United States Patent 8,541,208 (PROCESS FOR THE PRODUCTION OF FINE CHEMICALS) - sequence listing, part 19

SEQ ID NO: 105980 - DNA, 660 bp, Vibrio vulnificus CMCP6
  CDS (1)..(660): transl_table=11
atgaaaattttggtagtggaagatgaccctcgtttgggcgaacagattattgaatccctcgaaaaaacgggctgggtgcctgagctttctcaagatggaatcgatgctttgtaccgtgcgacgtcagaagagtgggatgcaatagtgctggatctaggcctaccgaagttagacggattaaccgtactaaaaggcattcgtgacgaaaacatcaacacaccagtggttattttaagtgcgcgagatacccttactcaacgcgtggaaggcttaaacgcaggtgccgatgattacttaaccaaaccgtttgaaatggttgaactgatcgctcgcattcgcgcccaattgcgccgagcctccggtaacgcgtcaccagtaatgcaaatcggagacctgagcttggacacacgtacgtcaaaagtgatgtggcagggtcaggcggtgagtttgaccgcactggaatacaaagtggttgcctattttgtgcataacgccgataaagtgatttcacgtactgagctggtggaacacatctacaagcaagacttcgaccgtgattccaataccattgaagtcttcattggacgcattcgtaagaagatcgcacccaatatcattaaaaccgttcgcggccttgggtatcagctcaatgccaactaa

SEQ ID NO: 105981 - protein, 219 aa, Vibrio vulnificus CMCP6
MKILVVEDDPRLGEQIIESLEKTGWVPELSQDGIDALYRATSEEWDAIVLDLGLPKLDGLTVLKGIRDENINTPVVILSARDTLTQRVEGLNAGADDYLTKPFEMVELIARIRAQLRRASGNASPVMQIGDLSLDTRTSKVMWQGQAVSLTALEYKVVAYFVHNADKVISRTELVEHIYKQDFDRDSNTIEVFIGRIRKKIAPNIIKTVRGLGYQLNAN

SEQ ID NO: 105982 - DNA, 657 bp, Vibrio vulnificus CMCP6
  CDS (1)..(657): transl_table=11
atgcgattactactgattgaagacgacacactgcttggccaatccatggtgacttcgctaagtcgccatggctatacggtggattggttagaaaaaggctcaggcgttaccagcgcactgaaaactgaagatttcacggcagtgatcctcgatttaaccttaccggatatcgacggcttagacgtgctgcgcaacattcgcagtgcgggttttagcttgccagtggtgattttgaccgccagagacgatatcaaagatcgcgtccaaggcttagaccgaggcgcggatgattatctgggcaaaccttttgcgcttgaagagttattagcccgtttgcgggtggtaattcgtcgtcaatctggtagcgcaacggaagtgattgaagtgggcgaattgagcctctccctttccgagcagtcgattcgttatcaagaggtcgttttaaaactgacgcgtaacgaatttaaaatccttgcggcgttaatgaccaatgctgggcgagtgatgagtaaagatcagttgcagcagtctctgcacggttgggatgacagcgccagcgacaacgccattgaagtgcacattcacaacttgcgcaaaaaggcacccaacgtgccgattaaaaatatccgtggcgtggggtacatcattgaaaagtag

SEQ ID NO: 105983 - protein, 218 aa, Vibrio vulnificus CMCP6
MRLLLIEDDTLLGQSMVTSLSRHGYTVDWLEKGSGVTSALKTEDFTAVILDLTLPDIDGLDVLRNIRSAGFSLPVVILTARDDIKDRVQGLDRGADDYLGKPFALEELLARLRVVIRRQSGSATEVIEVGELSLSLSEQSIRYQEVVLKLTRNEFKILAALMTNAGRVMSKDQLQQSLHGWDDSASDNAIEVHIHNLRKKAPNVPIKNIRGVGYIIEK

SEQ ID NO: 105984 - DNA, 675 bp, Bradyrhizobium japonicum USDA 110
  CDS (1)..(675)
atgcgcctgctcgttgttgaggacgaccccgatctcaatcgccagctcaccaaggcgctgacggacgccggctatgtcgtcgaccgcgccttcgacggggaggaggggcactatctcggcgacaacgagccgtacgatgccgtcgtactcgacatcggcctgccgaagaaggacggcatctcggtgctggaggcctggcgccgcaacggccgcaccatgccggtcctgatcctcaccgcgcgcgaccgctggagcgacaaggtccagggcttcgatgccggcgccgacgactatgtcgcaaagccgttccatctcgaggaggtgctggcgcgcatccgcgcgctgctgcgccgttccaccggccatgcccagagcgaactcagctgcggcccggtcacgctcgacaccaggaccggccgggtcagcgtgtccggcaatcccgtcaagatgacctcgcacgaatatcggcttctggcctacctgatgcaccattccggacgcgtggtctcccgcaccgagctggtcgagcatctctacgaccaggacttcgaccgcgactccaacaccatcgaggtcttcgtcggccgtattcgcaagaagctcgacgtcgacatcatccagaccgtccgcggcctcggctatctcctgaccccgccgcccgctccgggcgcctga

SEQ ID NO: 105985 - protein, 224 aa, Bradyrhizobium japonicum USDA 110
MRLLVVEDDPDLNRQLTKALTDAGYVVDRAFDGEEGHYLGDNEPYDAVVLDIGLPKKDGISVLEAWRRNGRTMPVLILTARDRWSDKVQGFDAGADDYVAKPFHLEEVLARIRALLRRSTGHAQSELSCGPVTLDTRTGRVSVSGNPVKMTSHEYRLLAYLMHHSGRVVSRTELVEHLYDQDFDRDSNTIEVFVGRIRKKLDVDIIQTVRGLGYLLTPPPAPGA

SEQ ID NO: 105986 - DNA, 675 bp, Bradyrhizobium japonicum USDA 110
  CDS (1)..(675)
atgcgccttctgatcgtcgaagacaatgccgagctgtcgcggctggtggccgccgggctgtcggcggccggctacgagagcgacatcgtgagcagcgcggccgaggcgcgcgaggcggtcggcagcgtcagctatgccgcgatgatcctcgacctcggccttcccgacggcgacggcctgtcggtgctgcgcgagctgcgccggcagatggagccgctgccggtgctggtgctgaccgcgcgcggcggcttgcaggatcgcgtcaacggcctgcgcagcggcgccgacgactatctcgcaaagccgttcgcgatggaggaactggtggcgcggctggaggcgatcctgcgccggccgggccagctgctcggccgctcgctgcgattggccaacctcgtctacgacaccgagagccgccagatcttcatcgacgaccagccgcggatcatctccgcgcgcgaggcctcggtgctcgagatcctgctgcgccggcaggggcgggtggtgccgaagaagaacgtcgaggatcacatcttcggcctcgaaggcgaggtcgcctccaacgccgtcgaggtctacgtctcgcggctgcgcaagcagctcaccgaacacggcgccaaggtcgtgatccacaccatccgcggcgtcggctatctcatggccgaggagaaatag

SEQ ID NO: 105987 - protein, 224 aa, Bradyrhizobium japonicum USDA 110
MRLLIVEDNAELSRLVAAGLSAAGYESDIVSSAAEAREAVGSVSYAAMILDLGLPDGDGLSVLRELRRQMEPLPVLVLTARGGLQDRVNGLRSGADDYLAKPFAMEELVARLEAILRRPGQLLGRSLRLANLVYDTESRQIFIDDQPRIISAREASVLEILLRRQGRVVPKKNVEDHIFGLEGEVASNAVEVYVSRLRKQLTEHGAKVVIHTIRGVGYLMAEEK

SEQ ID NO: 105988 - DNA, 696 bp, Xylella fastidiosa Temecula1
  CDS (1)..(696): transl_table=11
atgcgcctattgttgattgaggacaatgctgatcttgccgatgcgatcatccggcgcatgcggcgtcacggtcatgcggtggattggcagagcgatggtctagctgctgcgggcgtgttgcgttaccagcgctttgacctggtggtgttggatattggcttacccagtttggatggcttgcagttgctgagtgagttgcgccagcgtggcgacacgacaccggtgctgatactgacggcacgtgatgccattgaagatcgtgtgtatacgttgaatgttggtgccgacgactacttgagcaaaccgttcgactttcgtgagtttgaggcgcgttgccgtgtcttgttgcgtcgtaaccgtggtaatgccagtgaagtggtgcggattggcggctttgagtttgataatgcagcgcatcgcatctgtttgaacggtgagccgatcaaattacctaatcgtgaataccggcttctggagatattgattgcccggttgggtcaaatcgtgggtaaagacgagattggcaacagcttgttcaattttgatgacaatgccgggccgaatgcgattgaactttatgtggcacggttgcgtaggaaattggaagcggcgccactgcgtatcgtgactgtgcgtcgtgcaggctatctcctcgaaccgatcgttgaggctaggggccatgaagcgtgcgattaa

SEQ ID NO: 105989 - protein, 231 aa, Xylella fastidiosa Temecula1
MRLLLIEDNADLADAIIRRMRRHGHAVDWQSDGLAAAGVLRYQRFDLVVLDIGLPSLDGLQLLSELRQRGDTTPVLILTARDAIEDRVYTLNVGADDYLSKPFDFREFEARCRVLLRRNRGNASEVVRIGGFEFDNAAHRICLNGEPIKLPNREYRLLEILIARLGQIVGKDEIGNSLFNFDDNAGPNAIELYVARLRRKLEAAPLRIVTVRRAGYLLEPIVEARGHEACD

SEQ ID NO: 105990 - DNA, 663 bp, Pseudomonas syringae pv. tomato str. DC3000
  CDS (1)..(663): transl_table=11
atgcgcctgcttcttgtcgaggatgatcgtgcgatcggccaaggtatccgcgtggcccttaataccgaaggctatacgctggactggctggaagacgggctgagcgcgctgcatgccctgcgcagcgaacccttcgacctgctgttgctcgacctcggcctgccacgcatggacggcttcgacctgctgcgccagttgcgcgccgaagaactcgccctgccggtgctgatcctgacagcccgcgacggcaccgccaaccgcattgccgggctggacgcgggggccgacgattacctgatcaagccgttcgacgtcgatgaactgaaggcccgcgtgcgtgccctgctcaggcgcagccaggggcgcgcgcagccgttgctggaacacgccggcatcagcctcgacccggcgtcgcagcaggtcagttttcagggcagcgaagtactgatgacgccgatggaatatcaactgctgcaccaactgatgatccgccccggcaaagtggtgacccgcgagcgcctgtccaacaccctgtacggctggcaggacaaggtcgaaagcaacaccctggaagtgctgattcacaacctgcgcaaaaaactgtccaccgagctgatccgcaccgtgcgcggcgtcggttacctgctggagctcaaggcatga

SEQ ID NO: 105991 - protein, 220 aa, Pseudomonas syringae pv. tomato str. DC3000
MRLLLVEDDRAIGQGIRVALNTEGYTLDWLEDGLSALHALRSEPFDLLLLDLGLPRMDGFDLLRQLRAEELALPVLILTARDGTANRIAGLDAGADDYLIKPFDVDELKARVRALLRRSQGRAQPLLEHAGISLDPASQQVSFQGSEVLMTPMEYQLLHQLMIRPGKVVTRERLSNTLYGWQDKVESNTLEVLIHNLRKKLSTELIRTVRGVGYLLELKA

SEQ ID NO: 105992 - DNA, 684 bp, Pseudomonas syringae pv. tomato str. DC3000
  CDS (1)..(684): transl_table=11
atgacccgaattctggcaatcgaagatgatgccatcaccgcaaaggaaattgtcaccgaactcagcagccacgggctggaagtggactgggtggacaacggccgtgacggcctggcgcgtgcagtgagcggcgactacgacctcattaccctggaccgcatgctgccggagatggatggcctgaccatcgtcacccacctgcgtgcccagggcatttccacgccgatcctgatgatcagcgcgctgtccgatgtggacgaacgcgtacgcgggctaagggccggaggcgatgattatctgcccaaaccgttcgcgtcggacgaaatggcagcacgcgtcgaggtccttctgcgccgcagcaacccggtcagcgcggccaagaccgtgttgcaggttgccgacctggagctgaacctgatcagccgcgaagcctgtcgggggggtgagccgttgatcctgctgcccaccgagttcaagctgctggaatttctgatgcgcaacagcgggcaaatcatcacgcgcatgatgatcttccaggaagtatggggctatcacttcgacccgggcaccaacctgatcgatgtgcacatcggccgtctgcgcaagaagatcgatcaacctggcaccgcacagctgatccagaccgtgcgagggtcaggttatgtcattgccgaacccgtctaa

SEQ ID NO: 105993 - protein, 227 aa, Pseudomonas syringae pv. tomato str. DC3000
MTRILAIEDDAITAKEIVTELSSHGLEVDWVDNGRDGLARAVSGDYDLITLDRMLPEMDGLTIVTHLRAQGISTPILMISALSDVDERVRGLRAGGDDYLPKPFASDEMAARVEVLLRRSNPVSAAKTVLQVADLELNLISREACRGGEPLILLPTEFKLLEFLMRNSGQIITRMMIFQEVWGYHFDPGTNLIDVHIGRLRKKIDQPGTAQLIQTVRGSGYVIAEPV

SEQ ID NO: 105994 - DNA, 669 bp, Pseudomonas syringae pv. tomato str. DC3000
  CDS (1)..(669): transl_table=11
atgcgcctgttactggttgaagaccatgttcccctggcggatgagctgctggctgcgctgggacgacaaggctatgcggtcgactggctggctgatgggcgtgatgctgtctatcagggcgcaagcgaaccctacgaccttattgtgctcgacctgggcctgccaggcatgccggggctcgaagttctgcagcagtggcgcggtaagggtctggcgacaccggtgctgattttgacggcgaggggctcttgggcggagcgtatcgaaggcctgaaagccggtgccgatgactacctgaccaaacctttccaccctgaagagctgcaattgcgcattcaggcgctgctgcgccgttcgcatggcatggccaaccagcctacgctggagtctgccggactcaatctggacgaagggcgccagtgcgtcagtcgcgatggtaccgacatccagctcacgtctgccgagtttcgtctgctgcgctacttcatgctccaccctgggcagatcctctccaaaagccatctgtccgagcatttgtacgacggtgaaaacgagcgtgactccaacgtcatcgaggttcacgtcaatcacctgaggcgcaagctggggcgtgcggtgatcgagacgcgccgtggccaaggttatctttacggtggagccgggggttga

SEQ ID NO: 105995 - protein, 222 aa, Pseudomonas syringae pv. tomato str. DC3000
MRLLLVEDHVPLADELLAALGRQGYAVDWLADGRDAVYQGASEPYDLIVLDLGLPGMPGLEVLQQWRGKGLATPVLILTARGSWAERIEGLKAGADDYLTKPFHPEELQLRIQALLRRSHGMANQPTLESAGLNLDEGRQCVSRDGTDIQLTSAEFRLLRYFMLHPGQILSKSHLSEHLYDGENERDSNVIEVHVNHLRRKLGRAVIETRRGQGYLYGGAGG

SEQ ID NO: 105996 - DNA, 672 bp, Pseudomonas syringae pv. tomato str. DC3000
  CDS (1)..(672): transl_table=11
atgcgtgttcttcttgtggaagatcatctgcaattggctgaaagtgtcgcgcaggcgctcaagagcgcgggtttgaccgtggatgtgctgcacgatggcgttgccgccgacctggcgctgagcagcgaagagtacgccgtcgccattctcgatgtcggtcttccgcgcatggacggttttgaagtgctggcacgtttacgggcgcgcagcaagaacctgccggtgcttatgctgaccgcccgcagcgacgtcaaagaccgggttcacggcctgaatctgggggccgacgattacctggccaagccgttcgagctctccgagctggaagccagggtcaaggcactgttgcgtcgcagtgtgctgggcggcgagcgccagcagcgctgtggtgtactggcctacgatctggacacgcgccgttttacattgagcgatgagttgctcacgttgacctcccgcgaacaggcggtgctcgaagccttgatcgcccggccgggcagggtcatgagcaaagagcaactggccgcgcaggtgttcggcctcgatgaagaggccagtcctgacgccatcgaaatctacgtccatcgtctgcgcaagaagctcgacgggcattctgtgggcatcgtgaccttccggggtctggggtatctgcttgaaagtcgcgatgattaa

SEQ ID NO: 105997 - protein, 223 aa, Pseudomonas syringae pv. tomato str. DC3000
MRVLLVEDHLQLAESVAQALKSAGLTVDVLHDGVAADLALSSEEYAVAILDVGLPRMDGFEVLARLRARSKNLPVLMLTARSDVKDRVHGLNLGADDYLAKPFELSELEARVKALLRRSVLGGERQQRCGVLAYDLDTRRFTLSDELLTLTSREQAVLEALIARPGRVMSKEQLAAQVFGLDEEASPDAIEIYVHRLRKKLDGHSVGIVTFRGLGYLLESRDD

SEQ ID NO: 105998 - DNA, 675 bp, Salmonella enterica subsp. enterica serovar Typhi Ty2
  CDS (1)..(675): transl_table=11
atgcgtctcttattggcggaagataaccgtgagctggctcactggctggagaaagcgctggtgcaaaacggctttgccgtggactgcgtatttgacggcctggcggctgaccatcttctgcacagtgaaatgtatgcgctgatggtgctggatatcaatatgccgggaatggatggactggaggtggtgcaacggctgcgtaaacgcggtcagaccttgcccgttttgctgctcacggcgcgaagcgcggtggcggatcgcgtaaaaggtctcaacgtcggcgcggatgactatctgccgaaaccctttgaactggaagagctggatgcccgtttacgggccttgctccgacgcagcgctgggctggttcatgaagttcagcaactgggtgaattgatctttcatgatgaagggtattttctgttacagggacagccgttagcgctgacgccgcgtgagcaggcgctcttaaccgtattgatgtaccgacgaacgcggcctgtctcgcgtcagcagctttttgaacaggtgttcagcctgaacgatgaggtaagccctgaaagcatcgaactttatattcatcgactgcgtaaaaaacttcagggaagcgatgtacgaattacgacgctgcgcggcctgggttatgtgctggagcgcggcgatgaagtgggttaa

SEQ ID NO: 105999 - protein, 224 aa, Salmonella enterica subsp. enterica serovar Typhi Ty2
MRLLLAEDNRELAHWLEKALVQNGFAVDCVFDGLAADHLLHSEMYALMVLDINMPGMDGLEVVQRLRKRGQTLPVLLLTARSAVADRVKGLNVGADDYLPKPFELEELDARLRALLRRSAGLVHEVQQLGELIFHDEGYFLLQGQPLALTPREQALLTVLMYRRTRPVSRQQLFEQVFSLNDEVSPESIELYIHRLRKKLQGSDVRITTLRGLGYVLERGDEVG

SEQ ID NO: 106000 - DNA, 669 bp, Salmonella enterica subsp. enterica serovar Typhi Ty2
  CDS (1)..(669): transl_table=11
atgaagatactgattgttgaagacgacacgctattattacaggggttaatactcgccgcgcaaaccgaaggctatgcgtgtgatggcgtttcgacagcgcgtgccgccgagcatagtctggagtctggtcattacagtctgatggtgctggatttagggctgcccgatgaggatggcctgcatttcctgacgcgaatccgacagaaaaaatacaccctgccggtactcattctgaccgcccgcgatacgctcaacgaccgcattagcgggctggatgtcggcgcagatgattatctggtaaaacccttcgccctggaggagctgcacgcccgcatccgcgcgttgctgcgccgccataataaccagggtgaaagtgaactgacggttggcaatctgacgctcaatataggccgccatcaggcatggagggatggacaggaactgaccctgacgcctaaggagtacgcgctgctctcacgattgatgctcaaggcaggcagtccggtgcaccgggaaattctttataacgatatctacaactgggataacgaaccctcgaccaacactctggaagtgcatatacataatttgcgcgacaaagtcggcaagtcgcgcattcgcacggttcgcaggtttggctacatgctggttgccactgaggaaagctaa

SEQ ID NO: 106001 - protein, 222 aa, Salmonella enterica subsp. enterica serovar Typhi Ty2
MKILIVEDDTLLLQGLILAAQTEGYACDGVSTARAAEHSLESGHYSLMVLDLGLPDEDGLHFLTRIRQKKYTLPVLILTARDTLNDRISGLDVGADDYLVKPFALEELHARIRALLRRHNNQGESELTVGNLTLNIGRHQAWRDGQELTLTPKEYALLSRLMLKAGSPVHREILYNDIYNWDNEPSTNTLEVHIHNLRDKVGKSRIRTVRRFGYMLVATEES

SEQ ID NO: 106002 - DNA, 672 bp, Coxiella burnetii RSA 493
  CDS (1)..(672): transl_table=11
atgcgggtgttacttgttgaagatgatgaatttctcggcgatggtatccgggcaggcttaaagcagtacggccatacgattgattgggtaagagacggccaagccgctcacgatgttctttcttccactcacgaaacttttgatattattatcctcgacctcggtcttcctaaacgctccggattagatgttttaaaaactattcgcgaaaaaaacgatcccactcctgtggttatcctaacggctcgcgataccgtcgacgatcgcatcaaagggctcgatgcaggatcagacgattatatgactaagccctttgaccttgaagaactttgtgcccgtatgcgcgccatgcagcgtcgctccaaagaacgagcaaaaccgatcatttctcatggcgatattactctagaccctgcttctcacgtcgtaacgcttaagaagaaagaagtgatggttgcccgccgagaatttgcgttacttcaaaaattactggaaaacgcggggcgcgtcatttcacgagaacaactcaatcaaaccctctatggctggggggaaaatattgatagcaatgctctggaagtccatattcacaacttacgcaaacgatttggggcgaaactaatacgcaccattcggggtgtgggttacatggtagaaaaaaagtctgaatga

SEQ ID NO: 106003 - protein, 223 aa, Coxiella burnetii RSA 493
MRVLLVEDDEFLGDGIRAGLKQYGHTIDWVRDGQAAHDVLSSTHETFDIIILDLGLPKRSGLDVLKTIREKNDPTPVVILTARDTVDDRIKGLDAGSDDYMTKPFDLEELCARMRAMQRRSKERAKPIISHGDITLDPASHVVTLKKKEVMVARREFALLQKLLENAGRVISREQLNQTLYGWGENIDSNALEVHIHNLRKRFGAKLIRTIRGVGYMVEKKSE

SEQ ID NO: 106004 - DNA, 675 bp, Bacillus cereus ATCC 14579
  CDS (1)..(675): transl_table=11
atgcgagttcttatcgtcgaagatgaacaagacttacaaaatatattggtgaaacgattaaatgcagaacattatagtgtcgatgcatgtgggaatggagaagatgccctggattatataaacatggctacctacgatttgattgtccttgacattatgattcccggaatagatggtttacacgtattacaaagattacgcgcggacaataatgcaactcctgtcttgcttcttacagctaaagatacaattgatgatcgtgtaacaggactcgacttaggtgcagatgattatttagtaaagccgtttgcttttgatgaactgttagcaagaattcgagtgttaatgcgaagaacaacaggaaatacatctaatgtatttgaaatcgctgacctagtggtagattgcaatatgcataaagtaacacgaggagaccaagttatcactctttccagtaaagaatttgcaattttagaatatatgattcgtaataaagaagttgtgctgacacgagataaaattgagcaacatgtgtggaattacgactatgacggcggatcgaatattattgatgtttacgtccgctatcttcgtaaaaaaattgatagccagtttgaaacgaagttaattcatacagtgcgcggaactggttacgtattgcgagtagaatcatga

SEQ ID NO: 106005 - protein, 224 aa, Bacillus cereus ATCC 14579
MRVLIVEDEQDLQNILVKRLNAEHYSVDACGNGEDALDYINMATYDLIVLDIMIPGIDGLHVLQRLRADNNATPVLLLTAKDTIDDRVTGLDLGADDYLVKPFAFDELLARIRVLMRRTTGNTSNVFEIADLVVDCNMHKVTRGDQVITLSSKEFAILEYMIRNKEVVLTRDKIEQHVWNYDYDGGSNIIDVYVRYLRKKIDSQFETKLIHTVRGTGYVLRVES

SEQ ID NO: 106006 - DNA, 672 bp, Nitrosomonas europaea ATCC 19718
  CDS (1)..(672): transl_table=11
atgcgtattctggttgtcgaagatgattctctggtggcaagcggcatcaaacagggactgaccaacgcgggctataccgtggatgtggcacgaaacgccgcaagtgctgaacgccatctccgcgaagagaattttgatctggccgtggtagacatcggtctgccggatatcgatggattgaccctcgtgcaacgactgcgtcaccggaaaatgtgcctgcccgtgctggtgctgacggcacgcggcagcatggaagacaccattgccggcctcgatatcggtgcggacgactatatgaccaaaccattccgcctgccggagctgatcgcccgtatccgcgccctgatccgccgcgcccattcgatcaccagtaccgaattgcagcatgaccgactggttctcaataccggcagctatacagcgacattgaacgatcagccgcttttgctgacccggcgcgaatggacaatcctcgaaaccctgctgatggcctctccccgcgtagtcagcaaggacaaactactgcagaacctgacaggctgggacaagaacattacccccaatgccatcgaagtccacgtatcacgtctgcgcgccaagatcgccccgggcgggatcgaaattcgcacggttcgcggcatcggctatcgtatcgaccagagtcactcatga

SEQ ID NO: 106007 - protein, 223 aa, Nitrosomonas europaea ATCC 19718
MRILVVEDDSLVASGIKQGLTNAGYTVDVARNAASAERHLREENFDLAVVDIGLPDIDGLTLVQRLRHRKMCLPVLVLTARGSMEDTIAGLDIGADDYMTKPFRLPELIARIRALIRRAHSITSTELQHDRLVLNTGSYTATLNDQPLLLTRREWTILETLLMASPRVVSKDKLLQNLTGWDKNITPNAIEVHVSRLRAKIAPGGIEIRTVRGIGYRIDQSHS

SEQ ID NO: 106008 - DNA, 687 bp, Nitrosomonas europaea ATCC 19718
  CDS (1)..(687): transl_table=11
atgatgagcaccatgagagttcttgttgccgatgatcatgaagaaacgctgaacttcatccggcgcggactgacgcaggcgggtcatatcgtctccacggtcgacaatggccgtgaagcgctcttccgcgctaccgaggaaagctatgatgcaattgtcctcgatcgcatgttacccggactcgacggtctgtcgatcctcaaaatgttacgtgctggcggcatccgaacgccagtgctgctgctcactgccatgaccaggatagcggaccgggtggaaggattggagaacggtgcggacgattatctcgtcaagccctttgcattttccgaactgcacgcgcgtctcaacgtgattatccggagacctgccgttctggaaccggaaacaagcctccgcgtgctggacatcgaactggacctcggcaagcgtatcgcccgccgaggcggaaggcgcatcgatcttcagccgcgtgagctgctgatgcttgaagtacttctgcgtaatcctcatcgggtcatgacaaagacgatgctgcttgaacgtgtctgggattttgacttcgatcctcagaccaatattgtcgaaacccatatcagtcgcctgcgcgcgaagctcaatgccgacttcgatcaggatgcgatcatcacagtccgcggcgcaggctatatgatccgcagcgaatga

SEQ ID NO: 106009 - protein, 228 aa, Nitrosomonas europaea ATCC 19718
MMSTMRVLVADDHEETLNFIRRGLTQAGHIVSTVDNGREALFRATEESYDAIVLDRMLPGLDGLSILKMLRAGGIRTPVLLLTAMTRIADRVEGLENGADDYLVKPFAFSELHARLNVIIRRPAVLEPETSLRVLDIELDLGKRIARRGGRRIDLQPRELLMLEVLLRNPHRVMTKTMLLERVWDFDFDPQTNIVETHISRLRAKLNADFDQDAIITVRGAGYMIRSE

SEQ ID NO: 106010 - DNA, 693 bp, Mycobacterium bovis AF2122/97
  CDS (1)..(693): transl_table=11
gtgtccgtgcgaattcttgtcgttgacgacgatcgtgcggtgcgcgagtcgctgcgccggtcgctttccttcaatggctattcggtcgaactggcccacgacggggttgaggcgctcgacatgattgccagcgatcgccccgacgcgttggtcctggatgtcatgatgccgcggctggacggcctcgaggtgtgccgtcagctccgcagcaccggcgacgacctgccgattctggtgctgaccgcgcgcgactcggtgtccgagcgggtggccgggctggacgccggtgccgacgactacctaccaaagccgttcgccctcgaagagctgctggcacggatgcgggcgctgctgcgccgcaccaagcccgaggatgccgccgagtcgatggccatgaggttctccgacctgacgctggacccggtaacccgcgaagtcaaccgtggacagcgccggatcagcctgacccgcaccgaatttgcattgctggagatgctgatcgccaatccgcggcgagtgctgacgcgcagccgtatcctggaagaggtatggggattcgactttcccacctcgggcaacgcgctggaagtctacgtcgggtatctacgccgcaagaccgaggccgacggcgagccgcggctgatccacactgtgcgcggagtgggttacgtgctacgtgaaacaccaccctga

SEQ ID NO: 106011 - protein, 230 aa, Mycobacterium bovis AF2122/97; identical to SEQ ID NO: 8472

SEQ ID NO: 106012 - DNA, 687 bp, Bordetella pertussis Tohama I
  CDS (1)..(687): transl_table=11
atgcgcatattgctggttgaagacgagcgcgacatggcggcctggctgatgcgggcgctggcgcagagcgggttcacgcccgaccacgcgccggacgcccgtacggccgaaggcctgatggtgggcaacgaatatgatgcggtggtcatggacctgcgcctgcccgacaagcacgggctggtgctgctgcgcgaaatgcgcaaccgggacgaccgtacgccggtgctgctgctgaccgcccagggcgcgctgcaggaccgggtgcgcgggctcaatctcggcgccgacgatttcctgaccaagccgttcgcgctcgaagagctggaggcccgcctgaccgccctggtgcggcgcagccgcggccggcagcccccccgcctgcaatgcggctcgctgtcgtacgacggcgaaagccgcgccttcaccctggacggtgcgctgctgttcctgacgccgcgcgagcatgccgccctggcggcgctgctgacccgcagcggctatccggtcgacaagtcgcagcttttcggcaaagtgttcacgcacgaaagcgaggccaatcccgacgccatcgaagtggtgctgcaccgcctgcgcaagaaactgacgggcagcgacgtgcgcatcgtcacggtgcgcggcctgggatacatgctggaaagcaccgtcagtgaatcctccgaaagctga

SEQ ID NO: 106013 - protein, 228 aa, Bordetella pertussis Tohama I
MRILLVEDERDMAAWLMRALAQSGFTPDHAPDARTAEGLMVGNEYDAVVMDLRLPDKHGLVLLREMRNRDDRTPVLLLTAQGALQDRVRGLNLGADDFLTKPFALEELEARLTALVRRSRGRQPPRLQCGSLSYDGESRAFTLDGALLFLTPREHAALAALLTRSGYPVDKSQLFGKVFTHESEANPDAIEVVLHRLRKKLTGSDVRIVTVRGLGYMLESTVSESSES

SEQ ID NO: 106014 - DNA, 681 bp, Bordetella pertussis Tohama I
  CDS (1)..(681): transl_table=11
atgcgcattctgttgatcgaagacgaagccgaactcgcccgctggctatcgcgcagccttgcccgccatgccgggttcgtggtcgaatgggccgatgacggcctgctggccgaacgccgcctggccgtggaagagttcgatgccatcatcctggacctcggcctgcccggcatggacggccataccctgttgacccgcatccgcgcccgcgacgaccgtacgccagtcctggtcctgaccgcgcgcgattcgctggccgaaagagtgggtaccctgcaccagggcgccgacgacttcctgcccaagcctttcgtgctggaggagctcgaagcccgcctgaccgcactgatccgccgcagccgcggacgggaacatccccgcctgacgctgggcgacctggcactggataccgcgttacagcgattcaccgtcaaagggcagccgctggcgctttcgccccgggaacatgcggtgctgcgcgccctgatccagcgcagcggcgaaccgttgaacaagcaacagatcctcgatcgcatccagtccagcgacagcgatgtcaacctggaggccatcgaggtcctggtccatcggctgcgcaagaagctggccgacaccggcgtacagatcgtcaccatgcgcggcatgggctattgcctggagaacgctgttgacaacccgtag

SEQ ID NO: 106015 - protein, 226 aa, Bordetella pertussis Tohama I
MRILLIEDEAELARWLSRSLARHAGFVVEWADDGLLAERRLAVEEFDAIILDLGLPGMDGHTLLTRIRARDDRTPVLVLTARDSLAERVGTLHQGADDFLPKPFVLEELEARLTALIRRSRGREHPRLTLGDLALDTALQRFTVKGQPLALSPREHAVLRALIQRSGEPLNKQQILDRIQSSDSDVNLEAIEVLVHRLRKKLADTGVQIVTMRGMGYCLENAVDNP

SEQ ID NO: 106016 - DNA, 690 bp, Bordetella parapertussis 12822
  CDS (1)..(690)
atgcgtatcctgatagctgaagacgacagcatcctgaccgacggcctgtcccgctcgctgcggcacaacggctatgcggtcgacgccgtgcgcgacggactggccgccgattcggcgctggccgtccaacccttcgacctgctgatcctcgatctcggcctgccccacctgcccgggctggaggtgctgcgcaggctgcgcgcccgcaactccgtgctgccggtgctgatcctcaccgccgccgacagcatcgaacagcgcgtcaagggcctggatctcggcgccgacgactacatggccaagcctttcgcgctgtccgagctcgaggcccgcgtgcgcgccctgacgcggcgcggcgccggcggcggcgcgacgatcgtgcggcacggccgcctggtgttcgaccagacgggccgcatcgccacggtcgacgaccagaccctggacctgtccgcgcgcgaggtcagcctgctggagatcctgctggcgcgcagcggccgcatggtcagcaagacgcaactggtcgaccacctttgcgaatggggcgaggcagtcagcaccaacgccatcgaagtctatgtgcaccgcctgcgcaagaaactcgagcccagcggcgtgaaaatcatcaccgtgcgcggtctgggctattgcctcgagcgggaccagggtgcctcgtatctcgccagctga

SEQ ID NO: 106017 - protein, 229 aa, Bordetella parapertussis 12822
MRILIAEDDSILTDGLSRSLRHNGYAVDAVRDGLAADSALAVQPFDLLILDLGLPHLPGLEVLRRLRARNSVLPVLILTAADSIEQRVKGLDLGADDYMAKPFALSELEARVRALTRRGAGGGATIVRHGRLVFDQTGRIATVDDQTLDLSAREVSLLEILLARSGRMVSKTQLVDHLCEWGEAVSTNAIEVYVHRLRKKLEPSGVKIITVRGLGYCLERDQGASYLAS

SEQ ID NO: 106018 - DNA, 672 bp, Bordetella bronchiseptica RB50
  CDS (1)..(672)
atgcgagtactcgtaatcgaagatgacaccaccctgggccacgcgctccaggagtttctggccgaccaggggtatgcggtcgattggctgaccgagggcgacaaggtcctgggagccctggcgggccagccctacgatctcctcctgctggacctcaacctgcccggcatgagcggcctcgacgtactgcgccaattgcgccaggacggcaaccaggtgccggtactgatcctcaccgcgcgcgacggcctggacgaccgcgtggcgggtctggatgccggcgccgacgactatgtcaccaagcctttcgacctgcccgaactggcggcgcgcgtgcgcgccctgggacgccgccggtccgggcaggcgcagccccagatcgaggtcggcccgctggtgttcgacaccgtcgggcgcgaggtgcgcgccaacggcacgcgcctggcgttgtcggtgcgcgaactgtccgtgctggaaatgctgatggcgcgttccggccgggtcgtgaccaaacgccagatcgtcaattccctgtctgcctgggatgccgatttcagcgagaatgccgtcgaggtgtatgtctaccgcctgcgcaagcggctcgagggatccggcgccagcatccagacggtgcgcggcttcggctacatgctggacgtggaagcggcgtga

SEQ ID NO: 106019 - protein, 223 aa, Bordetella bronchiseptica RB50
MRVLVIEDDTTLGHALQEFLADQGYAVDWLTEGDKVLGALAGQPYDLLLLDLNLPGMSGLDVLRQLRQDGNQVPVLILTARDGLDDRVAGLDAGADDYVTKPFDLPELAARVRALGRRRSGQAQPQIEVGPLVFDTVGREVRANGTRLALSVRELSVLEMLMARSGRVVTKRQIVNSLSAWDADFSENAVEVYVYRLRKRLEGSGASIQTVRGFGYMLDVEAA

SEQ ID NO: 106020 - DNA, 690 bp, Bordetella bronchiseptica RB50
  CDS (1)..(690)
atgcgtatcctgatagctgaagacgacagcatcctggccgacggcctgtcccgctcgctgcggcacaacggctatgcggtcgacgccgtgcgcgacggactggccgccgattcggcgctggccgtccagcccttcgacctgctgatcctcgatctcggcctgccccacctgcccgggctggaggtgctgcgcaggctgcgcgcccgcaactccgtgctgccggtgctgatcctcaccgccgccgacagcatcgaacagcgcgtcaagggcctggatctcggcgccgacgactacatggccaagcctttcgcgctgtccgagctcgaggcccgcgtgcgcgccctgacgcggcgcggcgccggcggcggcgcgacgatcgtgcggcacggccgcctggtgttcgaccagacgggccgcatcgccacggtcgacgaccagaccctggacctgtccgcgcgcgaggtcagcctgctggagatcctgctggcgcgcagcggccgcatggtcagcaagacgcaactggtcgaccacctttgcgaatggggcgaggaagtcagcaccaacgccatcgaagtctatgtgcaccgcctgcgcaagaaactcgagcccagcggcgtgaaaatcatcaccgtgcgcggtctgggctattgcctcgagcgggaccagggtgcctcgtatctcgccagctga

SEQ ID NO: 106021 - protein, 229 aa, Bordetella bronchiseptica RB50
MRILIAEDDSILADGLSRSLRHNGYAVDAVRDGLAADSALAVQPFDLLILDLGLPHLPGLEVLRRLRARNSVLPVLILTAADSIEQRVKGLDLGADDYMAKPFALSELEARVRALTRRGAGGGATIVRHGRLVFDQTGRIATVDDQTLDLSAREVSLLEILLARSGRMVSKTQLVDHLCEWGEEVSTNAIEVYVHRLRKKLEPSGVKIITVRGLGYCLERDQGASYLAS

SEQ ID NO: 106022 - DNA, 672 bp, Bordetella bronchiseptica RB50
  CDS (1)..(672)
atgactcatttgctattggtggaagacgacccgatgctgggcgacgcgctgcagaccgcgctgcagcgcgaactcggcgcccgggtcgattgggtgcgcgacggcgcgcaggcgcagcttgcgctggtcgaccacgcctaccagctgatcctgctggacataggcctgcccggccagtccggcttggcgctgctgcgcgcgctgcgcgagggctacgacaccaccccggtgctgctggtgaccgcgcgcgaccagctcagcgaccgcatccgcggcctggacggcggcgccgacgactacatcgtcaagccgttcgaactggacgaactgctggcgcgcctgcgcgccgtgctgcgccgcagccacaaccaggtggcgccgctcatgcggcatggcgagctgctggtggacccggcggcgcgccaggtgtcgcgcgcgggccggcccgtcgcgctcagccagagcgaataccgcacgctactggcgctgatgcagcggcgcggccgcacggtctcgcgcgagcagctggagcacgatgtctacggcgccagcgtggcgctggaaagcaacacggtcgccgtgtacgtgcaccagttgcggcgcaagctgggcgacgacctgatcgagacggtgcacggctacggctatcgcatcggccaggaaggcgcatga

SEQ ID NO: 106023 - protein, 223 aa, Bordetella bronchiseptica RB50
MTHLLLVEDDPMLGDALQTALQRELGARVDWVRDGAQAQLALVDHAYQLILLDIGLPGQSGLALLRALREGYDTTPVLLVTARDQLSDRIRGLDGGADDYIVKPFELDELLARLRAVLRRSHNQVAPLMRHGELLVDPAARQVSRAGRPVALSQSEYRTLLALMQRRGRTVSREQLEHDVYGASVALESNTVAVYVHQLRRKLGDDLIETVHGYGYRIGQEGA

SEQ ID NO: 106024 - DNA, 678 bp, Bordetella bronchiseptica RB50
  CDS (1)..(678)
atgcgcatcctcgttatcgaagacgagcccaagctggccgactatctgcacaagggcctgtccgagcaaagccatatcgtcgacgtcgcgcgcgacggcgtcaacggccgccacctggcgctcgagggcgactacgaactggtcatcctcgacgtgatgctgcccgacatcgacggcttcgccgtcctggcggcgctgcgcgcggccgcgcgcaacacgccggtgctgatgctgacggcgcgcgaccgggtcgaggaccgcgtgcgcgggctggaaggcggcgccgacgactacctggtcaagccgttcgcgttctccgagctcctggcgcgcgtgcatgcgctgcagcggcgcgggcgcagccaggaatccaccctgctgcgcctggccgacctggagctggacctggccagccgcaaggcgcagcgcggcggacgccgcctggacctgacggccaaggagttctcgctgctggcgctgctgctgcgccgccagggccagatcctgtcgcgcaccacgctggccgagcaggtctgggacatgaacttcgacagcgacaccaacgtcatcgacgtcgccatccgccggttgcgcggcaagctggacgacccctacgacgccaagctgctgcataccgtgcgcggcatgggctacgtgctggaatcgcgcccgtcatga

SEQ ID NO: 106025 - protein, 225 aa, Bordetella bronchiseptica RB50
MRILVIEDEPKLADYLHKGLSEQSHIVDVARDGVNGRHLALEGDYELVILDVMLPDIDGFAVLAALRAAARNTPVLMLTARDRVEDRVRGLEGGADDYLVKPFAFSELLARVHALQRRGRSQESTLLRLADLELDLASRKAQRGGRRLDLTAKEFSLLALLLRRQGQILSRTTLAEQVWDMNFDSDTNVIDVAIRRLRGKLDDPYDAKLLHTVRGMGYVLESRPS

SEQ ID NO: 106026 - DNA, 672 bp, Bordetella bronchiseptica RB50
  CDS (1)..(672)
atggctatcctcgtcatcgaagacgacctcaagactggcgactacctgaagaaaggcttgctggaatccggctattccgtggatctcgcccgcaatggcatcgacggcctgcaccgcctgcgcgagcagcgctacgacgtgctggtgctcgatgtcatgctgccgggcaaggacggctggcaggtcatcgaagaggtacgccaggactccgacgtgccggtcatcttcctgacggcgcgcgaccatgtcgccgaccgcatccggggcctgcggctgggcgccgacgactacctggtcaagccgttctccttcgccgagctggtgctgcgcatccagacgatgctgcggcgcggcgcggcgcgcgcggccgaaacgctgcaggtcgccgacctgcggctcgacccggtgcggcgcaaggtcacccgcggcggcgccagcatcgtcctcaccaacaaggagttcatgctcctgcacctgctcatcagaaggcagggcgaagccctgtcgcgcaccatcatcgcctccgaagtctgggacatgaacttcgacagcgacaccaacgtggtggacgtggccatcaagcgcctgcgcgccaaggtcgacgccccgttccccctcaagctgatccagaccgtgcgcggcatcggctacgccctggcggagcagccttga

SEQ ID NO: 106027 - protein, 223 aa, Bordetella bronchiseptica RB50
MAILVIEDDLKTGDYLKKGLLESGYSVDLARNGIDGLHRLREQRYDVLVLDVMLPGKDGWQVIEEVRQDSDVPVIFLTARDHVADRIRGLRLGADDYLVKPFSFAELVLRIQTMLRRGAARAAETLQVADLRLDPVRRKVTRGGASIVLTNKEFMLLHLLIRRQGEALSRTIIASEVWDMNFDSDTNVVDVAIKRLRAKVDAPFPLKLIQTVRGIGYALAEQP

SEQ ID NO: 106028 - DNA, 681 bp, Bordetella bronchiseptica RB50
  CDS (1)..(681)
atgcgcattctgttgatcgaagacgaagccgaactcgcccgctggctatcgcgcagccttgcccgccatgccgggttcgtggtcgaatgggccgatgacggcctgctggccgaacgccgcctggccgtggaagagttcgatgccatcatcctggacctcggcctgcccggcatggacggccataccctgttgacccgcatccgcgcccgcgacgaccgtacgccagtcctagtcctgaccgcgcgcgattcgctggccgaaagagtgggtaccctgcaccagggcgccgacgacttcctgcccaagcctttcgtgctggaggagctcgaagcccgcctgaccgcactgatccgccgcagccgcggacgggaacatccccgcctgacgctgggcgacctggcactggataccgcgtcacagcgattcaccgtcaaagggcagccgctggcgctttcgccccgggaacatgcggtgctgcgcgccctgatccagcgcagcggcgaaccgttgaacaagcaacagatcctcgatcgcatccagtccagcgacagcgatgtcaacctggaggccatcgaggtcctggtccatcggctgcgcaagaagctggccgacaccggcgtacagatcgtcaccatgcgcggcatgggctattgcctggagaacgctgttgacaacccgtag

SEQ ID NO: 106029 - protein, 226 aa, Bordetella bronchiseptica RB50
MRILLIEDEAELARWLSRSLARHAGFVVEWADDGLLAERRLAVEEFDAIILDLGLPGMDGHTLLTRIRARDDRTPVLVLTARDSLAERVGTLHQGADDFLPKPFVLEELEARLTALIRRSRGREHPRLTLGDLALDTASQRFTVKGQPLALSPREHAVLRALIQRSGEPLNKQQILDRIQSSDSDVNLEAIEVLVHRLRKKLADTGVQIVTMRGMGYCLENAVDNP

SEQ ID NO: 106030 - DNA, 663 bp, Chromobacterium violaceum ATCC 12472
  CDS (1)..(663): transl_table=11
atgcggatactggtggtggaggacgacgcgcagatcggcgacggcctcaagatgggcctgcaacaactgggtttcgcggtggactggctgcgcgatggccggcaagcgctggccgcgctgccggccgcgccttacgacgccgtggtgctggacctgggcctgcccggcatggacggcatggacatcctcgccgcctggcgccgcgccgggcgcgacgagccggtgctggtgctgaccgcgcgcgacgcgctggccgaccgcgtcggcggcctggacgccggcgccgacgactacctggccaagcccttcgccttgtccgaggtggcggcgcggctgcgcgcgctgacccgccgccgccacggccaatgcggccccttgctcagccacggccggctcagcctggacccggtggcgcggacggcgacgctggacggcgcgctgctggagctgaccgcgcgcgagctggcgctgctggagctgctgctcagcagcaagggccgggtgttgtcgcgcgagctgatagaggaaaaactgtacggctggggacaggagttggggagcaacgcgctggaagtgcatgtccaccatttgcgcaagaagctgggcgcaggcttcatccgcacgctgcggggcataggctacacgctgggagagccggcgtga

SEQ ID NO: 106031 - protein, 220 aa, Chromobacterium violaceum ATCC 12472
MRILVVEDDAQIGDGLKMGLQQLGFAVDWLRDGRQALAALPAAPYDAVVLDLGLPGMDGMDILAAWRRAGRDEPVLVLTARDALADRVGGLDAGADDYLAKPFALSEVAARLRALTRRRHGQCGPLLSHGRLSLDPVARTATLDGALLELTARELALLELLLSSKGRVLSRELIEEKLYGWGQELGSNALEVHVHHLRKKLGAGFIRTLRGIGYTLGEPA

SEQ ID NO: 106032 - DNA, 666 bp, Chromobacterium violaceum ATCC 12472
  CDS (1)..(666): transl_table=11
atgagggtattactggttgaggacaatcggctgatcgctcagggcatcgttacaggcttgcgcgccaatggctgcatcgtggatgcggttggcagcgctgctcaggcggaccttgccctggccacattgaacgtggatgtgatgattctgaatctgggcttgccggatgagaatggcatgagcctgcttcgccgcctccgcactcgcggggtgagggtgcctatcctggtgctgactgcgcgggattcggttgaggacagggtggcggccttgcgcgccggcgccgacgattatctgctgaagccattcgacctggatgagctggtcgcgaggctgcatgcgctgactcggcgtatggccggccgcagcgtggatgtgatcgaggatggtcgcctgcgcttggacccggctcgaggcgaggtgtggctggatgaatcccctgtggcgctgacccgcagggaaatggccctgttgatggccttgctgcgcgccgatggccgcatcctcagtcccgaccagctgaaagacaggctgtacgactatagcgaggaaattgaaagcaatgccctgaacgtccatatctgccatctgcggcgcaagctcggtccgaatgtggtgaaaaccgtcaggggcttgggttatcgctatggcggagtcgggaagtga

SEQ ID NO: 106033 - protein, 221 aa, Chromobacterium violaceum ATCC 12472
MRVLLVEDNRLIAQGIVTGLRANGCIVDAVGSAAQADLALATLNVDVMILNLGLPDENGMSLLRRLRTRGVRVPILVLTARDSVEDRVAALRAGADDYLLKPFDLDELVARLHALTRRMAGRSVDVIEDGRLRLDPARGEVWLDESPVALTRREMALLMALLRADGRILSPDQLKDRLYDYSEEIESNALNVHICHLRRKLGPNVVKTVRGLGYRYGGVGK

SEQ ID NO: 106034 - DNA, 672 bp, Gloeobacter violaceus PCC 7421
  CDS (1)..(672): transl_table=11
gtgcacctgctgttggtcgaggacgaagcggaactggccgatcccctggctgcgatgctgaaacgcgaaggccacgtggtcgaaacaagctacgacggggagcacgcctgggatctgctttcaagccagagcttcgatttggtcatcctcgattggatgctgcctggtcactcgggactggatttgtgccgccggctgcgcgccggggggcgctcggtaccggtgttgatgctcaccgcccgcgacacgatcgacagcaaactcgccggttttgaggccggcgcggacgattatttggtcaaacccttcgagctgcgcgagttgcttgcccgggtgcgggccttgttgcgccgtcctcccgagcgacagtccgacgagttgcgtctgggtgatctggtgctcgatgtcagcaacaagcttgtccgccgcgccggtcgtcccatcgatctgtcggccaaagaatatcagttgctcgaatacttcatgcgccatcccggccagttgctcacccatgagcagatcctggagcacgtttgggactcgggggccgaaccgaacagcaacgtggtggcagcccaggttaaactgctgcgtcgcaaaatcgacaaagacgccggcactgccctgattcacacagtctacgggcagggttaccgcttcgggatgccgtaa

SEQ ID NO: 106035 - protein, 223 aa, Gloeobacter violaceus PCC 7421
MHLLLVEDEAELADPLAAMLKREGHVVETSYDGEHAWDLLSSQSFDLVILDWMLPGHSGLDLCRRLRAGGRSVPVLMLTARDTIDSKLAGFEAGADDYLVKPFELRELLARVRALLRRPPERQSDELRLGDLVLDVSNKLVRRAGRPIDLSAKEYQLLEYFMRHPGQLLTHEQILEHVWDSGAEPNSNVVAAQVKLLRRKIDKDAGTALIHTVYGQGYRFGMP

SEQ ID NO: 106036 - DNA, 660 bp, Vibrio vulnificus YJ016
  CDS (1)..(660): transl_table=11
atgaaaattttggtagtggaagatgaccctcgtttgggcgaacagattattgaatcccttgaaaaaacaggctgggtacctgagctttctcaagatggcatcgatgctttgtatcgtgcgacgtcagaagagtgggatgcaatggtgctagatctgggcctaccgaagttagatgggttaaccgtcctaaaaggcattcgtgacgaaaacatcaacacaccagtggttattttaagtgcccgagataccctcacgcaacgcgtggaaggcttaaatgcaggtgccgatgattacttaaccaaaccgtttgaaatggttgaactgatcgctcgcattcgcgcccaattgcgccgagcctccggtaacgcgtcaccggtaatgcaaatcggagacctgagcttggacacacgtacgtcaaaagtgatgtggcagggtcaggcggtgagtttgaccgcactggaatacaaagtggttgcctattttgtgcataacgccgataaagtgatttcacgtactgagctggtggaacacatctacaagcaagacttcgaccgtgattccaataccattgaagtcttcattggacgcattcgtaagaagatcgcacccaatatcattaaaaccgttcgcggccttggatatcagctcaatgccaattaa

SEQ ID NO: 106037 - protein, 219 aa, Vibrio vulnificus YJ016
MKILVVEDDPRLGEQIIESLEKTGWVPELSQDGIDALYRATSEEWDAMVLDLGLPKLDGLTVLKGIRDENINTPVVILSARDTLTQRVEGLNAGADDYLTKPFEMVELIARIRAQLRRASGNASPVMQIGDLSLDTRTSKVMWQGQAVSLTALEYKVVAYFVHNADKVISRTELVEHIYKQDFDRDSNTIEVFIGRIRKKIAPNIIKTVRGLGYQLNAN

SEQ ID NO: 106038 - DNA, 657 bp, Vibrio vulnificus YJ016
  CDS (1)..(657): transl_table=11
atgcgattactactgattgaagacgacacactgcttggccaatccatggtgacttcgctaagtcgccatggctatacggtggattggttagaaaaaggctcaggcgtcaccagcgcactgaaaaccgaagatttcacggcagtgatcctcgatttaaccttaccggatatcgatggcttagacgtgctgcgcaacattcgtagtgcgggttttaacttgcctgtggtgattttgaccgccagagacgacatcaaagatcgcgtccaaggcttagaccgaggcgcggacgattatctgggcaaaccttttgcgctagaagagctgctggcccgtttgcgcgtggtgattcgtcgtcaatctggtagcgcaacggaagtgattgaagtgggcgaattgaacctctctctttccgaccaatccattcgttatcaagaggccgttttaaaactgacgcgtaacgaatttaaaatccttgcggcgttaatgaccaatgctgggcgagtgatgagtaaagatcagttgcagcagtctctgcacggttgggatgacagcgccagcgacaacgccattgaagtgcacattcacaacttgcgcaaaaaggcacccaacgtgccgattaaaaatatccgtggcgtggggtacatcattgaaaagtag

SEQ ID NO: 106039 - protein, 218 aa, Vibrio vulnificus YJ016
MRLLLIEDDTLLGQSMVTSLSRHGYTVDWLEKGSGVTSALKTEDFTAVILDLTLPDIDGLDVLRNIRSAGFNLPVVILTARDDIKDRVQGLDRGADDYLGKPFALEELLARLRVVIRRQSGSATEVIEVGELNLSLSDQSIRYQEAVLKLTRNEFKILAALMTNAGRVMSKDQLQQSLHGWDDSASDNAIEVHIHNLRKKAPNVPIKNIRGVGYIIEK

SEQ ID NO: 106040 - DNA, 693 bp, Corynebacterium diphtheriae NCTC 13129
  CDS (1)..(693): transl_table=11
atgaagattgtggtcgtagatgatgagcaggcggtgcgcgagtcgctttgtcgttcgttgtcctttaacggatatgaagtgcatctggctcaagatggagtcgaggcacttgaagtaattgaacgtgaacaaccagagctggtcatccttgacgtgatgatgccacgcatggatggtcttgaggtttgccgcaccttgcgtggtagcggtgacgaccgtccgattttggttctgaccgctcgcgatggtgtgtctgatcgtgttgccggccttgatgctggtgcagacgactaccttcctaagccattcgcacttgaggagctactagctcgtgtgcgttccctgcttcgccgtgccgctgcagagtccgtcggctccggcagccaaggggagctttcctttgaggatcttcgcctaaaccccgatacgcgcgatgtcacccgcggtggtcgccctattagcttgactcgcactgagtttgcgctgctccagttgctgatggcgaattctcgtcgcgtactttcgcgtgcgtcgatcttggaagaagtgtggggatatgacttcccaacttctggaaacgcactggaagtctatattggctatttgcgtcgcaagactgaatcagaaggggagccacgtttgatccataccgttcgcggtgttggctacgtgctgagggaaactgcgccgtga

SEQ ID NO: 106041 - protein, 230 aa, Corynebacterium diphtheriae NCTC 13129
MKIVVVDDEQAVRESLCRSLSFNGYEVHLAQDGVEALEVIEREQPELVILDVMMPRMDGLEVCRTLRGSGDDRPILVLTARDGVSDRVAGLDAGADDYLPKPFALEELLARVRSLLRRAAAESVGSGSQGELSFEDLRLNPDTRDVTRGGRPISLTRTEFALLQLLMANSRRVLSRASILEEVWGYDFPTSGNALEVYIGYLRRKTESEGEPRLIHTVRGVGYVLRETAP

SEQ ID NO: 106042 - DNA, 681 bp, Serratia marcescens
  CDS (1)..(681): transl_table=11
atgaaaatattgatcgtcgaagacgaaattaaaacaggtgaatatctcagcaaagggcttacagaggcagggttcgtagtggatcacgctgataatggtcttaccggatatcatctcgccatgacagccgagtatgatttagtcattctggatatcatgctacctgatgtgaacggctgggatatcatccgcatgctgcgcactgccggaaagggtatgccggtcttactgctgacagccctcggcacgatcgaacatagggtcaaaggactggaactgggtgcggacgattatctggttaaaccctttgcgtttgccgaactgctcgcccgggtgagaacccttctgaggcggggaaacacgatgatcacggaaagccagtttaaggtggctgacctctcgattgatctcgtatccagaaaagtcagtcgcgccggaaaccgcattgtgctcaccagtaaagagttcagcctgctggaattcttcattcgccatcagggagaggttcttccccgctccctgattgcctctcaggtctgggacatgaattttgacagcgacactaatgcgatcgatgtcgcagtaaagcgactccgcgctaaaatagacaacgattacgagacaaagctgatccagacagtccggggcgtgggctacatgctggaggtcccggatgcatag

SEQ ID NO: 106043 - protein, 226 aa, Serratia marcescens
MKILIVEDEIKTGEYLSKGLTEAGFVVDHADNGLTGYHLAMTAEYDLVILDIMLPDVNGWDIIRMLRTAGKGMPVLLLTALGTIEHRVKGLELGADDYLVKPFAFAELLARVRTLLRRGNTMITESQFKVADLSIDLVSRKVSRAGNRIVLTSKEFSLLEFFIRHQGEVLPRSLIASQVWDMNFDSDTNAIDVAVKRLRAKIDNDYETKLIQTVRGVGYMLEVPDA

SEQ ID NO: 106044 - DNA, 681 bp, Klebsiella pneumoniae
  CDS (1)..(681): transl_table=11
atgaaaatattgatcgtcgaagacgaaattaaaacaggtgaatatctcagcaaagggctgacagaggcagggttcgtcgtggatcacgctgataatggtcttaccggatatcatctcgccatgacagccgagtatgatttagtcattctggatatcatgctacctgatgtgaacggctgggatatcatccgcatgctgcgcactgccggaaagggtatgccggtcttactgctgacggccctcggcacgatcgaacacagggtcaaaggactggaactgggtgcggacgattatctggttaaaccctttgcgtttgccgaactgctcgcccgggtgagaacccttctgaggcggggaaacacgatgatcacggaaagccagtttagggtggctgatctctcgatggatctcgtatccagaaaagtcagtcgcgccggaaaccgcattgtgctcaccagtaaagagttcagcctgctggaattcttcattcgccatcagggcgaggttcttccccgctccctgattgcctctcaggtctgggacatgaattttgacagcgacactaacgcgattgatgtcgccgtaaagcgactccgcgctaaaatagacaacgattacgggacaaagctgatccagactgtccggggcgtgggctatatactggaggccccggatgcatag

SEQ ID NO: 106045 - protein, 226 aa, Klebsiella pneumoniae
MKILIVEDEIKTGEYLSKGLTEAGFVVDHADNGLTGYHLAMTAEYDLVILDIMLPDVNGWDIIRMLRTAGKGMPVLLLTALGTIEHRVKGLELGADDYLVKPFAFAELLARVRTLLRRGNTMITESQFRVADLSMDLVSRKVSRAGNRIVLTSKEFSLLEFFIRHQGEVLPRSLIASQVWDMNFDSDTNAIDVAVKRLRAKIDNDYGTKLIQTVRGVGYILEAPDA

SEQ ID NO: 106046 - DNA, 675 bp, Rhodopseudomonas palustris CGA009
  CDS (1)..(675): transl_table=11
gtgcgtctgctcgtcgtcgaagatgaccccgatctcaaccgccagctcaccaccgcgctgaccgatgccggttacgtggtcgaccgcgccttcgatggcgaggaggggcatttcctcggcgacaccgagccgtacgacgctgtcgtgctcgacatcggcctgccgaagatggacggcatctcggtgctggaagcgtggcggcgcaacagccgcgcgatgccggtgctgatcctcaccgcgcgcgaccgctggagcgacaaggtgcagggcttcgacgccggcgccgatgattacgtcgccaagccgttccatctcgaggaagtgctggcgcggatccgcgcgctgctgcggcggagcgccggccatgcgcaatccgagctgacctgcggcccggtggtgctcgacacccgcaccggccgggtcagcgtcagcggcaatccggtgaagctgaccagccacgaatatcggctgctcgcctatctgatgcaccactccggccgggtggtgtcgcgcaccgagctggtcgagcatctgtacgatcaggatttcgaccgcgacagcaacaccatcgaggtgttcgtcggccgcatccgcaagaagctcggcgtcgacatcatccagaccgtgcgcgggctcggctatctgctgtcgccgccggccgcggacgcgcattag

SEQ ID NO: 106047 - protein, 224 aa, Rhodopseudomonas palustris CGA009
MRLLVVEDDPDLNRQLTTALTDAGYVVDRAFDGEEGHFLGDTEPYDAVVLDIGLPKMDGISVLEAWRRNSRAMPVLILTARDRWSDKVQGFDAGADDYVAKPFHLEEVLARIRALLRRSAGHAQSELTCGPVVLDTRTGRVSVSGNPVKLTSHEYRLLAYLMHHSGRVVSRTELVEHLYDQDFDRDSNTIEVFVGRIRKKLGVDIIQTVRGLGYLLSPPAADAH

SEQ ID NO: 106048 - DNA, 666 bp, Rhodopseudomonas palustris CGA009
  CDS (1)..(666): transl_table=11
atgcgggtgctggtggtcgaggacgacagccggatcgcgtcggagctggcgcgcggcctcggcgaagccggttacctcgccgagatcgtcggtgacggcgaagaggcgtggtttcgcggtgataccgaagattacgccgcgatcatcctcgacctcggtttgcccgggctcgacggcctcaccatcctgaagcgctggcgcgacaacggccgcctcaccccggtgctgatactcaccgcacgcggaagctgggccgaacgggtcgacggcatcgacgccggtgccgacgactacctgccgaagccgttccagatggaggagctgctggcgcggctgcgctcgatcgtgcggcgctcggccggccatgcctcgtcggtggtcaccatcggcgaggtcacgctcgacgagcggcagatgcaggtcagcgtcggcggcaagccggtctcgctgtcgccgcttgaatatcggctggcgtcctatctggtgctgcatcgcggccgggtggtgtcgcaatacgagcttgccgagaacatttacggccaggacgacgcccatgattccaacgccatcgaggtgctggtcggccgggttcgccgcaagatcggtgccgacctgatcgagacccggcgcggcttcggctacatcgtgccggacgagcgtccatga

SEQ ID NO: 106049 - protein, 221 aa, Rhodopseudomonas palustris CGA009
MRVLVVEDDSRIASELARGLGEAGYLAEIVGDGEEAWFRGDTEDYAAIILDLGLPGLDGLTILKRWRDNGRLTPVLILTARGSWAERVDGIDAGADDYLPKPFQMEELLARLRSIVRRSAGHASSVVTIGEVTLDERQMQVSVGGKPVSLSPLEYRLASYLVLHRGRVVSQYELAENIYGQDDAHDSNAIEVLVGRVRRKIGADLIETRRGFGYIVPDERP

SEQ ID NO: 106050 - DNA, 675 bp, Geobacter sulfurreducens PCA
  CDS (1)..(675): transl_table=11
atgaaggttctcgtggtcgaagatgagaagaaggtgtccagcttcatcaagcgggggctcgaggaagagaagtacgaggtcgatgccgcgttcaacggcgaggaagggctcaagatggccctggacaagggctacgatctgatcgttctcgacgtgatgctgcccaaaaaggatggtctcagcgtggtacgtgagctccgggagcgcaagaacagcacaccggttctgatgctgacagccaaggactcggtggaggatatcgtggccggtctcgattcgggttccgacgactacctgaccaagcccttcgcttttgctgagcttctggcccgggtccgggccttggtgcgtcgcagcgagcaggatcgcggggcagagatccgctttgctgatctgcggctcgacccggtgacccacaaggtctggcgcaaggacaaagagatcgacctcaccgccaaggagtattcgctgctcgagtacttcatgcggaaccccaaccaggtccttacccgcaccatgatcgccgagcacgtgtgggactacacctttgacagcttcaccaatatcattgacgtctacgtcaactacctgcgcaagaagatcgaccgggagtccgacaagaagctcatccacaccgtccgcggcgtgggctatatcctgaaggaggaggattga

SEQ ID NO: 106051 - protein, 224 aa, Geobacter sulfurreducens PCA
MKVLVVEDEKKVSSFIKRGLEEEKYEVDAAFNGEEGLKMALDKGYDLIVLDVMLPKKDGLSVVRELRERKNSTPVLMLTAKDSVEDIVAGLDSGSDDYLTKPFAFAELLARVRALVRRSEQDRGAEIRFADLRLDPVTHKVWRKDKEIDLTAKEYSLLEYFMRNPNQVLTRTMIAEHVWDYTFDSFTNIIDVYVNYLRKKIDRESDKKLIHTVRGVGYILKEED

SEQ ID NO: 106052 - DNA, 672 bp, Geobacter sulfurreducens PCA
  CDS (1)..(672): transl_table=11
atgcgcgtcctgatcatcgaagacgaaaagaaggccgccgcctacctccaaaaggggttcgcggagaacggcttcacggccgacaccgccgcatccggcgacgacggcctccacttggcgcgtaccgagaactatgacctgatcatcctcgacatcatgctgcccggccgggacggatgggaagtactggaagagctgcggaaagaagggagcgaggtgccggtcatctacctgtcggcccgggatgcggtgcacgaccgggtgcgagggcttgaactgggggccgacgactacctggtgaagcccttcgccttctcggaactcctggcgcgggcacggaccattctccggcgagggccgtcccgccagccggaacgtctgcgggctgacgacctggagatggatctcgtggggcacaaggcccggcgggagggaaggcccatcgacctcaccgccaaggaattcatcctgttatcgctgcttttgcgccgtaaaggcgaggtactttcccgcaccctcatcgccgaacaggtgtggggaatcaatttcgacagcgacactaacatcgtcgacgtagcgatccgtcggctacggcgcaaggtcgacgaccccttcgagaggaagctcatccacaccgtccgcggagcaggctatgtacttgaagcgaagtga

SEQ ID NO: 106053 - protein, 223 aa, Geobacter sulfurreducens PCA
MRVLIIEDEKKAAAYLQKGFAENGFTADTAASGDDGLHLARTENYDLIILDIMLPGRDGWEVLEELRKEGSEVPVIYLSARDAVHDRVRGLELGADDYLVKPFAFSELLARARTILRRGPSRQPERLRADDLEMDLVGHKARREGRPIDLTAKEFILLSLLLRRKGEVLSRTLIAEQVWGINFDSDTNIVDVAIRRLRRKVDDPFERKLIHTVRGAGYVLEAK

SEQ ID NO: 106054 - DNA, 687 bp, Mycobacterium avium subsp. paratuberculosis K-10
  CDS (1)..(687): transl_table=11
gtgcgaatactggtcgtcgacgacgatcgcgcggtgcgcgagtcgttacgcaggtcgttgtccttcaacggctactccgtcgagttggcccatgacggggtcgaggctctcgacatgatcgcgagcgatcgccccgacgcgctcgtcctggatgtgatgatgccgcgactggatggcctcgaggtgtgccgtcagctgcgcagcaccggtgacgacctgcccatcctggtgctgacggcccgcgattcggtctccgagcgggtggccgggctggacgcgggcgccgacgactacctgcccaagccgttcgccctggaagaactgctggcccggatgcgggcgctgctgcgccgcaccaagcccgaggacgacgccgaatccgtggcgatgacgttctccgatctgacgctggacccggtgacccgggaggtcacccgcgggcagcgccggatcagcctgacgcgcaccgagttcgcactgctggaaatgctgatcgccaacccgcgccgggtgctcacccgcagccgcatcctcgaggaggtctggggcttcgacttccccacctcgggcaatgcgctggaggtgtacgtcggctacctgcgccgcaaaaccgaagccgacggcgagccgcggttgatccacactgtgcgcggggtgggttacgtgcttcgggagacgccgccgtga

SEQ ID NO: 106055 - protein, 228 aa, Mycobacterium avium subsp. paratuberculosis K-10
MRILVVDDDRAVRESLRRSLSFNGYSVELAHDGVEALDMIASDRPDALVLDVMMPRLDGLEVCRQLRSTGDDLPILVLTARDSVSERVAGLDAGADDYLPKPFALEELLARMRALLRRTKPEDDAESVAMTFSDLTLDPVTREVTRGQRRISLTRTEFALLEMLIANPRRVLTRSRILEEVWGFDFPTSGNALEVYVGYLRRKTEADGEPRLIHTVRGVGYVLRETPP

SEQ ID NO: 106056 - DNA, 675 bp, Bacillus anthracis str. Sterne
  CDS (1)..(675): transl_table=11
atgcgagttcttattgtcgaagatgaacaagacttacaaaatatattagtaaagcgattaaatgcagaacattatagtgtcgatgcatgcgggaatggagaagatgccttagattatataaacatggctacctacgatttgatcgtgcttgacattatgattcccggaataaatggtttacaagtattacaaaaattacgcgcggacaatcatacaacttctgtcttgcttcttacagctaaagatacaattgatgatcgcgtaaaaggactcgacttaggtgcggacgattatttagtaaagccgttcgcttttgacgaactgctagcaagaattcgagtgttaatgcgaagaaaaacaggaaatacatctaatgtgtttgaaattgctgacctagtggtggattgcaatatgcataaagtaacaagaggagaccaagttattactctttccagtaaagaatttgctattttagaatatatgattcgtaataaagaagttgtgttgacacgagataaaattgagcaacatgtgtggaattacgactatgaaggtggctcaaatattattgatgtttacgtccgctatcttcgaaaaaaagttgatagccagtttgaaacgaagttaattcatacagtaagaggaactggttacgtattgcgagtagaatcatga

SEQ ID NO: 106057 - protein, 224 aa, Bacillus anthracis str. Sterne
MRVLIVEDEQDLQNILVKRLNAEHYSVDACGNGEDALDYINMATYDLIVLDIMIPGINGLQVLQKLRADNHTTSVLLLTAKDTIDDRVKGLDLGADDYLVKPFAFDELLARIRVLMRRKTGNTSNVFEIADLVVDCNMHKVTRGDQVITLSSKEFAILEYMIRNKEVVLTRDKIEQHVWNYDYEGGSNIIDVYVRYLRKKVDSQFETKLIHTVRGTGYVLRVES

SEQ ID NO: 106058 - DNA, 669 bp, Bartonella quintana str. Toulouse
  CDS (1)..(669): transl_table=11
atgcgtattttaattgttgaagatgatcggaatctgaatcatcaattagcagaggctgtgagaagtgcgggatatgtctcggatagtgcttttgatggtcaagaggcttattttttaggaagcacagagtcttatgatgctgtgattcttgatatcggtttgccgcttctagatggaatttctgttgttgaaaaatggcgcaaagaagggcatctcatgcctgttttaatgctaacagcgcgagatcgctggtctgataaggtgtttggcattgatgcaggtgctgatgattatgttgttaaaccctttcatttggaggaattgatggcacggttgcgggcattaattcgtcgatctgcggggcatgcgacaagcgcgttatgctgtggtgcagttttgttagatacgaagacttctcgtgtttttgttgatggtcaattgattaaattgacatcatatgaattcagacttctttcgtatcttatgcatcattgcggtagggtggtttcaaagacggagcttactgaacatctttatgatcaggattttgacaaggattcgaatacggttgaagtttttgtagggcggttacgtagaaaacttggggtggatgtaattgagaccattcgtggaatgggctatcgcgtgagaataccaggtgaccaatga

SEQ ID NO: 106059 - protein, 222 aa, Bartonella quintana str. Toulouse
MRILIVEDDRNLNHQLAEAVRSAGYVSDSAFDGQEAYFLGSTESYDAVILDIGLPLLDGISVVEKWRKEGHLMPVLMLTARDRWSDKVFGIDAGADDYVVKPFHLEELMARLRALIRRSAGHATSALCCGAVLLDTKTSRVFVDGQLIKLTSYEFRLLSYLMHHCGRVVSKTELTEHLYDQDFDKDSNTVEVFVGRLRRKLGVDVIETIRGMGYRVRIPGDQ

SEQ ID NO: 106060 - DNA, 669 bp, Bartonella henselae str. Houston-1
  CDS (1)..(669): transl_table=11
atgcgtatcttaattgttgaagatgaccggaatctcaatcgtcaattagcagaagctgtaaaaaatgcgggatatgtttcagatagtgctttcaatggtgaagaggcttattttttaggtagtacagagtcttatgatgctgtgatacttgatattggtttgccgcgtctagatggaatttgtgttgttgaaaaatggcgcaaagaaggtcatctcatgcctgttttaatgctaacagcccgagatcgctggtctgataaggtgcttggcattgatgcaggtgctgatgattatgttgtgaagccttttcatttagaagaattgatggcacggttgcgggcgttaattcgccgctctacaggtcatgcaacaagcacgttatgctgcggtaaagttttgttagatacgaaaacttctcgtgttttttttgatggtcaattaattaaattgacgtcatatgaatttagactcctttcatatctcatgcatcatggcgatagaatagtttcaaggacggaacttaccgaacatctttatgatcaagattttgacaaagattcgaatacggttgaagtttttgtaggacgtttgcgtaaaaaacttgggatggatttaattgagaccattcgtggaatgggctatcgagtaagaatgccaggtgatcaatga

SEQ ID NO: 106061 - protein, 222 aa, Bartonella henselae str. Houston-1
MRILIVEDDRNLNRQLAEAVKNAGYVSDSAFNGEEAYFLGSTESYDAVILDIGLPRLDGICVVEKWRKEGHLMPVLMLTARDRWSDKVLGIDAGADDYVVKPFHLEELMARLRALIRRSTGHATSTLCCGKVLLDTKTSRVFFDGQLIKLTSYEFRLLSYLMHHGDRIVSRTELTEHLYDQDFDKDSNTVEVFVGRLRKKLGMDLIETIRGMGYRVRMPGDQ

SEQ ID NO: 106062 - DNA, 657 bp, Acinetobacter sp. ADP1
  CDS (1)..(657): transl_table=11
atgagaatcttgatcgcagaagatgacatttcacaagcagaaagtatcaagtcttggttggaacttgatggctatgttgtggattgggttgatcgtggggattatgcgattgcagcgatcaaacagcatgattatgactgtattttgcttgatcgcggccttccaaaatcgagtggagatcaagtattgctgacactcagaaaacatcagtccatgacgcctgtcattatgattacagcacgtgacagtatttcagatcgagttacgggattagatcttggggcaaatgattatctggtcaagccatttagtttggaagaattgtctgcgcgaattcgtagtcatattcggtcaatgcaacaacaagtagatagtcttttatgttggaaaaatattgaactgaatacacaggataaatgggtgaaactttcaggggagctggttgaactcactgcaaaagaatttaaggtgctgcataaaatgatgcaaaacccagaacgcgtagtgacccgtgagcaacttgaaagtacgctatatgcctggggcgatgaaatagaaagtaacgcgattgaggtttttatttaccagctcaggaaaaaaataggtacaaattatattaagacaattcgtggcctgggttatcggatgagcgagtga

SEQ ID NO: 106063 - protein, 218 aa, Acinetobacter sp. ADP1
MRILIAEDDISQAESIKSWLELDGYVVDWVDRGDYAIAAIKQHDYDCILLDRGLPKSSGDQVLLTLRKHQSMTPVIMITARDSISDRVTGLDLGANDYLVKPFSLEELSARIRSHIRSMQQQVDSLLCWKNIELNTQDKWVKLSGELVELTAKEFKVLHKMMQNPERVVTREQLESTLYAWGDEIESNAIEVFIYQLRKKIGTNYIKTIRGLGYRMSE

SEQ ID NO: 106064 - DNA, 663 bp, Erwinia carotovora subsp. atroseptica SCRI1043
  CDS (1)..(663)
atgagagtattgttaatcgaagacgatcgcctgatcggtgatggcctaaaagctgggcttaacaaactgggctttaatattgattggtttacggaaggtaaagcgggcgctaccgcgttgaaggccgccccttatgatgcagtggtgctcgatctcagcctgccgggcatggacggcatggatatcctgcgccagtggcgtcaggctggacatgacgaaccggtgctgattctgaccgcccgcgatgcgctggaacagcgcgtagaaggattgcagcaaggagcagatgattatttatgtaagccttttgcgctgacagaagttgccgctcgcctgcaggcgctgattcgtcgccgtcacggccaactccaacccgtattaacacatggcgctgtttcccttgagcctagctcacggagcgtcacgcttaacagtgagccgttgatactaaaatcccgcgagctggcgctgttggaactgttcttgctcaatccgaaccgcgtactcacgcgcgcgcagttggaagagaagctctacggctgggatgatgatgtctccagcaatgcggtagaagtccatatccaccacctgcgcaaaaagctgggcagcgggtttattcgtaccgtgcatggcgttggctatattctgggagatgcaccatga

SEQ ID NO: 106065 - protein, 220 aa, Erwinia carotovora subsp. atroseptica SCRI1043
MRVLLIEDDRLIGDGLKAGLNKLGFNIDWFTEGKAGATALKAAPYDAVVLDLSLPGMDGMDILRQWRQAGHDEPVLILTARDALEQRVEGLQQGADDYLCKPFALTEVAARLQALIRRRHGQLQPVLTHGAVSLEPSSRSVTLNSEPLILKSRELALLELFLLNPNRVLTRAQLEEKLYGWDDDVSSNAVEVHIHHLRKKLGSGFIRTVHGVGYILGDAP

SEQ ID NO: 106066 - DNA, 663 bp, Yersinia pseudotuberculosis IP 32953
  CDS (1)..(663): transl_table=11
atgaaattactgattgttgaagatgatgaactgctacaacgcggtatagccatggcgctgaccagtgaaggctatgtctgcgactgcgcagctaccgccgccgaagctcacagtttgctgcaaaccagtcagtacagcatgattattcttgatctcggcctgccggatcaggatggtacgctgttattacgtcaatggcgtcgccaacatgtcaccctgccagtactcatcctcaccgcacgtgatgcgcttgaagacagggttgacgggctggatgccggtgctgacgattatcttgtcaaaccttttgccttggctgaattactggcccgggtacgtgctctcatccgccgttatcaggggcagagtgacaacctggtacagcaagatgacctgagccttaacttgtcgacacaacaagtctgtttacaagggcagccattagagataacccctaaagagtttgcgatcctctcacgtctaatcatgcgagctgggcaaacagttaaccgcgagttgttacaacaggatctatatacctggaatgacgaccttagctctaatacgctggaagttcatattcataatttgcgacgcaaactgggtaaagatcgtatccgaaccgttcgaggtattggttatcgattagaagccttatcatga

SEQ ID NO: 106067 - protein, 220 aa, Yersinia pseudotuberculosis IP 32953
MKLLIVEDDELLQRGIAMALTSEGYVCDCAATAAEAHSLLQTSQYSMIILDLGLPDQDGTLLLRQWRRQHVTLPVLILTARDALEDRVDGLDAGADDYLVKPFALAELLARVRALIRRYQGQSDNLVQQDDLSLNLSTQQVCLQGQPLEITPKEFAILSRLIMRAGQTVNRELLQQDLYTWNDDLSSNTLEVHIHNLRRKLGKDRIRTVRGIGYRLEALS

SEQ ID NO: 106068 - DNA, 693 bp, Yersinia pseudotuberculosis IP 32953
  CDS (1)..(693): transl_table=11
atgcggctattgttggtagaagatgaggagaagacatcttcgtatatcaatcgcgccctcagcgagttgggctttaccgtcgatgtggcggccaccgggaacgacggattatatctggctcttgagtatgattacgatacgattgtgctcgatgtcatgttgcccggcatggatggttacagcgttctcgaaggcctacgcgccagcaaacaaactccggttctgatgttatccgcccgtggctcggttgatgaacgagttaagggcctgcgtcacggtgccgacgattatttgcctaagcctttttcgctgattgaactggttgcgcgtatccaggcgttgttgaggcggcgtcccagtgatggtgtagatgtcagccaattgcacattaatgatctacatctcgacctgctggcaaggcgtgtcacgcgagccggtgaacgtcttgaactcaccgccaaagagttcgccctgttaagcctgttagccagacatcagggagaaattctgtcaaaaatgatgattgcagagcaggtctgggacatgaattttgacagcgatgctaatgtcgttgaggtggcgataaaacgcctgcgggcgaaaatagatacgccctacccggtcaaactgctgcatacagtgcgaggcatggggtatgtccttgaaactcgccccgatcgccagactaaatag

SEQ ID NO: 106069 - protein, 230 aa, Yersinia pseudotuberculosis IP 32953
MRLLLVEDEEKTSSYINRALSELGFTVDVAATGNDGLYLALEYDYDTIVLDVMLPGMDGYSVLEGLRASKQTPVLMLSARGSVDERVKGLRHGADDYLPKPFSLIELVARIQALLRRRPSDGVDVSQLHINDLHLDLLARRVTRAGERLELTAKEFALLSLLARHQGEILSKMMIAEQVWDMNFDSDANVVEVAIKRLRAKIDTPYPVKLLHTVRGMGYVLETRPDRQTK

SEQ ID NO: 106070 - DNA, 681 bp, Mannheimia succiniciproducens MBEL55E
  CDS (1)..(681): transl_table=11
gtgagtagcatgatgatgagaatattgttaattgaagatgatgcattaatcggtaacggcatcaaagtgggattaaccaaatcaggcttttcagtggattggttcacagacggaaaaaccggtttacaggcgataaaatccgcaccttatgatgctgttgtattagatctaaccttgcccggtatggacggtatggatattctgcaacaatggcgtaatgaaaaaattgacacgccggtgttaatattaaccgcccgcgataccttgaatgatcgggttaccggtttgcaacgcggtgcggatgattatttatgcaaaccttttgccttagcggaagtcattgcccgcttacaggcgctgattcgtcgtcgctacggtcaggcgaatcctatcgttgaacacagcttagtcaaatttgatccgaacagtcgcaaagtcagcctgcaaggcaaagacattccgttaaccaccagagaatataatttgctcgaattatttatgatgaataaagagcgggtgttgtcccgttcgtttattgaggagaaattatataactgggacgatgaagtaagcagcaacgcccttgaagtgcatattcataatttacgtcaaaaattaggtaaacagtttattcgcacggtacatggtgtcggttatgccttaggtaaaaacgaagaatga

SEQ ID NO: 106071 - protein, 226 aa, Mannheimia succiniciproducens MBEL55E
MSSMMMRILLIEDDALIGNGIKVGLTKSGFSVDWFTDGKTGLQAIKSAPYDAVVLDLTLPGMDGMDILQQWRNEKIDTPVLILTARDTLNDRVTGLQRGADDYLCKPFALAEVIARLQALIRRRYGQANPIVEHSLVKFDPNSRKVSLQGKDIPLTTREYNLLELFMMNKERVLSRSFIEEKLYNWDDEVSSNALEVHIHNLRQKLGKQFIRTVHGVGYALGKNEE

SEQ ID NO: 106072 - DNA, 678 bp, Legionella pneumophila subsp. pneumophila str. Philadelphia 1
  CDS (1)..(678): transl_table=11
atgagattattacttgttgaagacgatgaactgcttggcgatgcagtaaaagccggactgacacaatttggttatgttgttgactggctaaaagatggcgaagctgctcgggcggctctcaaatcagagtcttttgaattaattattcttgacttgggattacctaaattatccggtttatcattattgcaaaacatcagacatgatggaaatagcacacctgtgattattcttacagctcgagaatcaatagaagatcgggtaaaaggcttagatagcggtgctgacgattatcatattaagccttttgatttaaacgaattaagtgcaaggattagagcattggtaaggcgctctcagggcagagctgattccgtgttgcaatataaaaatattactctcgatcctgctgctcattctgtcttcgtggatgatgtactcgtcaatgttccaagaagagaatttgctctattgcagaaattacttgaaaacagtggccaggttttatctcgagaacaattaatgcagagtatttatggctgggaagaagacgtggacagtaatgctctcgaagttcatatacataatttacgtaaaaaacttaacgcaaactttatccgcactatacgtggtgtaggatatatggctgaaaaaaatgacagtgtacttctatcgtga

SEQ ID NO: 106073 - protein, 225 aa, Legionella pneumophila subsp. pneumophila str. Philadelphia 1
MRLLLVEDDELLGDAVKAGLTQFGYVVDWLKDGEAARAALKSESFELIILDLGLPKLSGLSLLQNIRHDGNSTPVIILTARESIEDRVKGLDSGADDYHIKPFDLNELSARIRALVRRSQGRADSVLQYKNITLDPAAHSVFVDDVLVNVPRREFALLQKLLENSGQVLSREQLMQSIYGWEEDVDSNALEVHIHNLRKKLNANFIRTIRGVGYMAEKNDSVLLS

SEQ ID NO: 106074 - DNA, 744 bp, Burkholderia mallei ATCC 23344
  CDS (1)..(744): transl_table=11
atgcgaattctcatcgccgaagacgacagcatactagcggacggcctcacccggtcactccgccaatcgggctatgccgtcgatcacgtgaggaacggcgtcgaggccgacacggccctgtcgatgcagactttcgacctgctgatcctcgatctcggcctgcccagaatgtccggcctcgaggtgctgcgccgcctgcgcgcgcgcaactcgaacctgcccgtgctgatcctgacggccgccgacagcgtcgacgagcgcgtgaaagggctcgacctgggcgccgacgactacatggcgaagccgttcgcgctcaacgaactcgaggcgcgcgtgcgcgcgctgacgcggcgcggcgcgggaggcgggccgaccgtcgtgcggcatggcttgctgtcgttcgaccaggtcggccggatcgcctatgcgaacgaacgcgtgctcgagctgtccgcgcgcgagctcgggctgctcgaggtgctgctgcagcgcatcggccggctggtgtcgaaggagcagctcgtcgatcacctgtgcgaatggggcgaggaagtcagcaacaacgcgatcgaggtctacgtccaccggctgcgcaagaagatcgagccgagcggcgtgcggatcacgaccgtgcgcggcctcggctactgcctcgagaaagccgcgcccgcgggcgcgagcgacgcgccgaacgccgccgcgtcgccggcggccgaggccgtcgccggccagccggtgcgctag

SEQ ID NO: 106075 - protein, 247 aa, Burkholderia mallei ATCC 23344
MRILIAEDDSILADGLTRSLRQSGYAVDHVRNGVEADTALSMQTFDLLILDLGLPRMSGLEVLRRLRARNSNLPVLILTAADSVDERVKGLDLGADDYMAKPFALNELEARVRALTRRGAGGGPTVVRHGLLSFDQVGRIAYANERVLELSARELGLLEVLLQRIGRLVSKEQLVDHLCEWGEEVSNNAIEVYVHRLRKKIEPSGVRITTVRGLGYCLEKAAPAGASDAPNAAASPAAEAVAGQPVR

SEQ ID NO: 106076 - DNA, 663 bp, Burkholderia mallei ATCC 23344
  CDS (1)..(663): transl_table=11
atgcggatattgctggttgaagacgatcggatgatcgccgaaggcgtgcgcaaggcgctgaaggccgacggctgcgcggtcgactgggtgcaggacggcgacgcggcgctcaccgcgctcggcggcgaggcgtacgatctgctgctgctcgatctcgggctgcccaagcgcgacggcatcgacgtgctgcgcacgctgcgcgcgcgcgggctcgcgctgccggtgctgatcctcaccgcgcgcgatgcggtcgccgatcgcgtgaagggcctcgacgcgggcgccgacgactatctcgtcaagccgttcgatctcgacgagctcgccgcgcggatgcgcgcgctgatccgccgccagtcggggcgcagcgaatcgatgatccggcacggcgcgctgacgctcgatccggcgtcgcatcaggtgacgctcgacggggcgcccgtcgcgctgtcggcgcgcgagttcgcgctgctcgaagcgctgctcgcgcgtccgggcgcggtgctgtcgaagagccagctcgaggagaagatgtacggctggggcgaggagatcggcagcaacaccgtcgaggtctatatccacgcgctgcgcaagaagctcggctcggacctgatccgcaacgtccgcggcctcggctacatggtcgtgaaggaagcgtag

SEQ ID NO: 106077 - protein, 220 aa, Burkholderia mallei ATCC 23344
MRILLVEDDRMIAEGVRKALKADGCAVDWVQDGDAALTALGGEAYDLLLLDLGLPKRDGIDVLRTLRARGLALPVLILTARDAVADRVKGLDAGADDYLVKPFDLDELAARMRALIRRQSGRSESMIRHGALTLDPASHQVTLDGAPVALSAREFALLEALLARPGAVLSKSQLEEKMYGWGEEIGSNTVEVYIHALRKKLGSDLIRNVRGLGYMVVKEA

SEQ ID NO: 106078 - DNA, 693 bp, Burkholderia mallei ATCC 23344
  CDS (1)..(693): transl_table=11
atgcgactccttctgatcgaagacgaccgccccatcgcacgcggcattcaaagcagcctcgaacaagccggcttcacggtcgacatggttcatgacggcatctttgccgagcaggcgctcgcgcaaaaccgccacgagctcgtgatcctcgacctcggcctgcccggcatcgacggcatgacgctgctgtcgcgctttcgccagaccaaccgccacacgcccgtcatcgtgctgaccgcgcgcgacgaactgaacgatcgcgtacagggcctcaattcgggtgccgacgactacatgctcaagccgttcgagcccgccgagctcgaggcgcgaattcgcgcggtgatgcgccgcagcggcccgcacagcgacatgccgcgcccggaagtatcgctcggcggcgtgcgcctgtcgggcgtcgatcgtcgcatcttcaacgacgacaagccgctcgagctctcgccgcgcgaattcgcggtgctcgagatgctgctgctgcgtcacggccgcgtcgtcagcaaggcgcaactgcaggatcacctgacgcacttcggcggcgatctcggcgataccgcgatcgaagtctacgtgcaccgggtgcgcaagaagctcgagcagtgccgcgtcgagatcgtcacggtgcgcggcttcggctatctgctgcaggaaattcgccagaccgcgagcgtctga

SEQ ID NO: 106079 - protein, 230 aa, Burkholderia mallei ATCC 23344
MRLLLIEDDRPIARGIQSSLEQAGFTVDMVHDGIFAEQALAQNRHELVILDLGLPGIDGMTLLSRFRQTNRHTPVIVLTARDELNDRVQGLNSGADDYMLKPFEPAELEARIRAVMRRSGPHSDMPRPEVSLGGVRLSGVDRRIFNDDKPLELSPREFAVLEMLLLRHGRVVSKAQLQDHLTHFGGDLGDTAIEVYVHRVRKKLEQCRVEIVTVRGFGYLLQEIRQTASV

SEQ ID NO: 106080 - DNA, 660 bp, Burkholderia mallei ATCC 23344
  CDS (1)..(660): transl_table=11
atgagagtgcttctcgtcgaagacgatccgtggctcggcgaggccgtccgcgcccagatcgagaaggacgggcatccgaccgattgcgtcgcgagcctcgcgcacgcgcggcggcacgtcgcggtcgcgccctacgatctgatcctgctcgatctgctgctgcccgacgggcgtgggctcgatttcctgcgcgagctgcgcgcgggcggctcgacggtgcccgtcatcatcctgaccgcgctcgatcaggtcgcgaaccggatcgcggggctgaacgccggcgccgacgactatctgatcaagccgttcgacctgtccgagttgtccgcgcgcgtgagcgcggtcgcgcgccgctattcgggcaatccgaatccgctcgtgaagctcggcgagctcgcggtcgacatcgccgcgcgcagcgtgacgcgcgccggcgcgcgggtcgacctgaccgcgagcgaatgggcgctgctcgaaacgctgatccagcatccggggatgatcctgtcgaagccgcagctcgaggagcggctgtattcgttcagcgacgaagtcggcagcaatacgatcgaagtgcatgtgagccgcctgcgcaagaagctcggcgccgagctgatcgagaccgtgcgcggcctcggctatcgcctgaggcgggactag

SEQ ID NO: 106081 - protein, 219 aa, Burkholderia mallei ATCC 23344
MRVLLVEDDPWLGEAVRAQIEKDGHPTDCVASLAHARRHVAVAPYDLILLDLLLPDGRGLDFLRELRAGGSTVPVIILTALDQVANRIAGLNAGADDYLIKPFDLSELSARVSAVARRYSGNPNPLVKLGELAVDIAARSVTRAGARVDLTASEWALLETLIQHPGMILSKPQLEERLYSFSDEVGSNTIEVHVSRLRKKLGAELIETVRGLGYRLRRD

SEQ ID NO: 106082 - DNA, 663 bp, Burkholderia mallei ATCC 23344
  CDS (1)..(663): transl_table=11
atgcgcgtattgcttgtcgaagacgatccgctcatcggcagcgggctcgaacaggggctgaaacaggaaggcttcgcggtggactgggcgcagaacgccgacgcggcgacgctcgcgctgcgcacgacgtcgtacggcctgctgctgctcgacctcggcctgccggacaaggacggcctcgcggtgctcgccgcgctgcgccgccgcgacgacgcgctgcccgtgatcgtcgtcaccgcgcgcgacgcgctgcccgaccggatcgcgggcctcgattgcggcgcggacgattacctcgtcaagccgttcgcgctcgaggaactgctcgcgcgcatccgcgcggtgaaccgccgccaggccggccgcgcgcagacggtgctcgcggtcggcgcgctgcggctcgatccggcgcgccatcaggtgtggcgcggcgacgaggaagtcgcgctgtcgccgaaggaattcgtgctgctgcacgagctgatgcgcgagccgggcgcggtgatctcgcgcgagcagttcgaggagcggctgtacagctggggcgaggaaatcgagagcaacgcggtgcaggtgcatatccacaacctgcgcaagaagctcggccacgacacgatcctcacggtgcgcggcgtcggctaccggatcggagacggcgcatga

SEQ ID NO: 106083 - protein, 220 aa, Burkholderia mallei ATCC 23344
MRVLLVEDDPLIGSGLEQGLKQEGFAVDWAQNADAATLALRTTSYGLLLLDLGLPDKDGLAVLAALRRRDDALPVIVVTARDALPDRIAGLDCGADDYLVKPFALEELLARIRAVNRRQAGRAQTVLAVGALRLDPARHQVWRGDEEVALSPKEFVLLHELMREPGAVISREQFEERLYSWGEEIESNAVQVHIHNLRKKLGHDTILTVRGVGYRIGDGA

SEQ ID NO: 106084 - DNA, 672 bp, Burkholderia mallei ATCC 23344
  CDS (1)..(672): transl_table=11
atgcgcgtgctgctcgtcgaagacaacccgatcctcgcgcagtcgctcgccgacgcgctttcgtccgcgcgtttcgcggtcgaccacatggcggacggcgaggccgccgatcacgtgctgcacacgcaggactacgcgctcgtgattctcgacctcgggctgccgaagctcgacggcctcgacgtgctgcggcggctgcgcgcgcggcgcaacccggtgccggtgctgatcctcaccgcgcacggctcggtcgaggaccgcgtgcgcgggctcgatctcggcgcggacgactacctcgcgaagccgttcgagctgaccgagctcgaggcgcgcgctcgcgcgctgatccggcgcagcctcgggcacgagcacgggcgcgtcgagtgcgggccgctcgcgttcgacagcgtcgaccggagttttcgtctgaacaatgacgcgctcgcgctgacgccgcgcgagcgctcggtgctcgaggtgctgatcctgcgcaacggccgcgcgatcaacaaggagacgctgtcggagaagatcttcgggctcgacgaatcggtgaacgcggacgcgatcgagatctacgtgcaccggctgcgcaagaagctcgagggcagcggcgtcgcgatcgtcacgctgcgcgggctcggctacctgctcgaggcgcagccgtcgtga

SEQ ID NO: 106085 - protein, 223 aa, Burkholderia mallei ATCC 23344
MRVLLVEDNPILAQSLADALSSARFAVDHMADGEAADHVLHTQDYALVILDLGLPKLDGLDVLRRLRARRNPVPVLILTAHGSVEDRVRGLDLGADDYLAKPFELTELEARARALIRRSLGHEHGRVECGPLAFDSVDRSFRLNNDALALTPRERSVLEVLILRNGRAINKETLSEKIFGLDESVNADAIEIYVHRLRKKLEGSGVAIVTLRGLGYLLEAQPS

SEQ ID NO: 106086 - DNA, 744 bp, Burkholderia pseudomallei K96243
  CDS (1)..(744): transl_table=11
atgcgaattctcatcgccgaagacgacagcatactagcggacggcctcacccggtcactccgccaatcgggctatgccgtcgatcacgtgaggaacggcgtcgaggccgacacggccctgtcgatgcagactttcgacctgctgatcctcgatctcggcctgcccagaatgtccggcctcgaggtgctgcgccgcctgcgcgcgcgcaactcgaacctgcccgtgctgatcctgacggccgccgacagcgtcgacgagcgcgtgaaagggctcgacctgggcgccgacgactacatggcgaagccgttcgcgctcaacgagctcgaggcgcgcgtgcgcgcgctgacgcggcgcggcgcgggaggcgggccgaccgtcgtgcggcatggctcgctgtcgttcgaccaggtcggccggatcgcctatgcgaacgaacgcgtgctcgagctgtccgcgcgcgagctcgggctgctcgaggtgctgctgcagcgcatcggccggctggtgtcgaaggagcagctcgtcgatcacctgtgcgaatggggcgaggaagtcagcaacaacgcgatcgaggtctacgtccaccggctgcgcaagaagatcgagccgagcggcgtgcggatcacgaccgtgcgcggcctcggctactgcctcgagaaagccgcgcccgcgggcgcgagcgacgcgccgaacgccgccgcgtcgccggcggccgaggccgtcgccggccagccggtgcgctag

SEQ ID NO: 106087 - protein, 247 aa, Burkholderia pseudomallei K96243
MRILIAEDDSILADGLTRSLRQSGYAVDHVRNGVEADTALSMQTFDLLILDLGLPRMSGLEVLRRLRARNSNLPVLILTAADSVDERVKGLDLGADDYMAKPFALNELEARVRALTRRGAGGGPTVVRHGSLSFDQVGRIAYANERVLELSARELGLLEVLLQRIGRLVSKEQLVDHLCEWGEEVSNNAIEVYVHRLRKKIEPSGVRITTVRGLGYCLEKAAPAGASDAPNAAASPAAEAVAGQPVR

SEQ ID NO: 106088 - DNA, 672 bp, Burkholderia pseudomallei K96243
  CDS (1)..(672): transl_table=11
atgcgcgtgctgctcgtcgaagacaacccgatcctcgcgcagtcgctcgccgacgcgctttcgtccgcgcgtttcgccgtcgaccacatggcggacggcgaggccgccgatcacgtgctgcacacgcaggactacgcgctcgtgattctcgacctcgggctgccgaagctcgacggcctcgacgtgctgcggcggctgcgcgcgcggcgcaacccggtgccggtgctgatcctcaccgcgcacggctcggtcgaggaccgcgtgcgcgggctcgatctcggcgcggacgactacctcgcgaagccgttcgagctgaccgagctcgaggcgcgcgcccgcgcgctgatccggcgcagcctcgggcacgagcacgggcgcgtcgagtgcgggccgctcgcgttcgacagcgtcgaccggatttttcgtctgaacaatgacgcgctcgcgctgacgccgcgcgagcgctcggtgctcgaggtgctgatcctgcgcaacggccgcgcgatcaacaaggagacgctgtcggagaagatcttcgggctcgacgaatcggtgaacgcggacgcgatcgagatctacgtgcaccggctgcgcaagaagctcgagggcagcggcgtcgcgatcgtcacgctgcgcgggctcggctacctgctcgaggcgcagccgtcgtga

SEQ ID NO: 106089 - protein, 223 aa, Burkholderia pseudomallei K96243
MRVLLVEDNPILAQSLADALSSARFAVDHMADGEAADHVLHTQDYALVILDLGLPKLDGLDVLRRLRARRNPVPVLILTAHGSVEDRVRGLDLGADDYLAKPFELTELEARARALIRRSLGHEHGRVECGPLAFDSVDRIFRLNNDALALTPRERSVLEVLILRNGRAINKETLSEKIFGLDESVNADAIEIYVHRLRKKLEGSGVAIVTLRGLGYLLEAQPS

SEQ ID NO: 106090 - DNA, 693 bp, Burkholderia pseudomallei K96243
  CDS (1)..(693): transl_table=11
atgaaggtccttatcgtagaagacgagccgaagacgggcatgtatttgaagcgcgggctcaccgaagcgggcttcgtctgcgactggacacaggacggcatcagcggtctgcatcagttgcagacggagaactacgatctcgcgatcctcgacgtgatgctgcccggttgcgacggctggacagtcgtgcgcgagctgcgcagaacgcaccgcacgccggtgctgttcctcaccgcgcgcgatcacgtcgacgatcgcgtgaaaggcctcgagctcggcggcgacgactatctcgcgaagccgttcgatttcgccgaattgctcgcgcgtgtgcgctcgctgctgcggcgcggccaggcaaccgatgcgccggtgctgcgcgtcgccaatctcgagctcgatctcatccagcgcaaggcgcgccgccagggcaacacgatcctgctcaccgcgaaggaattcctgctgctgtggctgctgatgcgccggcaaggcgagatcctgccgcgctcgctgatcgcatcgcagatctgggacatcaacttcgacagcgattcgaacgtcgtcgacgcggcgatcaagcgcgtgcgcgcgaaggtcgatcaggactacgagcccaagctgatccacacggtgcgtggaatgggatacgttctcgagcagcggggcgagccgtgcgaatcgtgtgcatga

SEQ ID NO: 106091 - protein, 230 aa, Burkholderia pseudomallei K96243
MKVLIVEDEPKTGMYLKRGLTEAGFVCDWTQDGISGLHQLQTENYDLAILDVMLPGCDGWTVVRELRRTHRTPVLFLTARDHVDDRVKGLELGGDDYLAKPFDFAELLARVRSLLRRGQATDAPVLRVANLELDLIQRKARRQGNTILLTAKEFLLLWLLMRRQGEILPRSLIASQIWDINFDSDSNVVDAAIKRVRAKVDQDYEPKLIHTVRGMGYVLEQRGEPCESCA

SEQ ID NO: 106092 - DNA, 675 bp, Methylococcus capsulatus str. Bath
  CDS (1)..(675): transl_table=11
atgaggattctgctcgtcgaagacgacgaaaccctggccgacggcctgtcgcgcagcctggccgaggatggcttcgacctcaccgttgccgcgacgggaacctacgccgacagtgccctgcgcacccaggactacgatctggtcatcctcgacctcggcctgcccgacatcgacgggaaagaagtcctcaggcagttgcgggtcagaaaatcgccggtgccggtcctcatcctgacggcccgggacgggctggacgaccggatcggcggtctggagctgggcgccgacgattacatgaccaagcctttcgagctgagggaactggaggcgcgggtgcgggcgctgatccggcgcagccacggcggcttcggtcacgacatcgtctgcggcccgctcgttctcaatacgttcgaccgccaggttcacgtgaacggagaaccgatgcttctgccttcccgcgaatatggcgtgctggaggcgctgctgctgcaggcgggccgggtggtcagcaaggaccggatcgccctgcgtctggcgagcggcggggatgaactggcggacaacgcgatcgaggtctacgtgcaccgtctgcgccgccgcctcgacgatctcggcattcgcatcaggacggtgcgcggcctcggctacctgctggaacggcccgccggtgaataa

SEQ ID NO: 106093 - protein, 224 aa, Methylococcus capsulatus str. Bath
MRILLVEDDETLADGLSRSLAEDGFDLTVAATGTYADSALRTQDYDLVILDLGLPDIDGKEVLRQLRVRKSPVPVLILTARDGLDDRIGGLELGADDYMTKPFELRELEARVRALIRRSHGGFGHDIVCGPLVLNTFDRQVHVNGEPMLLPSREYGVLEALLLQAGRVVSKDRIALRLASGGDELADNAIEVYVHRLRRRLDDLGIRIRTVRGLGYLLERPAGE

SEQ ID NO: 106094 - DNA, 666 bp, Methylococcus capsulatus str. Bath
  CDS (1)..(666): transl_table=11
atgcgtttgctgcttgccgaagacgatcggatgatcggccaggccctttgcgagggattgaaccaagagggcttcgtcgtcgactgggtccaggacggacatcaggctgaactcgccctgaaggttgccgaggccgactatgccttgcttctgctcgacctggggctgccgcggctgtcgggtctggatctgcttaccgaccttcggcgcaggggggccggcatcccggtcctcattctcaccgcgcgcgattccctgtcagaccgggtactggggctcaacagcggtgccgacgattaccttgtgaaacccttcgagctcgatgagctcgtggcccgcatccatgccctggtccggcgggcggcgggacgcgccgaaccggtcgtcgaacacggtccgttgcggttacttccggtgaagcgggaatgctggttgcggggtgagccggtcgagctgtccgcccgtgaattcgatctgctctacgccctcctggaaaaaccgggcgcggtgctgtcccgcacccggctggaggagcgcgtttatggttggggacaggaagtggtaagcaatgccatcgatgtccacatccaccatctccgcaagaagctgggtccgggattcatcgtcaatgtccgcggcgtgggttatcgggtggctcaagcatga

SEQ ID NO: 106095 - protein, 221 aa, Methylococcus capsulatus str. Bath
MRLLLAEDDRMIGQALCEGLNQEGFVVDWVQDGHQAELALKVAEADYALLLLDLGLPRLSGLDLLTDLRRRGAGIPVLILTARDSLSDRVLGLNSGADDYLVKPFELDELVARIHALVRRAAGRAEPVVEHGPLRLLPVKRECWLRGEPVELSAREFDLLYALLEKPGAVLSRTRLEERVYGWGQEVVSNAIDVHIHHLRKKLGPGFIVNVRGVGYRVAQA

SEQ ID NO: 106096 - DNA, 687 bp, Methylococcus capsulatus str. Bath
  CDS (1)..(687): transl_table=11
atgagaatcctcctggtcgaagacgaccggaaagcagccggacttctgacacgcggactcggcgaggagggtttccgcgtcgacaccgcccactccgcggaagacaccgagcagaagaacctccacaccgggtacgggctgatcatcctcgactggaacctgcccggcaaagacgggctgactttctgtgaggaacttcggaagcgggagatacgcacgccggttttgatgctcaccgcccgcgatgcgctgacggacagggtgaggggactcgacaccggcgccgacgactatctcaccaagcccttcgccttcgaggaactgctcgcgcgcgttcgtgccctactgcggcgggcggaacaagcccgtccggcgatgctgtcggtcgccgacctcgtcctcgacccgcgcagtcgacgcgtcacgcggagcggacgcccgctctccctcacccccaaggaatacgccatcctggaactcctgttgcgacgggccggcgaagtcgtatcccgcacccagttggccgaggagatatggagaaccggtctcatcgctctggacaatctgatcgatgttcacatcagcaatctacgccgtaaggtggatccgcccggcgttccgcctctcattcgaacggtgagaggctgcggcttcagcctggcggcggctgacagcgaatcgccgtga

SEQ ID NO: 106097 - protein, 228 aa, Methylococcus capsulatus str. Bath
MRILLVEDDRKAAGLLTRGLGEEGFRVDTAHSAEDTEQKNLHTGYGLIILDWNLPGKDGLTFCEELRKREIRTPVLMLTARDALTDRVRGLDTGADDYLTKPFAFEELLARVRALLRRAEQARPAMLSVADLVLDPRSRRVTRSGRPLSLTPKEYAILELLLRRAGEVVSRTQLAEEIWRTGLIALDNLIDVHISNLRRKVDPPGVPPLIRTVRGCGFSLAAADSESP

SEQ ID NO: 106098 - DNA, 687 bp, Nocardia farcinica IFM 10152
  CDS (1)..(687): transl_table=11
atgcgcattctggtagtcgacgacgatcgcgccgtccgggaatcgctgcgccggtcgttgaccttcaacggctacaccgtggacctcgccgtggacggggtcgacgcactggagaaagccaccgcgcagcggccggacgcgctcgtgctggatgtcatgatgccgcggctggacgggctggaggtttgccggcgtttgcgcagtaccggtgacgatcttccgattctggttttgacggcgcgggattcggtttccgaaagggttgccgggctcgacgcgggggccgacgattatctgcccaagccattcgcgctggaagaattgctggcccggctgcgcgccctgttgcgccgtcgcgcgcccgatccgggtgacacctccgagacgttgcgcttcgccgacctatcgctggacccggtcacccgcgaggtctcccgcggcgaccgcgcgatcagcctgacccgcaccgagttctccctgctcgagatgctgatggccaatccgcggcgggtgctgacccgtagccgcattctcgaggaggtgtggggctacgacttccccacctcgggtaacgcgctcgaggtctacatcggctacctgcgacgcaagaccgaggccgagggcgagccgcggctgatccacaccgtgcgcggcgtcgggtacgtgctgcgcgagaccccgccgtag

SEQ ID NO: 106099 - protein, 228 aa, Nocardia farcinica IFM 10152
MRILVVDDDRAVRESLRRSLTFNGYTVDLAVDGVDALEKATAQRPDALVLDVMMPRLDGLEVCRRLRSTGDDLPILVLTARDSVSERVAGLDAGADDYLPKPFALEELLARLRALLRRRAPDPGDTSETLRFADLSLDPVTREVSRGDRAISLTRTEFSLLEMLMANPRRVLTRSRILEEVWGYDFPTSGNALEVYIGYLRRKTEAEGEPRLIHTVRGVGYVLRETPP

SEQ ID NO: 106100 - DNA, 678 bp, Legionella pneumophila str. Lens
  CDS (1)..(678): transl_table=11
atgagattattacttgttgaagacgatgaactgcttggcgatgcagtaaaagccggactgacacaatttggttatgttgttgactggctaaaagatggcgaagctgctcgggcggctctcaaatcagagtcttttgaattaattattcttgacttgggattacctaaattatccggtttatcattattgcaaaacatcagacatgatggaaatagcacacctgtgattattcttacagctcgagaatcaatagaagatcgggtgaaaggcttagatagcggtgctgacgattatcttattaaaccttttgatttaaacgaattaagtgcaaggattagagcattggtaagacgctctcagggcagagctgattccgtgttgcaatataaaaatattaccctcgatcctgcggctcattctgtattcgtggatgatgtactcgtcaatgttccaagaagagaatttgctctattgcagaaattacttgaaaacagtggccaggttttatctcgagaacaattaatgcagagtatttatggctgggaagaagacgtggacagtaatgctctcgaagttcatatccataatttacgtaaaaaacttaacgcaaactttatccgcactatacgtggtgtaggatatatggctgaaaaaaatgacagtgtacttctatcgtga

SEQ ID NO: 106101 - protein, 225 aa, Legionella pneumophila str. Lens
MRLLLVEDDELLGDAVKAGLTQFGYVVDWLKDGEAARAALKSESFELIILDLGLPKLSGLSLLQNIRHDGNSTPVIILTARESIEDRVKGLDSGADDYLIKPFDLNELSARIRALVRRSQGRADSVLQYKNITLDPAAHSVFVDDVLVNVPRREFALLQKLLENSGQVLSREQLMQSIYGWEEDVDSNALEVHIHNLRKKLNANFIRTIRGVGYMAEKNDSVLLS

SEQ ID NO: 106102 - DNA, 687 bp, Ralstonia metallidurans CH34
  CDS (1)..(687): transl_table=11
atgaaactgctggtagtggaagatgaagtcaagacgggggagtatctccggcagggcctgaccgaggcggggttcgtggtcgacctggtcgccaatggactcgatggtcaacactttgcggtcaatgaaacctacgatctcatcatcctcgatgtcatgctgcccgacgtcgacggatggcatattctgcatgccatccgcgcgtcagggaacgcggtcccggtcttgtttctgacggcgcgagacagtgttgccgatcgcgtgcgaggcctcgagctcggcgcggatgactatctggtcaagccatttgccttttcggagctgcttgccagggtcaggacgctgctgcgtcgaggcgcggtgcaactagcgatggaccggattcaagtggccgatctgattctggatctgagccggcggcgagcgtctcgcggtgggcgacgcatcacgctgaccagtaaggaattcgccttgctcgagttgtttgcgcgtcgaaggggggaggtgcttccccgatccctcattgcctcccaggtgtgggacatgaacttcgatagcgatagtaacgtgatcgacgtggcgatccggcgcctgcgggcaaaaatcgatgacggctttgaagtaaagctgatccagactgtgcgcggcatgggatacgtcctcgaggcacctgaggatcctctatga

SEQ ID NO: 106103 - protein, 228 aa, Ralstonia metallidurans CH34
MKLLVVEDEVKTGEYLRQGLTEAGFVVDLVANGLDGQHFAVNETYDLIILDVMLPDVDGWHILHAIRASGNAVPVLFLTARDSVADRVRGLELGADDYLVKPFAFSELLARVRTLLRRGAVQLAMDRIQVADLILDLSRRRASRGGRRITLTSKEFALLELFARRRGEVLPRSLIASQVWDMNFDSDSNVIDVAIRRLRAKIDDGFEVKLIQTVRGMGYVLEAPEDPL

SEQ ID NO: 106104 - DNA, 663 bp, Idiomarina loihiensis L2TR
  CDS (1)..(663): transl_table=11
atggagttgttactggttgaagatgatgcgatgttaggacaggctgtggaactcggcttgtccgagcgtcagttcctggttcagcgggtacgcacgggagcggcggctattagcgagttaaaccgaactcactacgatgctgttgttctggatttggggttgccggatttagacggaacccgcgttttggccagcctcagaaaaaagggtatgacgttgcctgtattggttctgacagcgcgagatcaatccagtgaaattgtaaagcagctggataacggcgctgacgactatatgatcaaaccgttcgatatgaacgaactggctgcccgtctgcgcgcgctggttcgtcgccagcgcggctatgcttccccggagttaaaagtgggtgatattgttttggacgacgctaaccatagcgttgttgttgaagggctggctgttaacctctcccgacgcgaatttgagctactgaaagcattaatgtccgcaccggaacgtgtgcacagccgtgacaagctcgagcaggttgtgtttcagaatgaagctcaggtagagagtaacgcgctggaggttcatgtgcataatttacgtaaaaagctgggccataaagagtggattcagactattcgcggtattggttaccgactgcaatgcaattag

SEQ ID NO: 106105 - protein, 220 aa, Idiomarina loihiensis L2TR
MELLLVEDDAMLGQAVELGLSERQFLVQRVRTGAAAISELNRTHYDAVVLDLGLPDLDGTRVLASLRKKGMTLPVLVLTARDQSSEIVKQLDNGADDYMIKPFDMNELAARLRALVRRQRGYASPELKVGDIVLDDANHSVVVEGLAVNLSRREFELLKALMSAPERVHSRDKLEQVVFQNEAQVESNALEVHVHNLRKKLGHKEWIQTIRGIGYRLQCN

SEQ ID NO: 106106 - DNA, 687 bp, Azoarcus sp. EbN1
  CDS (1)..(687): transl_table=11
atgcggatccttcttgctgaagatgaccaagtcattgccaacggcctcggacgggccctcaagcgcagcggttacgccgtcgatcacgtcgcttccggcagcgaggcggataccgcgctggccacccagacatacgatctgctgattctcgacctcggcctgccgaagctccccgggattgacgtcctgaaacgcctgcgcgcgcgcaaatcggcgctgccggtgctgatcctcactgcccaggacggggtcgaggagcgtgtgcgagggctcgatgccggggcggacgactacctgacgaaacctttcgcgctgccggaactggaggcgcgtgtccgggcgctgacgcgacgcggcaccgggcagccgcgctgcatcgaaatcggcagcctttcgtacgaccaggctgatcgagtggcgaagatcaacgggcaggtcgtcgaattgtcggcgcgggaagtcggcctgctcgaagtcttcgccctgcgggtcgggcgactcgtgagcaaggaccagatcgtggatcacctgtgcggctggggggaagaggtctcgagcaatgcgatcgaggtctacgtccaccggctgcgcaagaagctcgaagacagcggtgtacgcatcgtcaccgtgcgcggactcggctactgcctggaaaacccggatgcggtccagacggcgaaagcctga

SEQ ID NO: 106107 - protein, 228 aa, Azoarcus sp. EbN1
MRILLAEDDQVIANGLGRALKRSGYAVDHVASGSEADTALATQTYDLLILDLGLPKLPGIDVLKRLRARKSALPVLILTAQDGVEERVRGLDAGADDYLTKPFALPELEARVRALTRRGTGQPRCIEIGSLSYDQADRVAKINGQVVELSAREVGLLEVFALRVGRLVSKDQIVDHLCGWGEEVSSNAIEVYVHRLRKKLEDSGVRIVTVRGLGYCLENPDAVQTAKA

SEQ ID NO: 106108 - DNA, 681 bp, Azoarcus sp. EbN1
  CDS (1)..(681): transl_table=11
atgaaaatcctgatcgtcgaggacgagccgaaaaccggtgattacctgcgccaggggctggccgaggcgggcttcgtcgttgatctcgcgcgcgacgggctcgacggcctgcatctcgcgctcgacggcgactacgatctgatggtgctcgacgtgatgctgccgtcgctcgatggctggggcgtgttgcagacggtgcggcgcagcggacgcgacatgccggtgctgttcctgaccgcgcgcgatcaggtcgaggaccgcgtgcgggggctcgagcttggcgccgacgactacctcgtcaagccgttcgcgttttccgagctgctcgcgcgcgtgcgcacgctgctgcgccgcggtaaggcgaaggagccggaggtttatagcgcgggagacctcgaactcgacctgctgcgtagacgggtgacgcgcgccggcgtgaagatcgacctgacgtcgaaggagttcgcgttgctcgagctgttgttgcggcgccagggcgaagtgctgctgcgctcgctgatcgcgtcgcaggtatgggacatgaacttcgacagcgacaccaacgtcatcgaagtcgcggtgcggcggctgcgcgcgaaagtcgacgacccgttcgagccgaagctgatccgcacggtgcgcggcatgggctacgtgctcgaagcgccgcagccgcggtga

SEQ ID NO: 106109 - protein, 226 aa, Azoarcus sp. EbN1
MKILIVEDEPKTGDYLRQGLAEAGFVVDLARDGLDGLHLALDGDYDLMVLDVMLPSLDGWGVLQTVRRSGRDMPVLFLTARDQVEDRVRGLELGADDYLVKPFAFSELLARVRTLLRRGKAKEPEVYSAGDLELDLLRRRVTRAGVKIDLTSKEFALLELLLRRQGEVLLRSLIASQVWDMNFDSDTNVIEVAVRRLRAKVDDPFEPKLIRTVRGMGYVLEAPQPR

SEQ ID NO: 106110 - DNA, 660 bp, Azoarcus sp. EbN1
  CDS (1)..(660): transl_table=11
atgcgggttctgctggtggaagacgatgcgagcctcggcgaagggattctcacgtcgctcaagcccgaaggctacacggtcgactgggtgcgggacggcagcagcgcgctgcacgccctgacccacgagagtttcgggctggcagtgctggatctcggcctgccccggctcgacgggctcgaagtgctgcgccagttgcgggccgccgagaatccgacaccagtgctggtgctgaccgcgcgcgacaccatcgccgatcgcatcgccgggctcgatgccggcgcagacgactatctcgtcaagcctttcgacgtcgccgagctcaaggccaggctgcgggcgctgctgcgacgcagcttcaatcgtccgcagccggcgctcgaatatcgcggcatcacgctcgaccccgccagccagttggtgacgtggaacggccagaccgtaagcctgcagcgcaaggaattcatcctgctccacgaactgatcgcgcaacccggccgcgtgctgacgcgcgacaagctgcagcaggtgctctacggctggggcgaggaagccgagagcaacgcgctcgaggtgcacatccatcacctgcggaagaaattcttccccgaactgatccgtaccgtgcgcggcgtcggctatctcgtcgacaagggctga

SEQ ID NO: 106111 - protein, 219 aa, Azoarcus sp. EbN1
MRVLLVEDDASLGEGILTSLKPEGYTVDWVRDGSSALHALTHESFGLAVLDLGLPRLDGLEVLRQLRAAENPTPVLVLTARDTIADRIAGLDAGADDYLVKPFDVAELKARLRALLRRSFNRPQPALEYRGITLDPASQLVTWNGQTVSLQRKEFILLHELIAQPGRVLTRDKLQQVLYGWGEEAESNALEVHIHHLRKKFFPELIRTVRGVGYLVDKG

SEQ ID NO: 106112 - DNA, 663 bp, Azoarcus sp. EbN1
  CDS (1)..(663): transl_table=11
atgcatatcctggtcgtcgaagacgaaccgacactcgccgcgcagcttgtcgaagcgctcgccgctgccggctacgcggtcgaccgtgccgacaacgggcgggatgcccacttcatcggcgacgtcgagccgctcgacgcggtggtgctcgatctcggcctgccgctgatggacgggatcacggtgctgaagaaatggcgcgccgcaggacgcacgatgcccgtgttgatccttaccgcacgcgacaactggcatgaaaaagtcgccgggatcgatgccggtgccgacgactacctcaccaagccgttccacatggaagagcttctcgcgcgcctgcgggcgctgatccggcgcgccggcggccacgccagcgccgagctcgcgtgcggtccggtgttgctcgacacgcgtgccggacgtgtcagcgtgaatggcgacgcggtgaacctgaccagccacgaactgcgcgtgctggattacctgatgcaccaccagggcgagatcgtgtcgcgcagcgatctcaccgagcacatctacgcccaggatttcgaccgcgattcgaataccatcgaagtcttcatcggtcgtctgcgcaagaagcttcccgccgggatgatcgaaacagtcaggggcctcggctaccgcatggtttgtcccgcgtga

SEQ ID NO: 106113 - protein, 220 aa, Azoarcus sp. EbN1
MHILVVEDEPTLAAQLVEALAAAGYAVDRADNGRDAHFIGDVEPLDAVVLDLGLPLMDGITVLKKWRAAGRTMPVLILTARDNWHEKVAGIDAGADDYLTKPFHMEELLARLRALIRRAGGHASAELACGPVLLDTRAGRVSVNGDAVNLTSHELRVLDYLMHHQGEIVSRSDLTEHIYAQDFDRDSNTIEVFIGRLRKKLPAGMIETVRGLGYRMVCPA

SEQ ID NO: 106114 - DNA, 687 bp, Francisella tularensis subsp. tularensis SCHU S4
  CDS (1)..(687): transl_table=11
atgagaatattgttggctgaagatgatcttcatttgggtgaaggcttattagaagctttgcaaaaagagggtttgattgtaaatctagtttcagatggtgaggcagcgcaaacttttatagaatctggattgtatgatatagtcgtcttagatattggtatgccaataaaaactggtttagaagttctaagaaatattagaaatagaggtattaaagtaccaataatactgttgactgctagagatggtttagaagatagaattaaaggtcttgatcttggtgctgatgattatctaactaagccatttgagttaaaagagctagtagctagaattaaagctatttctcgtcgtattgatactagatctggtaaaagtgttaatgaagaaattagatttggagattatagttttaatccaagctctgaaacggtaaccaaagatggagttattattcctgtttcaaaaaaagagttagcgcttttagctatattggtacaaaatgctggtagggtagtaccaaagacacagcttttagaagaagtatattctactgataaggaaatggatacaaacaccctagaagtacatatgcataatttaagaaagaaaattaacattcctaattttatacagactattagaggtgttggttactttgtacaaaaggataaagtaattaagtaa

SEQ ID NO: 106115 - protein, 228 aa, Francisella tularensis subsp. tularensis SCHU S4
MRILLAEDDLHLGEGLLEALQKEGLIVNLVSDGEAAQTFIESGLYDIVVLDIGMPIKTGLEVLRNIRNRGIKVPIILLTARDGLEDRIKGLDLGADDYLTKPFELKELVARIKAISRRIDTRSGKSVNEEIRFGDYSFNPSSETVTKDGVIIPVSKKELALLAILVQNAGRVVPKTQLLEEVYSTDKEMDTNTLEVHMHNLRKKINIPNFIQTIRGVGYFVQKDKVIK

SEQ ID NO: 106116 - DNA, 678 bp, Dehalococcoides ethenogenes 195
  CDS (1)..(678): transl_table=11
atgctgatgaaactgctgttaatcgaagatgatgccaatctggcaaaagtcattacttccggtcttgaagaaaatggatatgcagtcaattgggagtccaatggcaaacttggagctgaaatggctttggcctatacctttgatgtcatcatcctggatataatgctgcctgaacttgatggtttcgctgtatgccataaaatccgctccaatggcaatcaaacccccatcataatgctgaccgccaggtatcaggaagctgacaaagtaaatgggcttaactgcggagcggatgattacctggtgaaacctttcagcttccccgaactgcttgcccgcctgagagccttgctaagacgggccaataaccagcattctccctctatcaagctcaggaaacttactttaaacacagtggacagaagagctttttacgatggcagggaaatagagcttacggctaaagaatacggcattcttgaatatttggtactgaacaagaactgcataattaccaagaatatgattgaagagcatatctgggaatctgaaagtgacattttttccaatgtcatagaagtgttaatcagccgtatccgcaagaaactggacaacaataataaaaattctcttataaaaacggtaaaagggttagggtatattattgaggataaatag

SEQ ID NO: 106117 - protein, 225 aa, Dehalococcoides ethenogenes 195
MLMKLLLIEDDANLAKVITSGLEENGYAVNWESNGKLGAEMALAYTFDVIILDIMLPELDGFAVCHKIRSNGNQTPIIMLTARYQEADKVNGLNCGADDYLVKPFSFPELLARLRALLRRANNQHSPSIKLRKLTLNTVDRRAFYDGREIELTAKEYGILEYLVLNKNCIITKNMIEEHIWESESDIFSNVIEVLISRIRKKLDNNNKNSLIKTVKGLGYIIEDK

SEQ ID NO: 106118 - DNA, 681 bp, Escherichia coli
  CDS (1)..(681): transl_table=11
atgaaaatattgatcgtcgaagacgaaattaaaacaggtgaatatctcagcaaagggcttagagaggcagggttcgtagtggatcacgctgataatggtcttaccggatatcatctcgccatgacagccgagtatgatttagtcattctggatatcatgctacctgatgtgaacggctgggatatcatccgcatgctgcgcactgccggaaagggtatgccggtcttactgctgacagccctcggcacgatcgaacatagggtcaaaggactggaactgggtgcggacgattatctggttaaaccctttgcgtttgccgaactgctcgcccgggtgagaacccttctgaggcggggaaacacgatgatcacggaaagccagtttaaggtggctgacctctcgattgatctcgtatccagaaaagtcagtcgcgccggaaaccgcattgtgctcaccagtaaagagttcagcctgctggaattcttcattcgccatcagggagaggttcttccccgctccctgattgcctctcaggtctgggacatgaattttgacagcgacactaatgcgatcgatgtcgcagtaaagcgactccgcgctaaaatagacaacgattacgggacaaagctgatccagacagtccggggcgtgggctacatgctggaggtcccggatgcatag

SEQ ID NO: 106119 - protein, 226 aa, Escherichia coli
MKILIVEDEIKTGEYLSKGLREAGFVVDHADNGLTGYHLAMTAEYDLVILDIMLPDVNGWDIIRMLRTAGKGMPVLLLTALGTIEHRVKGLELGADDYLVKPFAFAELLARVRTLLRRGNTMITESQFKVADLSIDLVSRKVSRAGNRIVLTSKEFSLLEFFIRHQGEVLPRSLIASQVWDMNFDSDTNAIDVAVKRLRAKIDNDYGTKLIQTVRGVGYMLEVPDA

SEQ ID NO: 106120 - DNA, 894 bp, Xanthomonas oryzae pv. oryzae KACC10331
  CDS (1)..(894): transl_table=11
ttggcagcagcctattcccgggaagctgtcatggacctgtcgttgcggggcgggggattggggagtcgggattgggagttggtaaaatcaaactgcaacggccgcaagcttttatgcgcgcgccctgttaccttccggccgcgaccaagcgctgtgacgcatccccaatccctattcacgaaccccagtcccatgcgccttttgctggtcgaagacaacgccgatctcgccgatgccatcgtgcggcgcatgcgccgtagcgggcatgcggtggattggcaagccgatgggttggcggcggcaagtgtgttgcggtatcagagtttcgatttggtggtgctggatataggcctgcccaagctcgatgggttgcgggtgttggctggcatgcgtgagcggggcgacaccacgccggtgttgatgttgaccgcacgcgatggcatagaagaccgcgtgcaggcgctggatgtcggtgcggacgactacctgggcaagccgttcgactttcgcgagttcgaagcgcggtgccgcgtgttgttgcggcgtaatcgcggccaggccagcgaggtggtgcagatcggcggcttcgtcttcgacaatgccgcgcataccttgacgctggatggcgtgccgatcgagctccccaatcgcgaatatcgcctgttcgacatcctgatcggccggctcggacgagtcgtcggcaaggatgaaatcggcaacggcctgttcggcttcgacgacgatgccggccccaatgcgatcgagctgtatgtcggccgtctgcggcgcaagctggccgcagcgccgctgcgtatcgtcaccgtgcgcggtgcgggctacaaactggaagaagccgacccgcatgcgccggtggagccgggcgccgatggctga

SEQ ID NO: 106121 - protein, 297 aa, Xanthomonas oryzae pv. oryzae KACC10331
MAAAYSREAVMDLSLRGGGLGSRDWELVKSNCNGRKLLCARPVTFRPRPSAVTHPQSLFTNPSPMRLLLVEDNADLADAIVRRMRRSGHAVDWQADGLAAASVLRYQSFDLVVLDIGLPKLDGLRVLAGMRERGDTTPVLMLTARDGIEDRVQALDVGADDYLGKPFDFREFEARCRVLLRRNRGQASEVVQIGGFVFDNAAHTLTLDGVPIELPNREYRLFDILIGRLGRVVGKDEIGNGLFGFDDDAGPNAIELYVGRLRRKLAAAPLRIVTVRGAGYKLEEADPHAPVEPGADG

SEQ ID NO: 106122 - DNA, 750 bp, Xanthomonas oryzae pv. oryzae KACC10331
  CDS (1)..(750): transl_table=11
atgtgcgggcgcagcttgccaagcagtgagcagacttccagactgcactgcatgcgcattctgctggttgaagacgatctttcactgggcgaaggcatccgcaccgcgctgcggcgcgccgcctatgcggtggactgggtgcatgacggcgtcagtgcgttgatggcgctacaggagcagaccatggatctggtcatcctggatttggggttgccgcgcatggatggcatcggggtcattcgcaccgcacgcgcacgtgcggtggacacgccgattctggtactcagcgcacgcgaacgtgcagccgaccgcgcgcttggcctggatgtcggtgcagacgattatctgggcaagccgttcgacaccaatgaactgttggcccgcacgagggccttgctgcggcgctcggccgggcgcacgcagcctgcattgcaggccggcgcattgcggctggatccggctggcatgtcggtgcgctggcatggccgcgatctggatctgacccgtcgcgaattcgccctgttgtggctgctgatggagcagcgtggacgaccgatcggtcgcgaacgcatccagcagcatctctatggatgggacgaagacgtcgccagcaatgcggtggacgtgcatgtgcaccagctgcgtcgcaagctgtcggcagccgtgatccgcaccattcgcggtattggctatgcactggacgaacaggccgcacaggccgccgcggccccgccgcaggcaccgcaatga

SEQ ID NO: 106123 - protein, 249 aa, Xanthomonas oryzae pv. oryzae KACC10331
MCGRSLPSSEQTSRLHCMRILLVEDDLSLGEGIRTALRRAAYAVDWVHDGVSALMALQEQTMDLVILDLGLPRMDGIGVIRTARARAVDTPILVLSARERAADRALGLDVGADDYLGKPFDTNELLARTRALLRRSAGRTQPALQAGALRLDPAGMSVRWHGRDLDLTRREFALLWLLMEQRGRPIGRERIQQHLYGWDEDVASNAVDVHVHQLRRKLSAAVIRTIRGIGYALDEQAAQAAAAPPQAPQ

SEQ ID NO: 106124 - DNA, 813 bp, Salmonella enterica subsp. enterica serovar Choleraesuis str
  CDS (1)..(813): transl_table=11
atgattacttttccctttcatgtcgtttcagatccatttaataaggtaatccttaacaacttcttaaggcaaaaaaagaatctttttttctgtacatcgcctgcggcgacaaggttaactgacggtaacgcgagttaccgcaaggaagaacagatgcgaattttactggtagaagatgacacacttattggcgatggcataaaagcgggcctgagtaaaatgggtttcagcatcgactggtttaccgagggacgcccgggcaaagaggcgctttacagcgcgccttatgatgcggttattttagatttgacgctgccaggcatggacggacgggatattttgcgcgaatggcgcgaaaagggtaaacaggaaccggtgctgatcctgacggcgcgcgacgcgttagcagagcgtgtcgaggggctacgtctgggcgccgatgactatttatgtaaacctttcgcgctcattgaggtcgccgcccgtctggaggcgctggtacgccgcgccagcggtcaggccagtagcgaattgcaccacggccaggtgacgctcaatccaggcaatctcgtcgcgacgcttgccggcgaaccactggccctaaaaccaaaagagttcgcgttgctggaactcttactgcgcaacaaaggtcgcgtgctgccgcgcaagcttattgaagagaagctgtataactgggatgacgacgtgtccagcaatgcagtggaagtccatgttcatcatttacgccgcaagctcggcagcgaatttattcgcaccgtacacggcatcggctacaccctgggtgacgcatga

SEQ ID NO: 106125 - protein, 270 aa, Salmonella enterica subsp. enterica serovar Choleraesuis str
MITFPFHVVSDPFNKVILNNFLRQKKNLFFCTSPAATRLTDGNASYRKEEQMRILLVEDDTLIGDGIKAGLSKMGFSIDWFTEGRPGKEALYSAPYDAVILDLTLPGMDGRDILREWREKGKQEPVLILTARDALAERVEGLRLGADDYLCKPFALIEVAARLEALVRRASGQASSELHHGQVTLNPGNLVATLAGEPLALKPKEFALLELLLRNKGRVLPRKLIEEKLYNWDDDVSSNAVEVHVHHLRRKLGSEFIRTVHGIGYTLGDA

SEQ ID NO: 106126 - DNA, 690 bp, Brucella abortus biovar 1 str. 9-941
  CDS (1)..(690): transl_table=11
ttgcgtatcctgattgttgaagacgacaaggacctgaaccgccagctttccgaagcgatgattgccgcaggttatgtcgttgacagcgcctatgacggcgaagaaggccactatctgggcgatacagaaccttatgatgcggtggtgctggatatcggcctgccgcagatggacggtatcagcgttgtggagcgctggcggcgcagcgggcgcaccatacctgttctcatgctgaccgcgcgcgatcgctggagcgacaaggtggctggcatcgatgcgggtgcggatgactatgtggcaaagcctttccatattgaagaggttctggcccggctgcgcgccctgatccgccgtgctgccggtcatgcatcgtcagaattcgtctgcgggccgctgcatctcgatacgaagacgtcgaaggcgagtatcgatggcgtggcgctcaagctgacctcgcatgaatatcgcctcctgtcctatatgatgcaccatatggacgaagtggtttcgcgcaccgagcttgtggaacatctttacgatcaggatttcgaccgcgattccaatacgattgaagttttcgtcgggcgcctgcgcaagaaaatgggcgttgatctcatcgagaccgttcgcggcatgggctatcgtatgcgctcgggcggcgagggcgaagcaaaagggagcggcagctga

SEQ ID NO: 106127 - protein, 229 aa, Brucella abortus biovar 1 str. 9-941
MRILIVEDDKDLNRQLSEAMIAAGYVVDSAYDGEEGHYLGDTEPYDAVVLDIGLPQMDGISVVERWRRSGRTIPVLMLTARDRWSDKVAGIDAGADDYVAKPFHIEEVLARLRALIRRAAGHASSEFVCGPLHLDTKTSKASIDGVALKLTSHEYRLLSYMMHHMDEVVSRTELVEHLYDQDFDRDSNTIEVFVGRLRKKMGVDLIETVRGMGYRMRSGGEGEAKGSGS

SEQ ID NO: 106128 - DNA, 678 bp, Brucella abortus biovar 1 str. 9-941
  CDS (1)..(678): transl_table=11
atgagaattatcctcatcgaagacgaccccattctaggcgctgccgtgcgcgaccacatcgcggctgaaggccattgcgttgattgggtcagccgtctcgacaccgcccatgactacatggagagcgcgcgctacgatctcgttcttctggatttgatgctgccggacgggcaaggcctgtccttcttgcgtgatctgcgcacaaagggctgttccacgcctgtcatcatattgacggccctggaccagatttccgaccgcattcagggactgaacgcaggcgccgacgattatctgacgaagcccttcgatctttccgagctttccgcacggctgaacgcggtagcgcggcgctatagcggcaatcccaatcccctgatcgaaatcggcggcttgcagatcgaccttgcagccaagtccgtcatgcgcgacgggcgcgcactttgccttaccgcgcgcgaatgggcattgctggaggcttttctccagcatccgggccagaccctgtccaaggcccagcttgaagaacacctctattctttcgatacggaagtcgaaagcaacacaatggaggttcatgtgagccgcctgcgcaaaaaactcggccacgcgatcatcgaaacggttcgcggcattggctacaggcttggcaatagcaaatcgaaagcagcacgatga

SEQ ID NO: 106129 - protein, 225 aa, Brucella abortus biovar 1 str. 9-941
MRIILIEDDPILGAAVRDHIAAEGHCVDWVSRLDTAHDYMESARYDLVLLDLMLPDGQGLSFLRDLRTKGCSTPVIILTALDQISDRIQGLNAGADDYLTKPFDLSELSARLNAVARRYSGNPNPLIEIGGLQIDLAAKSVMRDGRALCLTAREWALLEAFLQHPGQTLSKAQLEEHLYSFDTEVESNTMEVHVSRLRKKLGHAIIETVRGIGYRLGNSKSKAAR

SEQ ID NO: 106130 - DNA, 768 bp, Corynebacterium glutamicum ATCC 13032; identical to SEQ ID NO: 8643
  CDS (1)..(768): transl_table=11

SEQ ID NO: 106131 - protein, 255 aa, Corynebacterium glutamicum ATCC 13032; identical to SEQ ID NO: 8644

SEQ ID NO: 106132 - DNA, 687 bp, Pseudomonas syringae pv. syringae B728a
  CDS (1)..(687)
atgaaactgctggtagccgaagacgaacctaaaactggaatctatctgcagcaaggcctgcgggaggctggcttcaatgtggaccgcgtggtcacaggcacagatgccgttgaccaggcgctcaatgaagcctatgacctgttgattctcgacgtgatgatgccaggcctcgatggctgggaagtcatcagacgccttcgcaccgttggccaatccgtaccggtactgtttctgaccgcacgcgacggggtagacgaccgagtcaaggggctggagctgggcgccgatgattacctggttaagccatttgctttttcagaattgctggcacgggtgcgaacgctactgcggcgcggcagcagcaacctcccggttcaaactagcttgcaaatcggagaccttcaggtggatttgctcaagcgtcgagccacccggggcggcaagcgaatcgacctcacggccaaagagtttgcactgctggaattgctgatgcgccggcaaggtgaggtgctgtccaaatcgctgatagcttcccaagtctgggacatgaattttgacagcgacacaaatgtcattgaagtggccatacggcggttaagggccaagattgacgatgacttcgaggcaaaactgctgcatacctgccggggaatgggttacatgctagacgcgcaggacgaaggatga

SEQ ID NO: 106133 - protein, 228 aa, Pseudomonas syringae pv. syringae B728a
MKLLVAEDEPKTGIYLQQGLREAGFNVDRVVTGTDAVDQALNEAYDLLILDVMMPGLDGWEVIRRLRTVGQSVPVLFLTARDGVDDRVKGLELGADDYLVKPFAFSELLARVRTLLRRGSSNLPVQTSLQIGDLQVDLLKRRATRGGKRIDLTAKEFALLELLMRRQGEVLSKSLIASQVWDMNFDSDTNVIEVAIRRLRAKIDDDFEAKLLHTCRGMGYMLDAQDEG

SEQ ID NO: 106134 - DNA, 663 bp, Pseudomonas syringae pv. syringae B728a
  CDS (1)..(663)
atgcgcctgcttctcgtcgaggatgatcgagccattggtcagggcatccgcgtggccctgaataccgagggctataccctcgactggctggaggacggactgagcgcgctgcacgctttgcgcagcgagccattcgacctgttgctgctcgacctcggcctgccgcgcctggatggcctggacctgctgcgccagttgcgcgccgaagcactcaccctgccggtgctgatcctgaccgcgcgcgacgggactgccgaccgtattgccggtctggatgccggtgcggacgattacctgatcaagccattcgacgtcgatgaactgaaagcccgggtccgcgccctgctcaggcgcagccagggccgtgcgcaaccgctgctggaacatgccggcatcagcctcgatccggcgtcgcagcaggtcagtttccagggcagcgaagtaccgatgacgcccatggagtaccagttgctgcatcaactgatgatccgccccggcaaggtggtcacccgcgagcgcttgtccaataccctgtacggttggcaggacaaggtcgaaagcaacacgctggaggtactgattcacaacctgcgcaagaaactgtccaccgagctgatccgcaccgtgcgcggcgtcggttacctgctggagctcaaggcatga

SEQ ID NO: 106135 - protein, 220 aa, Pseudomonas syringae pv. syringae B728a
MRLLLVEDDRAIGQGIRVALNTEGYTLDWLEDGLSALHALRSEPFDLLLLDLGLPRLDGLDLLRQLRAEALTLPVLILTARDGTADRIAGLDAGADDYLIKPFDVDELKARVRALLRRSQGRAQPLLEHAGISLDPASQQVSFQGSEVPMTPMEYQLLHQLMIRPGKVVTRERLSNTLYGWQDKVESNTLEVLIHNLRKKLSTELIRTVRGVGYLLELKA

SEQ ID NO: 106136 - DNA, 702 bp, Xanthomonas campestris pv. campestris str. 8004
  CDS (1)..(702): transl_table=11
atgcgcctgttgctcgtcgaagacaacgccgaccttgccgatgccatcgtgcggcgcatgcgccgtagcgggcacgcagtggattggcagcaggacgggttggctgcggccagcgtgttgcgctaccagagctttgatctggtggtgctggatatcggtctgcccaagctggatggattgcgcgtgctggccgggatgcgcgagcgcggcgacaccacgccggtgctgatgctgaccgcgcgtgatggcatcgaagaccgcgtgcaggcgctggatgtgggggccgacgattacctgggcaagccgttcgactttcgtgagttcgaagcgcgctgccgggtgctgctgcggcgcaatcgcggccaggccagtgaggtagtgcagctcggcgcgttcgtgttcgacaacgctgcgcacaccgtgagcctggacggggtggcgatcgagttgcccaatcgtgagtaccgtctgctggaaatcctgatcggacggctgggccaggtggtgggcaaggacgagatcggcaacgggttgttcggtttcgatgacgatgccggccccaatgcgatcgagctgtatgtgggccggctgcgccgcaagttgatcgatgcgccgctgcgcatcgtcaccgtgcgtggcgccggctacaagctggaagaagccgacccgcaggccgtcaccgaggccggcagcgatggctga

SEQ ID NO: 106137 - protein, 233 aa, Xanthomonas campestris pv. campestris str. 8004
MRLLLVEDNADLADAIVRRMRRSGHAVDWQQDGLAAASVLRYQSFDLVVLDIGLPKLDGLRVLAGMRERGDTTPVLMLTARDGIEDRVQALDVGADDYLGKPFDFREFEARCRVLLRRNRGQASEVVQLGAFVFDNAAHTVSLDGVAIELPNREYRLLEILIGRLGQVVGKDEIGNGLFGFDDDAGPNAIELYVGRLRRKLIDAPLRIVTVRGAGYKLEEADPQAVTEAGSDG

SEQ ID NO: 106138 - DNA, 666 bp, Xanthomonas campestris pv. campestris str. 8004
  CDS (1)..(666): transl_table=11
atgcacctgctccttgttgaagacgacaccatgcttgccgacgccatctacgacggcgtccgccagcagtcctggaccatcgaccatgtcggcaccgccgctgcggccaggaccgcgctggtggaacaccactacaccgcggtgttgctggacatcggcctgccgggcgattccgggctcacggtgatccgctacatgcgtggccattacgatgctaccccggtgatcgcgctgacagcgcgcggccagctcaccgaccgcatccgcgggctggatgccggcgcagacgactacctggtcaagccgttccagttcgatgaactgatggcacgcgtgcgcgccatcgcccggcgcagccagggccgcgtggtgccgttgctcacccagggcgaagtgtcggtggacccgagcagccgcaaggtcacccgcaacggcaagtgggtcgcattgagcgcgcacgaataccgcctgctgctggccttgatggagcgcgccgggcgcgtggtcaccaaggaccagctcgaagaaggcgtgtatggcggcccgtccgaaggcggcagcaacatgatcgcggtctacgtgcaccagctgcggcgcaagctcggcgacgaggtcatcagcaccatctatggccagggctacatgatcggccaggcgcccgaatga

SEQ ID NO: 106139 - protein, 221 aa, Xanthomonas campestris pv. campestris str. 8004
MHLLLVEDDTMLADAIYDGVRQQSWTIDHVGTAAAARTALVEHHYTAVLLDIGLPGDSGLTVIRYMRGHYDATPVIALTARGQLTDRIRGLDAGADDYLVKPFQFDELMARVRAIARRSQGRVVPLLTQGEVSVDPSSRKVTRNGKWVALSAHEYRLLLALMERAGRVVTKDQLEEGVYGGPSEGGSNMIAVYVHQLRRKLGDEVISTIYGQGYMIGQAPE

SEQ ID NO: 106140 - DNA, 666 bp, Haemophilus influenzae 86-028NP
  CDS (1)..(666): transl_table=11
atgagaattttattgatagaagacgataatctaatcggcaatgggttgcagattggtttaactaaacttggttttgcggtggattggtttaccgatggaaaaacaggaatggctgctttaacctctgcatcttatgatgcggtggtattggatttaaccttgcctaaacttgatggattagatgtattgcaacaatggcgatctaatcatcaagatgttcccgtattaattttgactgctcgtgatactttagatgaacgagttaaaggtttacaaagtggtgcagatgattatctttgcaagccttttgctttggctgaagtcgccgcacgtttacaagcccttattcgtcgtcgttatggatatcatcattctgtgatagaacaggctggtgttaagctagatcagaatcaacgttctgtttggctgaataatcaacccatttctttaacaagccgtgaatataaattgcttgaattatttatgctgaataaagattgcgtattgtctcgctcatccattgaagaaaaattatccagttgggatgaggaaattagcagtggcgcattggatgtgcatatttataatttacgccaaaaattggggaaacaatttattcgcacggtacacggtgttggatatgctttgggacaagttgaaaaatga

SEQ ID NO: 106141 - protein, 221 aa, Haemophilus influenzae 86-028NP
MRILLIEDDNLIGNGLQIGLTKLGFAVDWFTDGKTGMAALTSASYDAVVLDLTLPKLDGLDVLQQWRSNHQDVPVLILTARDTLDERVKGLQSGADDYLCKPFALAEVAARLQALIRRRYGYHHSVIEQAGVKLDQNQRSVWLNNQPISLTSREYKLLELFMLNKDCVLSRSSIEEKLSSWDEEISSGALDVHIYNLRQKLGKQFIRTVHGVGYALGQVEK

SEQ ID NO: 106142 - DNA, 672 bp, Pseudomonas fluorescens Pf-5
  CDS (1)..(672): transl_table=11
atgcgagtcctgctcgtggaagaccacctgcaactggccgaaagtatcgcccaggcgctcaagagcaccggcctgaccgtggatgtgctgcacgatggggtggcggccgacctggccctgggcagcgaggaatacgccgtggcgatccttgatgtcggcctgccgcgcatggatggtttcgaagtgctggcgcgcctgcgggcccgcggcaagaacctgccggtgctgatgctgaccgcccgcagtgacgtcaaggaccgggtccacggcctgaacctgggggccgacgattacctggccaagcccttcgagctgaccgagctggaggcccgggtcaaggccctgttgcgccgcagcgtgctggggggcgagcgccagcagcgttgcggagtgctggcctatgacctggacacccggcgtttcaccctgggcgaggagttgctgaccctgacttcccgcgaacaggcggtgctcgaagccttgatcgcccgccccggccgggtcatgagcaaggagcaactggcctcccaggtgttcggcctggacgaagaggccagccccgacgccatcgagatctacgtgcaccgcctgcgcaagaagctcgacggccatgcggtcgccatcgtcaccttccgcggcctgggctacctgctggaaagccgcgatgcataa

SEQ ID NO: 106143 - protein, 223 aa, Pseudomonas fluorescens Pf-5
MRVLLVEDHLQLAESIAQALKSTGLTVDVLHDGVAADLALGSEEYAVAILDVGLPRMDGFEVLARLRARGKNLPVLMLTARSDVKDRVHGLNLGADDYLAKPFELTELEARVKALLRRSVLGGERQQRCGVLAYDLDTRRFTLGEELLTLTSREQAVLEALIARPGRVMSKEQLASQVFGLDEEASPDAIEIYVHRLRKKLDGHAVAIVTFRGLGYLLESRDA

SEQ ID NO: 106144 - DNA, 681 bp, Pseudomonas fluorescens Pf-5
  CDS (1)..(681): transl_table=11
atgaaactgctgatcgtcgaagaccaacccaaaaccggccactacctgcgccagggcctgagcgaggccggcttcaacgccgaactggtggccgacggcagcaccggccagcaccaggccctgaccggcgactacgctctgctgattctcgacgtgatgctgccgggtcgcaacggctggcagatcctccaggcggtgcgcagcgccgggctggagatgccggtactgttcctcaccgcccgggatgccgtgcaagaccgggtgcacggcctggaattgggggccgacgactacctggtcaagccttttgccttctccgaactgctggcccgggtccgcagcctgctgcgccggggcagcgccgtggcccaggaaaccagcctgcaactggcagacctgcgcctggacctgatccgccgccgggtagaacgcggcagccagcgcatcgacctgaccgccaaggaattcgccctgctggaaatgctcctgcggcgccagggcgaagtcctgcccaagtcgctgattgcctcccaggtctgggacatgaatttcgacagcgataccaacgtcatcgaagtagccatccgccgcctgcgcctgaagatcgacgacgatttcccgaacaaactgatccataccgtacgcggcatgggctacgtgctcgaagagcgccaggcctga

SEQ ID NO: 106145 - protein, 226 aa, Pseudomonas fluorescens Pf-5
MKLLIVEDQPKTGHYLRQGLSEAGFNAELVADGSTGQHQALTGDYALLILDVMLPGRNGWQILQAVRSAGLEMPVLFLTARDAVQDRVHGLELGADDYLVKPFAFSELLARVRSLLRRGSAVAQETSLQLADLRLDLIRRRVERGSQRIDLTAKEFALLEMLLRRQGEVLPKSLIASQVWDMNFDSDTNVIEVAIRRLRLKIDDDFPNKLIHTVRGMGYVLEERQA

SEQ ID NO: 106146 - DNA, 684 bp, Pseudomonas fluorescens Pf-5
  CDS (1)..(684): transl_table=11
atgacccgcattctgaccatcgaagacgacgccgtgaccgcccgggaaatcgtcgccgaactgagcagccacggcctcgacgtggattgggtggacaatggccgtgagggcctggtgcgcgccgtgagcggcgactacgacctgatcaccctggaccgcatgctgccggaactggacggcctggccatcgtcaccaccctgcgcaccatcggtgtgtcgacaccgatcctgatgatcagcgccctctccgacgtcgatgaacgggtgcgcggcctgcgggccgggggcgacgactacctgaccaagcccttcgcctccgacgagatggcggcccgggtcgaagtgctgctgcggcgcaagaacacggtcaaggatttcgacaccagcctgcgggtggcggacctggaactgaacctgatcagccgcgaggcaacccgcgccgaccagttgctgagcctgctgcccaccgaatacaagctgctggaattcctcatgcgcaacaccgggcagatcctctcgcggatgatgatcttcgaggaggtctggggctatcacttcgaccccgggaccaatttgatcgacgtgcacatcggccgcctgcgcaagaagatcgacccgcccggcatgaccccgttgatccgcaccgtgcgaggctcgggttatgtcattgctgaacccctctaa

SEQ ID NO: 106147 - protein, 227 aa, Pseudomonas fluorescens Pf-5
MTRILTIEDDAVTAREIVAELSSHGLDVDWVDNGREGLVRAVSGDYDLITLDRMLPELDGLAIVTTLRTIGVSTPILMISALSDVDERVRGLRAGGDDYLTKPFASDEMAARVEVLLRRKNTVKDFDTSLRVADLELNLISREATRADQLLSLLPTEYKLLEFLMRNTGQILSRMMIFEEVWGYHFDPGTNLIDVHIGRLRKKIDPPGMTPLIRTVRGSGYVIAEPL

SEQ ID NO: 106148 - DNA, 678 bp, Pseudomonas fluorescens Pf-5
  CDS (1)..(678): transl_table=11
atgcacgtacttgtctgtgaagatgatgagctgattgccagcgggatagtcgccggcctcacggcccagggcctgacggtcgagcatgtggccaccgcttcggcagcgcgggccatgctcggcgtggccgatttcgacgtgatggtactggatcttggccttccggatgaagacggtttgaagctgctcaagcagcagcgccagcagggcctggagattccggtgctgatcctcaccgcccgcgactcggtgaccgaccgggtcgatggcttgcaggccggtgccgacgattacctgctcaagcccttcgacctgcgggaactggcggcgcgcctgcacaccctgttgcgccgggtggcggggcgcagcgtcaacctgatcgagcacgggcgcttgacctatgacccgagcacccgggaaaccctgctcggcggccaaccggtggacctctcgcggcgcgagcaatccctgctccaggcgctgctgcacaaccgtggccgggtgctgtccagcgagcaactcaaggacagcgtctacggtttcaacgatgagctggagagcaacgcgctgaatgtgcacatccaccacctgcggcgcaaactcggcaacggcatcgtcgaaaccgtgcgcggcctcggctatcgcctgggcccggccgacggtgaggagaaccgctaa

SEQ ID NO: 106149 - protein, 225 aa, Pseudomonas fluorescens Pf-5
MHVLVCEDDELIASGIVAGLTAQGLTVEHVATASAARAMLGVADFDVMVLDLGLPDEDGLKLLKQQRQQGLEIPVLILTARDSVTDRVDGLQAGADDYLLKPFDLRELAARLHTLLRRVAGRSVNLIEHGRLTYDPSTRETLLGGQPVDLSRREQSLLQALLHNRGRVLSSEQLKDSVYGFNDELESNALNVHIHHLRRKLGNGIVETVRGLGYRLGPADGEENR

SEQ ID NO: 106150 - DNA, 678 bp, Pseudomonas fluorescens Pf-5
  CDS (1)..(678): transl_table=11
atgcgcgttctgattatcgaagacgaagaaaaaacggccgattacctgcaccgcgggttgaccgagcaaggctacaccgtcgacctggcccgggacggcgtcgaaggcctgcacatggctctggagggcgactatgccgtgatagtgctggatgtgatgctgcccggcctggatggctttggcgtattgcgagcactgcgtgcgcgcaagcagaccccggtgatcatgctcaccgcccgcgaacgcgtggaagaccgcatcaagggcctgcgcgatggcgccgacgactacctgggcaagcccttctccttccttgaactggtggcccgcctgcaagccctgacccgtcgcagcggtgggcatgagccggtgcagatcagcatcgccgacctgtggatcgacctgatcagccgcaaggccagccgtgccggcagccgcctggacctgaccgccaaggagttttccctgctcagcgtgctggcccggcgccagggcgagatcctgtccaagaccgccatcgctgaaatggtctgggacatcaatttcgacagcgacgcgaatgtcgtcgaagtggcgatcaagcgcctgcgggccaagctcgacggccccttcgaacagaaactgctgcacaccatccgtggcatgggctatgtgctggagagccgcggtgccgagtaa

SEQ ID NO: 106151 - protein, 225 aa, Pseudomonas fluorescens Pf-5
MRVLIIEDEEKTADYLHRGLTEQGYTVDLARDGVEGLHMALEGDYAVIVLDVMLPGLDGFGVLRALRARKQTPVIMLTARERVEDRIKGLRDGADDYLGKPFSFLELVARLQALTRRSGGHEPVQISIADLWIDLISRKASRAGSRLDLTAKEFSLLSVLARRQGEILSKTAIAEMVWDINFDSDANVVEVAIKRLRAKLDGPFEQKLLHTIRGMGYVLESRGAE

SEQ ID NO: 106152 - DNA, 675 bp, Psychrobacter arcticum 273-4
  CDS (1)..(675): transl_table=11
atggcacgcatattattgatagaagacgatagcaccatcgctgacggtattgtccttggcttaaaaagtcatggcatgatggtggattggtttagtgatgccaagcaaggtgaaatggcgctgcaagacggcatgtttgatgcggtactgcttgatttaaccttgccaaaaggtgatggtatgaccgtactaaaaaactggcgggcaaaacacatagatacgcctgtattaattatcacggctcgcgatgcgattgccaatcgtgtggcaggactcaatgcaggcgctgatgattatttggtgaagccatttgcattagatgaggttattgcccgtctgcaagcattgatgagacgcagccaaggtcggagtcaacctgaagtccgttatggcgaagtagcctatcagcctcataatcagcaagtctcttatcaaggtaaaactgtagaattaaccatcaaggaagtggcaatcttagagcaaatgctgacccaccctaagcaaattcacagccgcgcaagcttagaagataagctatatggatggaaacaagatatcgaaagcaatgccattgaagtgcatattcatcatttacgtaaaaaactgggcaatgattttatcttgaccaaacgtggtattggctactatctcaatccagcccataatcagcgttag

SEQ ID NO: 106153 - protein, 224 aa, Psychrobacter arcticum 273-4
MARILLIEDDSTIADGIVLGLKSHGMMVDWFSDAKQGEMALQDGMFDAVLLDLTLPKGDGMTVLKNWRAKHIDTPVLIITARDAIANRVAGLNAGADDYLVKPFALDEVIARLQALMRRSQGRSQPEVRYGEVAYQPHNQQVSYQGKTVELTIKEVAILEQMLTHPKQIHSRASLEDKLYGWKQDIESNAIEVHIHHLRKKLGNDFILTKRGIGYYLNPAHNQR

SEQ ID NO: 106154 - DNA, 732 bp, Colwellia psychrerythraea 34H
  CDS (1)..(732): transl_table=11
atgagaattttattagtagaagatgaccaagggcttgctgaagcactgcagcaatccttagttagagaaggctttgttgtcgatcatttatccagaggaaagctcgctttaaccgctttagccgtgcctagccatgatatggttatccttgatttaggcttgccagatattgatggtttactggtcttgaaagaaattagagctaaaaagaatgacttgccggttattattttaaccgctagagatagcattgacagtaaagtgaaaggcttagattatggcgcagacgattacttagcaaaaccgtttgatatgcaagagttattggcaaggttaagagtcatagagcgccgcttaggcaccgcttctagttcaatgattacgattgaccgagtgagcttggatactaagtctcataaagtatatttactacaatgtaaccaagtaaataacgaacaaaatcacgaacaagaaggtgagataaacgcgcagaatggtgcaagtgaagtgcacttttctaaaaaagagtttatggtattaaaggcgttgatggaaaatgccggacgtattcaatcacgagagcaaattgaatctaaactctatcaatggggtgaagaagtgctgagtaacgctgtcgaagtgcatattcataaattaagaaagaacctgcccaataaattcatacaaaatgtccgtggtgtaggttacatcattaatcaccctcaagactaa

SEQ ID NO: 106155 - protein, 243 aa, Colwellia psychrerythraea 34H
MRILLVEDDQGLAEALQQSLVREGFVVDHLSRGKLALTALAVPSHDMVILDLGLPDIDGLLVLKEIRAKKNDLPVIILTARDSIDSKVKGLDYGADDYLAKPFDMQELLARLRVIERRLGTASSSMITIDRVSLDTKSHKVYLLQCNQVNNEQNHEQEGEINAQNGASEVHFSKKEFMVLKALMENAGRIQSREQIESKLYQWGEEVLSNAVEVHIHKLRKNLPNKFIQNVRGVGYIINHPQD

SEQ ID NO: 106156 - DNA, 684 bp, Pseudomonas syringae pv. phaseolicola 1448A
  CDS (1)..(684): transl_table=11
atgacccgaattctggcaatcgaagatgatgccatcacagcaaaggaaatcgtgaccgaactcagcaaccacggactggaagtggactgggtggacaacggccgtgacggtcttgcacgtgcagtgagcggcgactatgacttgattactctggaccgcatgcttccggagatggatggtctgaccatcgtcacccatctgcgcgcccagggtatctccacgccaatcctgatgatcagcgccctttccgacgtggacgagcgggtgcgcgggctgcgtgcaggtggggatgattatctgcccaaaccgtttgcttccgacgaaatggcggcgcgtgtcgaagtgctcctgcgccgcagcaacccggtcagcgcgggcaagacagtgctacaggtcgctgatctggaactgaatctgatcagccgcgaagcctgccgtggcggtgagccgctgaccctgctgcccaccgagttcaagctgctggaattcctgatgcgtaacagcggccagatcatcacccgcatgatgattttccaggaagtctggggctatcactttgatccgggcaccaacctgatcgacgtgcatattggccgtctgcgcaagaagatagaccaacctggcaccgcacagctgatccagaccgtgcgaggttcaggttatgttattgccgaacccgtctaa

SEQ ID NO: 106157 - protein, 227 aa, Pseudomonas syringae pv. phaseolicola 1448A
MTRILAIEDDAITAKEIVTELSNHGLEVDWVDNGRDGLARAVSGDYDLITLDRMLPEMDGLTIVTHLRAQGISTPILMISALSDVDERVRGLRAGGDDYLPKPFASDEMAARVEVLLRRSNPVSAGKTVLQVADLELNLISREACRGGEPLTLLPTEFKLLEFLMRNSGQIITRMMIFQEVWGYHFDPGTNLIDVHIGRLRKKIDQPGTAQLIQTVRGSGYVIAEPV

SEQ ID NO: 106158 - DNA, 669 bp, Pseudomonas syringae pv. phaseolicola 1448A
  CDS (1)..(669): transl_table=11
atgcgcctgctactggttgaagaccatgttcctctcgcggatgagttactcgctgcgctgggacggcaaggctacgcagtcgactggctggctgacggtcgtgacgcggtttatcaaggcgcaaccgagccctacgacctcattgttctggatctgggcttgcccggcatgcccgggcttgaggttctccagcaatggcgcggcaagggcctggctacccccgtactgattctgacggcacgaggttcgtggtcagagcgtatagaaggcttgaaggcgggggctgacgattacctgaccaaaccttttcatcctgaagaactacagttgcgtattcaggccctgttgaggcgttcgcacgggcttgccaaccagccaaccctggagtctgccggccttaatctggatgaaggtcgccagagtgtcagccgggatggcgttgatatccagctcacgtctgcagagtttcgtctgctgcgctatttcatgctccaccctggacagattctctccaaaagccatctctctgagcacttgtacgatggcgaaaacgagcgtgactccaatgtcatcgaggtccatgtcaatcacctgaggcgcaaactaggccgcgcagtggtcgagacacgccgtggccaaggctatctgtacggcggagccggaggttga

SEQ ID NO: 106159 - protein, 222 aa, Pseudomonas syringae pv. phaseolicola 1448A
MRLLLVEDHVPLADELLAALGRQGYAVDWLADGRDAVYQGATEPYDLIVLDLGLPGMPGLEVLQQWRGKGLATPVLILTARGSWSERIEGLKAGADDYLTKPFHPEELQLRIQALLRRSHGLANQPTLESAGLNLDEGRQSVSRDGVDIQLTSAEFRLLRYFMLHPGQILSKSHLSEHLYDGENERDSNVIEVHVNHLRRKLGRAVVETRRGQGYLYGGAGG

SEQ ID NO: 106160 - DNA, 663 bp, Pseudomonas syringae pv. phaseolicola 1448A
  CDS (1)..(663): transl_table=11
atgcgcctgcttcttgtcgaggatgatcgtgcgattggccaaggcatccgtgtggcccttaacaccgagggctacacgctggactggctggaagacgggctgagcgcgctgcacgccctgcgcagcgaacccttcgacctgttgctgctcgacctcggcctgccgcgcatggatggtttcgatctgctgcgccagttgcgcgccgaagagcttgccctgccggtgctgatcctgaccgcgcgcgacggcaccgccgaccgcattgccggcctggacgccggtgccgacgactacctgatcaagccgttcgacgtcgatgaactcaaagcccgggtccgggctttgctcaggcgtagccagggacgtgcgcagccgttgctggaacacgccggcatcagcctcgacccggcttcgcagcaggtcagttttcagggcagcgaagtgccgatgacgccaatggaatatcaactgctgcaccaattgatgatccgccccggcaaggtggtcacccgcgagcgcttgtccaataccctgtatggctggcaggacaaggtcgaaagcaacactctggaagtgctgattcacaacctgcgcaagaaactgtccaccgaactgatccgcaccgtgcgcggcgtcggctacctgctggagctcaaggcatga

SEQ ID NO: 106161 - protein, 220 aa, Pseudomonas syringae pv. phaseolicola 1448A
MRLLLVEDDRAIGQGIRVALNTEGYTLDWLEDGLSALHALRSEPFDLLLLDLGLPRMDGFDLLRQLRAEELALPVLILTARDGTADRIAGLDAGADDYLIKPFDVDELKARVRALLRRSQGRAQPLLEHAGISLDPASQQVSFQGSEVPMTPMEYQLLHQLMIRPGKVVTRERLSNTLYGWQDKVESNTLEVLIHNLRKKLSTELIRTVRGVGYLLELKA

SEQ ID NO: 106162 - DNA, 672 bp, Dechloromonas aromatica RCB
  CDS (1)..(672): transl_table=11
atgcgcatccttatcgctgaagacgacgccatcatcgcggatggcttatcccgctccctacggcagggcggttacgctgtggactgggcacccaatggcatggaggccgacacggcactggtcacggtatcctacgatttgctgattcttgatctcggtttgcccaagctttccgggcttgaggtgctcaagcgactacgggcgcgtaattcgcagttgccggtgttgattctgacggcccttgatggcacaggcgatcgcgtcaaggggcttgacctgggtgcggacgactacatggtcaagccgtttgagctgcctgagcttgaagccagggtgcgggccttgacccgccgctcggctggtacctcgccgaccatccagtgtggcgccctgacttatgaccaggttggacgagtcgctcagatacagggccaaaccctggagttgtcggcgcgtgaagttggcttgctggaagtgctgttgagccggatggggcgcttggtcagcaaggaccagctggtcgatcatctttgtggctggggtgaggaagtcagccataatgccatcgaggtttatgtccatcgcctgcgcaagaagatcgagccgggcggcgtgaagatcgcgaccgttcgtggtctgggttattgccttgagcgcccccctggcgagtaa

SEQ ID NO: 106163 - protein, 223 aa, Dechloromonas aromatica RCB
MRILIAEDDAIIADGLSRSLRQGGYAVDWAPNGMEADTALVTVSYDLLILDLGLPKLSGLEVLKRLRARNSQLPVLILTALDGTGDRVKGLDLGADDYMVKPFELPELEARVRALTRRSAGTSPTIQCGALTYDQVGRVAQIQGQTLELSAREVGLLEVLLSRMGRLVSKDQLVDHLCGWGEEVSHNAIEVYVHRLRKKIEPGGVKIATVRGLGYCLERPPGE

SEQ ID NO: 106164 - DNA, 666 bp, Dechloromonas aromatica RCB
  CDS (1)..(666): transl_table=11
atgcgcatcctgcttgtcgaagatgacaccatgctggccgagagcatctgcgaaggcctcgaaaaagggggcttcacggtcgatcggctgggggcggcagaacccgccgaatcggcacttggcctgacccactacgatctggccattatcgatatcggtctgccgggcatgagtgggcttgagctgattcgtcgtgtgcggctgcgtggcctgcaggtgccggtcctcatcctgaccgccagggatggcctggatgaccgcatcagcggcctcgacctcggtgccgatgactacatggtcaagcctttccagttgcccgaactgctggcgcggatgcgggccctgattcggcgcagcctttcggcggccagctcggaactggctgccgggggcattcgcctcgacctggctcgacgcgtcgccacggcccacggcgaaatcatggacctgaccggccgcgaatgggaaattctgcagcaattgatgctggccagcccaaacgtcgtaggcaagcagaaaatggcggaaagtctgagcgagtgggaaaacgaaatatccgccaatgccgtggaaatctacatctcgcgcctgcgccagaagttgcaggggtgtggcattgaaatccgcaccatccgcggtattggctaccgactcgatgagctctga

SEQ ID NO: 106165 - protein, 221 aa, Dechloromonas aromatica RCB
MRILLVEDDTMLAESICEGLEKGGFTVDRLGAAEPAESALGLTHYDLAIIDIGLPGMSGLELIRRVRLRGLQVPVLILTARDGLDDRISGLDLGADDYMVKPFQLPELLARMRALIRRSLSAASSELAAGGIRLDLARRVATAHGEIMDLTGREWEILQQLMLASPNVVGKQKMAESLSEWENEISANAVEIYISRLRQKLQGCGIEIRTIRGIGYRLDEL

SEQ ID NO: 106166 - DNA, 672 bp, Dechloromonas aromatica RCB
  CDS (1)..(672): transl_table=11
atgcgcatcctgatcgttgaagatgacaatcttgtcgcccagggcctgaagcagggacttcagcaactgggctacacggtcgatgttgcccgcagtgcggaagaagccgaggcgttcgcagtgggtgaggattttgacattacactggtcgatatcgggctacccaaagccgatggtctgcatttcatccggcaacttagaacgcgaggaaatcgcctgccggcattgatcctgacggccagagacagcatggacgacacaatcaagggactggatgccggggcggacgattacatgaccaagccctatcgcctcccggaagttgccgcccggataagggctctgatccgccgctcaaacgccgttgtcgacgcctgcctgcaccacgatggcatacgcatggacacccgcagccacacggcaacgctgaacggtgaaccgctcgacctgacaaatcgcgaatgggccatcctggaaatgctgctgatggcgtcccccgccgtcgtcagcaaagacaaactggttcagggactggccggctgggacaaggacatcacgccaaatgccatcgaagttcatgtctccaggctacgccagaagctcaccactggcactatcgtcatccgaacagttcgcggtattggatatcgtgtcgatgcagcccaaaactaa

SEQ ID NO: 106167 - protein, 223 aa, Dechloromonas aromatica RCB
MRILIVEDDNLVAQGLKQGLQQLGYTVDVARSAEEAEAFAVGEDFDITLVDIGLPKADGLHFIRQLRTRGNRLPALILTARDSMDDTIKGLDAGADDYMTKPYRLPEVAARIRALIRRSNAVVDACLHHDGIRMDTRSHTATLNGEPLDLTNREWAILEMLLMASPAVVSKDKLVQGLAGWDKDITPNAIEVHVSRLRQKLTTGTIVIRTVRGIGYRVDAAQN

SEQ ID NO: 106168 - DNA, 690 bp, Dechloromonas aromatica RCB
  CDS (1)..(690): transl_table=11
atgcacatcctgctcgtcgaagatgacgccctgctggccgatggtctggcccgagctctgcgccattccggatatatcgtcgacaccgccaatgacggcctgagtgccgattccctgctggccaatgaggcctacgatctggtgattctcgatatcggcctgcccgggctcgatggttgtgaggtattgcagcgcctgcgcacccgccgtcagcagacgccggtgctggtgttgtcagcgcggctggcggttgaagagcgggtgcgcctgcttgatctgggcgccgatgattacgtggtcaaaccggtgacccaggccgaactggaggcacgggtcagagccctgatccggcgccggctgggtgaggcgtcgcccgaggtggttctcggcagtctgcgtctggatacggtgggcaagcgggcctggttgaacgatacggcgcttgagttgaatgcccgggagtgggcggcgcttgagtttctggccggccgggttaaccggatcgtcagcaaggaacagttgatccaggcgctgtatagctggcaggatgaaatcacgccaaacgccatcgaaaaactcgtttcgcgtctgcgcgtcaagcttgaagaggcagggatcacgatccgcaccgtgcgcggactgggctattacctggaaaaaccggccgatgctgccgcgcgtgacgagtag

SEQ ID NO: 106169 - protein, 229 aa, Dechloromonas aromatica RCB
MHILLVEDDALLADGLARALRHSGYIVDTANDGLSADSLLANEAYDLVILDIGLPGLDGCEVLQRLRTRRQQTPVLVLSARLAVEERVRLLDLGADDYVVKPVTQAELEARVRALIRRRLGEASPEVVLGSLRLDTVGKRAWLNDTALELNAREWAALEFLAGRVNRIVSKEQLIQALYSWQDEITPNAIEKLVSRLRVKLEEAGITIRTVRGLGYYLEKPADAAARDE

SEQ ID NO: 106170 - DNA, 678 bp, Dechloromonas aromatica RCB
  CDS (1)..(678): transl_table=11
atgaaaatcctggtcgtggaagacgaacagaaaaccggcgattacctgcggcaggggctaatggaagcgggcttcatcgtcgatctggcgcgtgacggattcgacgggttgcacctggcgctgaccgaggcctacgatctggcagtcctcgacgtgatgctgcccggcatcgacggctggcaagtgctgcaaggcattcgccgggccggcaaggacatgccggtgctctttctgacggctcgcgatgacgtcgaggaccgagtcaaggggctggaacttggggccgatgactacctggtgaaacctttcgccttttctgaactgctggcccgtgtccgaaccctgcttcggcgcggcggcaaagcaaaggaatccgatctcctgaacgcggccgacctcgaactcgacctgatgcgtcgtcgggttacccgatccggcaagaaaatcgacctgacctcgaaagagttcgcgctgctggaagttcttttgcggcgtcagggcgaggtgctgccgcgctcgctgattgcctcccaggtgtgggacatgaacttcgacagcgatacaaacgtcatcgaggtcgccatccggcggctgcgggccaaggtggacgacggtttcgagccgaaactaatccggacggttcgaggcatgggctatgtgctggagacagccgagtga

SEQ ID NO: 106171 - protein, 225 aa, Dechloromonas aromatica RCB
MKILVVEDEQKTGDYLRQGLMEAGFIVDLARDGFDGLHLALTEAYDLAVLDVMLPGIDGWQVLQGIRRAGKDMPVLFLTARDDVEDRVKGLELGADDYLVKPFAFSELLARVRTLLRRGGKAKESDLLNAADLELDLMRRRVTRSGKKIDLTSKEFALLEVLLRRQGEVLPRSLIASQVWDMNFDSDTNVIEVAIRRLRAKVDDGFEPKLIRTVRGMGYVLETAE

SEQ ID NO: 106172 - DNA, 672 bp, Dechloromonas aromatica RCB
  CDS (1)..(672): transl_table=11
atgaagatcctcattgttgaagacgaagcgaagactggcgattacctcaaacaggggctttccgaagctggctttggcgccgatctcgcccgcaatgggctggatgggatgcatgaaggtctggccggtgaatacgacctgctgattctcgacgttaaccttccggggctggatggctggcaggtactgaaagccttgcgtgctgccgggcgcgatctgccagtgctgttcctgacggcgcgcgaccaggttgaggatagggtcaaggggctggaactcggtgccgatgattacctggtcaaacccttcgctttctcggagctgctcgctcgcgtccgaacactgctgcgtcgcggtcgtgccaaggagacggggaatctgagcattgctgatcttgaactcgatgtgctgaagcggcgggcgatccgggccggtcagcgcatcgacctgacggccaaggaattcgcgctgcttgaactgttcctgcgccggcagggcgaggtgctggcacgcagtttcatcgcctcgcaggtctgggacatgaatttcgattccgacaccaatgtggtcgaagttgccatccgccgcctgcgggccaaggtcgatgaggagttcacgcccaaactgatccataccctgcgcggcatgggctatgtgatggagattcgctga

SEQ ID NO: 106173 - protein, 223 aa, Dechloromonas aromatica RCB
MKILIVEDEAKTGDYLKQGLSEAGFGADLARNGLDGMHEGLAGEYDLLILDVNLPGLDGWQVLKALRAAGRDLPVLFLTARDQVEDRVKGLELGADDYLVKPFAFSELLARVRTLLRRGRAKETGNLSIADLELDVLKRRAIRAGQRIDLTAKEFALLELFLRRQGEVLARSFIASQVWDMNFDSDTNVVEVAIRRLRAKVDEEFTPKLIHTLRGMGYVMEIR

SEQ ID NO: 106174 - DNA, 657 bp, Dechloromonas aromatica RCB
  CDS (1)..(657): transl_table=11
atgcgcattctgcttgtcgaagatgatcctgaactgggcgacggcttgaccgtcggcttgcgtcaggccggttttgccgtcgattggctgcgcgacggcaattcagctgaccaggcactgcagagtgagagcttcgacttcgtcgtgctcgatctcggtctgccgcgtctttccggcatggaagtgctgaatcgcgcccggggccgcggtcaggacatgcccatcctgattctgaccgcccgcgacgctaccggcgacaaggtttccggactggatgccggggctgacgactacctcgtcaaaccgatcgacctcgacgagttgaccgcccgcatccgcgccctgacccggcgcagcgccggccgtgctgccccgctattgacccatggcgagctgagtatcgaccttgccgcccaccgcgtcaccctggccgggcaggaaatcgaactgtccagccgcgagttctcgctgttgcagatgcttctggaaagtgctggccgtgtgctgactcgcacccagctcgaacaatcgctctatggctggcacgacgaacccgacagcaacgccctcgaagtacacatccaccacctgcgcaagaagctgggcagcgaattgatccgcaccctgcgcggggtcggctacaccattcccaagtga

SEQ ID NO: 106175 - protein, 218 aa, Dechloromonas aromatica RCB
MRILLVEDDPELGDGLTVGLRQAGFAVDWLRDGNSADQALQSESFDFVVLDLGLPRLSGMEVLNRARGRGQDMPILILTARDATGDKVSGLDAGADDYLVKPIDLDELTARIRALTRRSAGRAAPLLTHGELSIDLAAHRVTLAGQEIELSSREFSLLQMLLESAGRVLTRTQLEQSLYGWHDEPDSNALEVHIHHLRKKLGSELIRTLRGVGYTIPK

SEQ ID NO: 106176 - DNA, 690 bp, Ralstonia eutropha JMP134
  CDS (1)..(690): transl_table=11
atgcgcattctgattgccgaagatgacgatgtgcttgccgacggcctgacgcgctcgctgcgtcactccggctatgcggtcgaccatgtcgcgaatggcctcgaggccgattccgcgctgtcgacccagactttcgacctgctgatcctggatcttggcctgccgcgcatgccgggtctggaagtgctcaagcgcctgcgcgcgcgcggcgccatgctgccggtgctgatcctgaccgctgccgacggcgtcgatgagcgcgtcaagggactggacctcggtgctgacgactatatggcaaaaccgtttgcgttgtccgaactcgaagcccgggtgcgcgcgctggtgcgccgcggcgccggcggcggcgcgacgctgatgcgccacgggccgctcgcattcgaccaggtcggtcgcattgcctatatgaacgagcagatgctggacttgtcggcacgcgaggtcgggctgctcgagatcctcctcactcgctgcgggcggctggtctccaaggaacagctcgtggaccatctgtgcgagtggggcgaagaggtcagtaacaacgcgatcgaggtctacgtgcaccggctgcgcaaaaagatcgaagttggtggcatccgcattgccacggtacgcgggcttggctactgcctggagaagttccagccaagcgtggccgcgcatagctga

SEQ ID NO: 106177 - protein, 229 aa, Ralstonia eutropha JMP134
MRILIAEDDDVLADGLTRSLRHSGYAVDHVANGLEADSALSTQTFDLLILDLGLPRMPGLEVLKRLRARGAMLPVLILTAADGVDERVKGLDLGADDYMAKPFALSELEARVRALVRRGAGGGATLMRHGPLAFDQVGRIAYMNEQMLDLSAREVGLLEILLTRCGRLVSKEQLVDHLCEWGEEVSNNAIEVYVHRLRKKIEVGGIRIATVRGLGYCLEKFQPSVAAHS

SEQ ID NO: 106178 - DNA, 750 bp, Ralstonia eutropha JMP134
  CDS (1)..(750): transl_table=11
atgtcgactgctcgacttgccaggcttcattgccgcggattggcctatatctttaaaagcataaaagcaggcctggaaatgagaatacttattgttgaagacgaccccatgctgggtgatggcctgttgcatggcctgcagctcgtgggatacgtcgtcgactggttcaccacgggtgcagagggcgatcatgcacttggcatggtgcactacgatgctgccgtgctcgaccttggactgccgggcgacgacggcatgacgtggctgcggcgctggcgcgagcgcggctgccagatcccggtgctggtactcacggcgcgtgacgccatcgagagccgcatcagcggcctggattcgggggccgacgattatctggtcaagccgatttcgctggatgaacttgccgcccggctgcgcgccatgacgcgccgcgccgccggaaactccgcgcctgtctggcggcacggcgcacttgaattccacccggccgccaagcaggccctctggcacggcaagcccgtggacctgaccagccgcgaggcgatgctgctcgaactgctgctggcccacccgaaccgcctgctgacgcgcgattttctgcgcgacaagctctatgactggcagggcggcctcgaaagcaacacgctggaggtgcatatccaccacctgcgccgcaagatccatccgaagatcgtccgcacattccgtggcgcgggctacacgctcggtgctgccgaggactgcgcatga

SEQ ID NO: 106179 - protein, 249 aa, Ralstonia eutropha JMP134
MSTARLARLHCRGLAYIFKSIKAGLEMRILIVEDDPMLGDGLLHGLQLVGYVVDWFTTGAEGDHALGMVHYDAAVLDLGLPGDDGMTWLRRWRERGCQIPVLVLTARDAIESRISGLDSGADDYLVKPISLDELAARLRAMTRRAAGNSAPVWRHGALEFHPAAKQALWHGKPVDLTSREAMLLELLLAHPNRLLTRDFLRDKLYDWQGGLESNTLEVHIHHLRRKIHPKIVRTFRGAGYTLGAAEDCA

SEQ ID NO: 106180 - DNA, 675 bp, Ralstonia eutropha JMP134
  CDS (1)..(675): transl_table=11
atgaagattcttgttgtggaagacgagcccaagacgggcgaatacctgcgcaaaggcctgaccgagtcatcctttgtggtcgatgtcgcggtgacgggcggagatggcctgcaccaggccacggaacacgaatacgacctgatcatcctggatgtcatgctgccgggcatgagcgggtgggacgtgctcaggcagctgcgcgagcgcaaggacacgccggtcctgttcctgacggccagggacgaagtggaagaccgtgtccgcggcctggagctcggcggcgacgactatcttgccaaaccgtttgcctttgtcgaactgctcgcgcgggtacgcacgctgctgcggcgcggaccggtacgcgaggccgaccgtatcgaaatcggcgacctggagatcgacgtgatccgccatcgcgtcacccgggctggccagcgcatcgacctgactccgcgcgaattcgccctgctgcatttcctggccaggcggcatggggaggtgctcagccgcacgcacattgcctcccaggtgtgggacatgaacttcgacagcgataccaatgtggtggacgtggccatccgccgcctgcgcgcaaagatggacgaccacttcgcgcccaagctgatccacagcgtacgcggcatcggctacgtcctcgaaattcggccatcgtga

SEQ ID NO: 106181 - protein, 224 aa, Ralstonia eutropha JMP134
MKILVVEDEPKTGEYLRKGLTESSFVVDVAVTGGDGLHQATEHEYDLIILDVMLPGMSGWDVLRQLRERKDTPVLFLTARDEVEDRVRGLELGGDDYLAKPFAFVELLARVRTLLRRGPVREADRIEIGDLEIDVIRHRVTRAGQRIDLTPREFALLHFLARRHGEVLSRTHIASQVWDMNFDSDTNVVDVAIRRLRAKMDDHFAPKLIHSVRGIGYVLEIRPS

SEQ ID NO: 106182 - DNA, 681 bp, Ralstonia eutropha JMP134
  CDS (1)..(681): transl_table=11
atgcgtatcctgcttgccgaagacaacctgatgctggccaactcgctgacccaggccatgacccaggccgggtttaccgtcgactgcatgcacgacggccgtagcgccgaccacctgctggccacgcaggactatgcgttgctgatcctcgatctcggcttgccacggctggacggtcttgaagtgctgcgccggctgcgccaacgccgcaaccgcatgcctgtgctcatcctgaccgcgcatggctcggtggaggaccgcgtgcgcggtctggacctgggcgccgacgactacctggccaagccctttgacctttccgagctagaagcgcgcgcacgcgcgctgatccgccgcagccacggccatgaatccacacagctgagttgcggccccctgcactacgacagcgtgagccgcgcgttcacgatcgacggcgaactgctgcaactcacgcggcgcgagcgatcggtgctcgaagtgctgttgctgcgtaatggcaaggccgtcaacaagtcagccctctccgagaagatcttcggcattgacgagtcggtcaatccggatgccatcgagatctacatccaccgcctgcgcaagaagctcgatggcagcggcgtggcgatcgtcacgctgcgtgggctcggctatctgatcgaagcgcggccacagcctgcgccatga

SEQ ID NO: 106183 - protein, 226 aa, Ralstonia eutropha JMP134
MRILLAEDNLMLANSLTQAMTQAGFTVDCMHDGRSADHLLATQDYALLILDLGLPRLDGLEVLRRLRQRRNRMPVLILTAHGSVEDRVRGLDLGADDYLAKPFDLSELEARARALIRRSHGHESTQLSCGPLHYDSVSRAFTIDGELLQLTRRERSVLEVLLLRNGKAVNKSALSEKIFGIDESVNPDAIEIYIHRLRKKLDGSGVAIVTLRGLGYLIEARPQPAP

SEQ ID NO: 106184 - DNA, 687 bp, Ralstonia eutropha JMP134
  CDS (1)..(687): transl_table=11
atgaaactgctagtagtggaagacgaggccaagaccggcgaatacctgcggcagggcctgacagaggccggcttcgtggtggacctggccgcgaatggactcgatggccaccatctggccatgagcgaggcctacgatctgatcatcctcgacgtgatgctgccggacgtggacggctggcgcatcgtgcagacgctgcgcgcggccggcaaccgcgtgccggtgctgttcctgactgcgcgcgacagcgtggcggaccgcgtcaaggggctcgagctgggcgcggacgactacctggtcaagccattcgcgttcgccgaactgcttgcgcgcgtacgcacgttgctacgccgtggcagcgtgcaggcgagcgtggatcgcgtacaggtcggcgacctggtactggatctggcgcgccggcgtgcgtcgcgcggcgggcgccgcatcgtgctgacgagcaaggagttctcgctgctcgagctgctcgtgcgccggcgcggcgaagtactgccgcgctcgctgattgcgtcgcaagtctgggacatgaacttcgacagcgacagtaatgtgatcgacgtcgccatccgccgcctgcgcgcgaagatcgacgacgacttcgacaccaagctgatccagacggtgcgcggcatgggctacgtgctggaaggtcccgaggacacggtgtga

SEQ ID NO: 106185 - protein, 228 aa, Ralstonia eutropha JMP134
MKLLVVEDEAKTGEYLRQGLTEAGFVVDLAANGLDGHHLAMSEAYDLIILDVMLPDVDGWRIVQTLRAAGNRVPVLFLTARDSVADRVKGLELGADDYLVKPFAFAELLARVRTLLRRGSVQASVDRVQVGDLVLDLARRRASRGGRRIVLTSKEFSLLELLVRRRGEVLPRSLIASQVWDMNFDSDSNVIDVAIRRLRAKIDDDFDTKLIQTVRGMGYVLEGPEDTV

SEQ ID NO: 106186 - DNA, 678 bp, Ralstonia eutropha JMP134
  CDS (1)..(678): transl_table=11
atgcgcattctgctggtggaagatgaagtcgaactggcgcgctgggttgcccgcgcgctggagcagggcggcttcgtgatcgaacacgtgggcgatggcctgcaggccgaggcgcggcttgtggccgaagagtacgacgtggtcgtgcttgacctgcgcctgcccggcaaggatggcctggccgtgctcaaggccatgcgcgcgcgcgacgaccgcacgccggtgctgatcctgaccgcgcaggacacgctcgacgaacgcgtgcgcggcctgaacctcggcgccgacgactacctgcccaagccgttcgcgattgccgaactggaagcccgcatcctcgcgctgatccgccgcagccgcggccgcgcgcacccgcgcctgcaatgcggcacgctggtgttcgatggggagtcccgcggctttacgctcgacggccagccgctcgcgctgacgccgcgcgaatcgacgctgctcggtgcgctgctcgcacgcagcggccagccgctcaccaaggcccagttgctcgacaaggtgttttcgctcgacgccgatgtcagccccgatgccatcgaggtgctcgtgtaccgcctgcgcaagaaactggccgggcatggcgtgacgatcgtcacgctgcgtggcttcggctacctgctcgagcctgagacaccggccgcctga

SEQ ID NO: 106187 - protein, 225 aa, Ralstonia eutropha JMP134
MRILLVEDEVELARWVARALEQGGFVIEHVGDGLQAEARLVAEEYDVVVLDLRLPGKDGLAVLKAMRARDDRTPVLILTAQDTLDERVRGLNLGADDYLPKPFAIAELEARILALIRRSRGRAHPRLQCGTLVFDGESRGFTLDGQPLALTPRESTLLGALLARSGQPLTKAQLLDKVFSLDADVSPDAIEVLVYRLRKKLAGHGVTIVTLRGFGYLLEPETPAA

SEQ ID NO: 106188 - DNA, 690 bp, Ralstonia eutropha JMP134
  CDS (1)..(690): transl_table=11
atgcgcatcctgattgtcgaagacgagcccaaggcgggcgattacctgctcaaggggctgaccgaatccggctttgtggtcgaccttgcgcgcgacggtgtcgacggtctggcccacgcgcgcgagcagccttatgacctcatcgtgctcgacgtgatgctgcccggcatggacggctggagcgtgctgcgtgaactgcgccgcgaacgcgatacgccggtgctgttcctgaccgcgcgcgatgaactgcaggaccggttgaagggactggagcttggcgccgacgactacatggtcaagccattcgcgtttgccgagctggtcatgcgcatccgcaccatcctgcgccgcgggccgctgcgcgagagcgagttcatcgaagtcgccgatttgcagatcgacgcaatccgccgacgcgtgtcgcgctcgggccagaagatcgacctcacatcgaaggaattcgcgctgctctacctgctcgcgcggcgccgcggcgaggtgctgtcgcgctcgctgatcgcctcgcaggtgtgggacgtgaacttcgacagcaacaccaatgtggtcgatgtctccatccggaggctacgcgcgaaggtcgacgatccgttcgaccacaagctgatccacacgcggcgcggcatgggctacgtgctcgatgatggcgagcccggactgggcgacgcgtga

SEQ ID NO: 106189 - protein, 229 aa, Ralstonia eutropha JMP134
MRILIVEDEPKAGDYLLKGLTESGFVVDLARDGVDGLAHAREQPYDLIVLDVMLPGMDGWSVLRELRRERDTPVLFLTARDELQDRLKGLELGADDYMVKPFAFAELVMRIRTILRRGPLRESEFIEVADLQIDAIRRRVSRSGQKIDLTSKEFALLYLLARRRGEVLSRSLIASQVWDVNFDSNTNVVDVSIRRLRAKVDDPFDHKLIHTRRGMGYVLDDGEPGLGDA

SEQ ID NO: 106190 - DNA, 660 bp, Ralstonia eutropha JMP134
  CDS (1)..(660): transl_table=11
atgagagtccttctcatcgaagatgaaccttggctcggggaggctgtccgcgaccagatcgagaaagacggacatccgaccgacttcgtggccagcatcgccgatgcgcgccgacaccttgcggccgctaactacgacctgatcctgctcgatctgctgcttcccgacggtagggggctcgatttcctgcgagagattcgctcgggtggttcgaccgtgccggtcatcatcttgactgcgctcgatcaggtatcaaaccgcatcgctggcctgaacgccggcgcggatgactatctcgttaagccgttcgacctgtcggagctctccgcacgggtgagcgcggtgtcacgccggtattcgggcaatcccaatcccctggtcacactcggcgaactgcatatcgatacggcggggcgcagcgtgatgcgcggggacgcgcacgttgacctgacggccagtgaatgggcacttctcgaagccctgattcagcgtccggggatgatcgtgtcaaggagccggctggaggatcgcctttattccttcaacgaggagattggcagcaacaccatcgaggtacacatgagccggctacgcaagaagcttggtgccgatgtcatcgagacattgcgtgggctcggctatcggctcaagcgggactga

SEQ ID NO: 106191 - protein, 219 aa, Ralstonia eutropha JMP134
MRVLLIEDEPWLGEAVRDQIEKDGHPTDFVASIADARRHLAAANYDLILLDLLLPDGRGLDFLREIRSGGSTVPVIILTALDQVSNRIAGLNAGADDYLVKPFDLSELSARVSAVSRRYSGNPNPLVTLGELHIDTAGRSVMRGDAHVDLTASEWALLEALIQRPGMIVSRSRLEDRLYSFNEEIGSNTIEVHMSRLRKKLGADVIETLRGLGYRLKRD

SEQ ID NO: 106192 - DNA, 708 bp, Ralstonia eutropha JMP134
  CDS (1)..(708): transl_table=11
atgcgcgtgctgctggtggaagacgatgccatgatcggcgacagcgtgaagcttgcgttgcgccaggaaggctttgcggtggactgggtgcaggatggcgaggcgggccttgccgcgggcacgccaacgggaggctcgggcggtgccgacgaaggcgcgtgctatgacctgatcctgctcgacctcggcttgccgcgccgctcggggcttgacgtgctgcgtgccctgcgcgcgcgcggcgtgtcgacgccggtgctgatcctgaccgcacgtgacgcgattgccgatcgtgtggcgggactcaatgcgggcgccgacgattacctcgtcaagccgttcgacctgcaggagctggccgcgcgcatgcacgcgctcgcgcgccgcgccgaaggaagggccgagccgatcctcagctacggtgccatttcgctgaacccggccacgcgcgaggtcaccctcaatggcgaaccggtgcacctgtccgcgcgtgagttctcgctgctgtcggcgctgatggcgcgcccgggcaaggtctggtcggtcgcgcagttgcaggaacgactgtacagctgggacgacgaggtgggcagcaatacggtcgaggtctacatccacgcgctgcgcaagaagttcggcgccgcgctgatccgcaatatccgcggcgtgggctatgtcatgccccggctcgaagagggaccgggcaactga

SEQ ID NO: 106193 - protein, 235 aa, Ralstonia eutropha JMP134
MRVLLVEDDAMIGDSVKLALRQEGFAVDWVQDGEAGLAAGTPTGGSGGADEGACYDLILLDLGLPRRSGLDVLRALRARGVSTPVLILTARDAIADRVAGLNAGADDYLVKPFDLQELAARMHALARRAEGRAEPILSYGAISLNPATREVTLNGEPVHLSAREFSLLSALMARPGKVWSVAQLQERLYSWDDEVGSNTVEVYIHALRKKFGAALIRNIRGVGYVMPRLEEGPGN

SEQ ID NO: 106194 - DNA, 663 bp, Thiobacillus denitrificans ATCC 25259
  CDS (1)..(663): transl_table=11
atgcgcatactcctggtcgaagacgacgccctgttgggcgacggcctcaaggccgggctctcgcaatcgggctttgccgtcgactggctgcgcgacggcgaggcggcggtcaccgcgctcaccaccgagcgcttcgccgcggtcgtgctcgatctgggcctgccgcggcgcgacggtctgtcggttctgcaatggctgcgtgggcgcggcgacccgacgccggtgctggtcctcaccgcgcgcgaccagctcgaagacaaggtgcgcggcctcgatctcggtgccgacgattacgtgctgaagcccttcgacctcgacgaggtcgcggcgcgcctgcgtgcgctgatgcggcgtgcgcacggcaaatccgccccgcttctcaagctcggcgacatcgaactcgatccggccgcgcgctcggtcacgcagcgcggacagccggtcgacctgaccggccgcgagttcgatctgctgcacgtcctgctgcagagcagcggccacgtgctgacccggcgcatgctcgaagaacagctctatacctgggacgaaggcgtcggcagcaacgcgctcgaggttcatgtccatcacctgcgacgcaagctcggcaacgacgtgatccgcaccgtccgcggcgtcggctacatggcggcgcccccgacgtga

SEQ ID NO: 106195 - protein, 220 aa, Thiobacillus denitrificans ATCC 25259
MRILLVEDDALLGDGLKAGLSQSGFAVDWLRDGEAAVTALTTERFAAVVLDLGLPRRDGLSVLQWLRGRGDPTPVLVLTARDQLEDKVRGLDLGADDYVLKPFDLDEVAARLRALMRRAHGKSAPLLKLGDIELDPAARSVTQRGQPVDLTGREFDLLHVLLQSSGHVLTRRMLEEQLYTWDEGVGSNALEVHVHHLRRKLGNDVIRTVRGVGYMAAPPT

SEQ ID NO: 106196 - DNA, 729 bp, Thiobacillus denitrificans ATCC 25259
  CDS (1)..(729): transl_table=11
gtggcaggatgcgggctcttcccagggttttacgtcatgaaaattctgatcgtcgaagacgagcccaaaacgggcgcttacctcaggcaagggctcaccgaagccggcttcgtcaccgatctcgcccgcgacgggtgggacggactggaactcgccaagtccgggcattacgacctcatgattctcgacgtcatgttgcccggtctcgacggctggcaggtgctcgaaggcgtgcgccgcgctggcatcggtacgccggtgctgttcctgaccgcgcgcgatcgcgtcgaagaccgggtcaaggggctggaactcggcgccgacgactatctcgtgaagcccttcgcctttgccgaactgctcgcccgcgtccacagcctgatgcgccgcgggcaggccgccctcgagtcggccgtgctcaaggcggcggacctcgaactcgatctgctgcgccgccgcgcgacccgcgcgggccgccggatcgatctcacggccaaggaattcgccctgctcgaactgtttcttcgccgtaaaggcgaagtgttgccgcgtagcctgatcgcatcccaggtgtgggacatgaatttcgactcggacaccaatgtcatcgacgtcgcggtgcggcggctgcgcgtcaagatcgacgaaggcttcgacgccaaactcatccacaccgtgcgcggcatgggttacgtgctggagacgagcgcggaaagcgcagcttcatga

SEQ ID NO: 106197 - protein, 242 aa, Thiobacillus denitrificans ATCC 25259
MAGCGLFPGFYVMKILIVEDEPKTGAYLRQGLTEAGFVTDLARDGWDGLELAKSGHYDLMILDVMLPGLDGWQVLEGVRRAGIGTPVLFLTARDRVEDRVKGLELGADDYLVKPFAFAELLARVHSLMRRGQAALESAVLKAADLELDLLRRRATRAGRRIDLTAKEFALLELFLRRKGEVLPRSLIASQVWDMNFDSDTNVIDVAVRRLRVKIDEGFDAKLIHTVRGMGYVLETSAESAAS

SEQ ID NO: 106198 - DNA, 666 bp, Thiobacillus denitrificans ATCC 25259
  CDS (1)..(666): transl_table=11
atgcgggtattgctgatcgaagacgacgacctgatcgcccacggtgtccaggctggcctgggcgcgcggggcctgacggtggatcgggtcgagaccgcggcgcaggcgcgaaccatgctcgcgaccgtgcactaccaactggcgattctcgatctcggtctgcccgacgaggatggcatgagtctgctgcagcgctggcgcgcggcgggcgtcgatctgccggtgctggtgctgaccgcgcgcgacgccgtggaggaccgggtcgccggactgcgcgccggcgcggacgattacctgctcaaacccttcgacctcgacgaactgctcgcccgcctgcaggcgctgctgcgccgcgccgccgggcgcagcgcggatgtcgtcgagcatggcgcgctgcggctcgacctcgagcgcggtgacgtctctctcaacggccgtcccgtcgtgctgacgcggcgcgagctggcgctgctggccgcgctgctgcacgcgcgcggccgcatcctcagcgccgaccagctcaaggacagcctgtacgggttcagcgaggagatcgagagcaacgcactgagcgtgcatatccaccacctgcggcgcaagctcggcgccgacctgatcgagaccgtgcgcggcctcggctaccgcttcaacatgtcagacgcatga

SEQ ID NO: 106199 - protein, 221 aa, Thiobacillus denitrificans ATCC 25259
MRVLLIEDDDLIAHGVQAGLGARGLTVDRVETAAQARTMLATVHYQLAILDLGLPDEDGMSLLQRWRAAGVDLPVLVLTARDAVEDRVAGLRAGADDYLLKPFDLDELLARLQALLRRAAGRSADVVEHGALRLDLERGDVSLNGRPVVLTRRELALLAALLHARGRILSADQLKDSLYGFSEEIESNALSVHIHHLRRKLGADLIETVRGLGYRFNMSDA

SEQ ID NO: 106200 - DNA, 678 bp, Rubrivivax gelatinosus PM1
  CDS (1)..(678)
atgcgcatcctgattgtcgaagacgaccgcctgctcggcgacggcctggccgccggcctgcgctccctgggcttcgccgtcgactggttcaccgacggcgcccaggccgacgccgcactgtcccacaccccctacgacgccatcgtgctcgatctcggcctgccgggccgcgatggcctcgcctggctggcacgctggcgcggcccgggtcccctgcagtcgacgccggtgctggtgctgaccgcccgcgacggcatcgaccaccgcatcgccgggctcgacaccggcgccgacgactacctcatcaagccgatcgagaccaccgaactggccgcgcggctgcgggcggtgctgcggcgcagccagggccggccacagccgctgtggcagcacggcgctctgagctaccagccggcggccaaggccgtgctctggcgcggcaagccggtcgtgctgacggcacgcgaatgcgcgctgctcgaactgctcctggcgaatccgcagcgcgtgctgcccaagtcgctgatcaccgagaagctgtattcgttcgaacaggagatcgagagcaacgcgctcgaagtccacatccaccacctgcgccgcaagatcgatccgaagctggtgcgcacggtacggggcatgggctacgccctcggcccggcagaggacctggcatga

SEQ ID NO: 106201 - protein, 225 aa, Rubrivivax gelatinosus PM1
MRILIVEDDRLLGDGLAAGLRSLGFAVDWFTDGAQADAALSHTPYDAIVLDLGLPGRDGLAWLARWRGPGPLQSTPVLVLTARDGIDHRIAGLDTGADDYLIKPIETTELAARLRAVLRRSQGRPQPLWQHGALSYQPAAKAVLWRGKPVVLTARECALLELLLANPQRVLPKSLITEKLYSFEQEIESNALEVHIHHLRRKIDPKLVRTVRGMGYALGPAEDLA

SEQ ID NO: 106202 - DNA, 684 bp, Rhodospirillum rubrum
  CDS (1)..(684)
atgcgcatcctggtgatcgaggatgacaaggaggtggccgcccaccttctcaaaggcctgcgcgaggccggccatgtcgccgacagcgtggccgatggccgcgacggcctgttccaggccgccggggaagcctatgacctgctgatcgtcgatcgcatgctgcccaatgtcgacggtctgaccatcgtccgcaccctgcgggcttcgggcaaaacggtgccggtgctgatcctctcggcgctcggcgaggtcgacgaccgggtcaaggggctgcgggcggggggcgatgactatctggtcaagcccttcgccttcgccgagcttctggcccgcatcgacgccctgacccggcgcacggcgggaagcgacgccgaacagacgcggttgcgggcgggcgaggtggagatggacctgctggcccgccgggtcacccgtggctcgcgcaccatcgatcttcagccccgcgaattccgcctgcttgaatacctgatgcgccatgccgatcaggtggtcacccgcaccatgcttttggaaaacgtctgggattatcacttcgacccgcagaccaacgtcgttgacgttcatatcagccgcctgcgccgcaagatggacgagggcttcgcccagcccttcctggaaaccgtgcggggggcgggctacgtcttgcgcaccaatggctcttaa

SEQ ID NO: 106203 - protein, 227 aa, Rhodospirillum rubrum
MRILVIEDDKEVAAHLLKGLREAGHVADSVADGRDGLFQAAGEAYDLLIVDRMLPNVDGLTIVRTLRASGKTVPVLILSALGEVDDRVKGLRAGGDDYLVKPFAFAELLARIDALTRRTAGSDAEQTRLRAGEVEMDLLARRVTRGSRTIDLQPREFRLLEYLMRHADQVVTRTMLLENVWDYHFDPQTNVVDVHISRLRRKMDEGFAQPFLETVRGAGYVLRTNGS

SEQ ID NO: 106204 - DNA, 702 bp, Chromohalobacter salexigens DSM 3043
  CDS (1)..(702): transl_table=11
atgcatgtgcttctcgtcgaggacgacgagctcgtggcggccggtatccgcgcagggctggaaagccatgggtgggcggtcgacaccgtcgcctcgatggcagcggcgcgtcatgccctgcaggtcgtggcgagcgatatcgtggtcctcgatcgcggccttcgcgatggcgatgggttgacgctggtcgaggaatggcgcgaggccggcaagcgcgtgccggtgctggtgctgaccgcccgcgatgccatcagcgaccgcatcgcggggctcgatgccggtgccgacgattatctggtcaagcccttcgatctcgacgaactggtggcgcgactgcatgcgttgctgcggcgtgcggccggccgggcccatccgtgtatcgttcatggagcgttgcggttcgatccccaggcgcgccaggtcacctggcgggggcggcccgtcacgctgtcgcggcgggaactggtgctgctggagaccttcctgcagtcgccgggcagcgtgctgagcgcgaatcaactgcgcgatagtctctacggcctcgacgacgaggtggagagcaatgcgctcaacgtccacattcatcatctccgccgcaaagtggctccggccgtgatcgagacggtccggggtctcggataccgtctcggcacgcccgaggccctggcgggaacggaggactcgtcggtggcgtcgcgatga

SEQ ID NO: 106205 - protein, 233 aa, Chromohalobacter salexigens DSM 3043
MHVLLVEDDELVAAGIRAGLESHGWAVDTVASMAAARHALQVVASDIVVLDRGLRDGDGLTLVEEWREAGKRVPVLVLTARDAISDRIAGLDAGADDYLVKPFDLDELVARLHALLRRAAGRAHPCIVHGALRFDPQARQVTWRGRPVTLSRRELVLLETFLQSPGSVLSANQLRDSLYGLDDEVESNALNVHIHHLRRKVAPAVIETVRGLGYRLGTPEALAGTEDSSVASR

SEQ ID NO: 106206 - DNA, 690 bp, Brucella suis
  CDS (1)..(690): transl_table=11
atgcgtatcctgattgttgaagacgacaaggacctgaaccgccagctttccgaagcgatgattgccgcaggttatgtcgttgacagcgcctatgacggcgaagaaggccactatctgggcgatacagaaccttatgatgcggtggtgctggatatcggcctgccgcagatggacggtatcagcgttgtggagcgctggcggcgcagcgggcgcaccatacctgttctcatgctgaccgcgcgcgatcgctggagcgacaaggtggctggcatcgatgcgggtgcggacgactatattacaaagcctttccatattgaagaggttctggcccggctgcgcgccctgatccgccgtgctgccggtcatgcatcgtcagaattcgtctgcgggccgttgcatctcgatacgaagacgtcgaaggcaagtatcgatggcgtggtgctcaagctgacctcgcatgaatatcgcctcctgtcctatatgatgaacaatatggacgaagtggtttcgcgcaccgagcttgtggaacatctttacgatcaggatttcgaccgcgattccaatacgattgaagttttcgtcgggcgcctgcgcaagaaaatgggcgttgatctcatcgagaccgttcgcggcatgggctatcgtatgcgctcgggcggcgagggcgaagcaaaagggagcggcagctga

SEQ ID NO: 106207 - protein, 229 aa, Brucella suis
MRILIVEDDKDLNRQLSEAMIAAGYVVDSAYDGEEGHYLGDTEPYDAVVLDIGLPQMDGISVVERWRRSGRTIPVLMLTARDRWSDKVAGIDAGADDYITKPFHIEEVLARLRALIRRAAGHASSEFVCGPLHLDTKTSKASIDGVVLKLTSHEYRLLSYMMNNMDEVVSRTELVEHLYDQDFDRDSNTIEVFVGRLRKKMGVDLIETVRGMGYRMRSGGEGEAKGSGS

SEQ ID NO: 106208 - DNA, 672 bp, Synechococcus sp
  CDS (1)..(672): transl_table=11
gtgcgtttgctgttgctagaagatgaaccagatctgggtcatgcgctccataaggctttgacccaagaacgctacagcgttgattggctcacgaatggtgatgaggcttgggagatgatccagacctatccctaccgcgctttagtactggattggatggtgccaggttgctcgggcctagagatctgtcagcggctacggcaggctcaggactcaaccccggtgttggtactgacagctcgtgatggtttgcaggatctggtgcagggcttggatgctggtgcagatgactacttagtgaagccgtttcgattggctgaactgttagcccgagtgagggctttgctgcgtcgatcgccccagactcaaacgcctttgctacaggttggcgttcgccttgacccagcgcaggcgacggttcaagtggatgactattcgccgatgccgcttaccgctcgtgagtttcagttgctggaagcgctgatgcatcatcctgggcaaatcctgtctcgcgatcagctcctcgatcaactctggccgatggatgcggaaccgagtagtaatgtcgttgctgctcaagtgcgcttgctacgccggaagctggcaacctatcaggctgacctgttgattgaaactgtctatggctttggctatcgccttcgaccgtcttag

SEQ ID NO: 106209 - protein, 223 aa, Synechococcus sp
MRLLLLEDEPDLGHALHKALTQERYSVDWLTNGDEAWEMIQTYPYRALVLDWMVPGCSGLEICQRLRQAQDSTPVLVLTARDGLQDLVQGLDAGADDYLVKPFRLAELLARVRALLRRSPQTQTPLLQVGVRLDPAQATVQVDDYSPMPLTAREFQLLEALMHHPGQILSRDQLLDQLWPMDAEPSSNVVAAQVRLLRRKLATYQADLLIETVYGFGYRLRPS

SEQ ID NO: 106210 - DNA, 672 bp, Rhizobium leguminosarum
  CDS (1)..(672): transl_table=11
atgcgcatcctggtagtcgaagacgacgttaatctgaaccggcagctggccgacacgctgaaggaggcgggatatgtcgtcgaccaggcgttcgacggcgaggaaggccatttcctcggcgacaccgaaccctatgacgccatcatcctcgatatcggcctgccggagatggacggggtcaccgttcttgaaaaatggcgcggcgccggccgcggcgtgccggtgctgattctcacggcgcgcgaccgatggagcgacaaggtcgccggcatcgatgccggtgccgacgactacgtcaccaagcccttccatgtcgaggaagttctggcgcgcattcgggcgctgatccggcgtgcagccgggcattcctcatctgagatcatctgcgggccggtgcggctcgataccaagtcctcgaaggcgacggtcaacggcacgacgctgaagctgacctcgcacgaatatcgcctgctcgcctatctcatgcatcacatgggcgaggtcgtctcgcgcacggaactggtcgagcatatgtacgaccaggatttcgaccgtgattccaatacgatcgaagtcttcgtcggccgcctgcgcaagaaaatgggcgtcgacctgatcgaaacggtgcgcggtctcggttaccgcatccaagcgccgaaacatgcgaattaa

SEQ ID NO: 106211 - protein, 223 aa, Rhizobium leguminosarum
MRILVVEDDVNLNRQLADTLKEAGYVVDQAFDGEEGHFLGDTEPYDAIILDIGLPEMDGVTVLEKWRGAGRGVPVLILTARDRWSDKVAGIDAGADDYVTKPFHVEEVLARIRALIRRAAGHSSSEIICGPVRLDTKSSKATVNGTTLKLTSHEYRLLAYLMHHMGEVVSRTELVEHMYDQDFDRDSNTIEVFVGRLRKKMGVDLIETVRGLGYRIQAPKHAN

SEQ ID NO: 106212 - DNA, 660 bp, Serratia marcescens
  CDS (1)..(660): transl_table=11
gtgaacatactgttggtggaagacgacctgcaattaggcaaggcgctgtgccgcgcattggagctcaccggctttaatttgtgctgggtgcgcctgctcgcagacgcggaaaataaactttcacccggcgggttcgacctgatgctgttggatctcacgctgccggacggcgacggtttgcaaaagctgatcgcctggcgcgccgccgggcaaaatatccccatcatcatcctgaccgcccgcgaccgcatcgaaagcctggtgaacagcctggattccggcgcggacgactttctggccaaaccctttgcgctgcccgaactcatctcgcgcgtcaaggcggtcaaccggcgcatggcgggcttcgcgtcgcaaacctggagcctcggcacgctgtatctcgatccggtcaaccatcaggtgacgctggataacgaactgctgatgctgtcgaaaaaagagtatcacctgctgcacgaactgatgcgctgtgccggcaccgtggtgcgcaaagcggtgctggaacagcggctgttcggccacggcgacagcgtggaaagcaactcgctggaagtacatatgcataatttacggcgcaagatcggtaaagaaagaattattaccgtacgcggcattggctatttgctgaagaaagagtag

SEQ ID NO: 106213 - protein, 219 aa, Serratia marcescens
MNILLVEDDLQLGKALCRALELTGFNLCWVRLLADAENKLSPGGFDLMLLDLTLPDGDGLQKLIAWRAAGQNIPIIILTARDRIESLVNSLDSGADDFLAKPFALPELISRVKAVNRRMAGFASQTWSLGTLYLDPVNHQVTLDNELLMLSKKEYHLLHELMRCAGTVVRKAVLEQRLFGHGDSVESNSLEVHMHNLRRKIGKERIITVRGIGYLLKKE

SEQ ID NO: 106214 - DNA, 669 bp, Salmonella bongori
  CDS (1)..(669): transl_table=11
atgaagatactgattgttgaagacgacacgctattattacaggggttaatactcgccgcgcaaactgaaggttacgcctgcgatggcgtttcgacagcacgtgctgccgaacatagtctggagtcaggtcattacagtctgatggtgctggatttagggttgcccgatgaggacggcctgcactttctggcacgggtgcgacagaaaaaatatactctgccggtactcattctgaccgcccgcgatacgctcaatgaccgcatcaccgggctggacgtcggcgcggacgattacctggttaaacccttcgccctggaggagttgcacgcccgtatccgcgcgctgctgcgccgccataataatcagggcgaaagtgaactgacagtcggcaaactgacgcttaatatgggacggcaccaggtctggatggacggccaggagctaaccctgacgcctaaagagtacgccctgctgtcacggttgatgctcaaagcgggcagcccggtacaccgggagattctgtataacgatatctacaactgggataacgaaccttcgaccaacactctggaagtgcatattcataacttgcgcgacaaagtcggtaaagcgcgcattcgcacggttcgcgggtttggctacatgctggttgccactgaggaaagctaa

SEQ ID NO: 106215 - protein, 222 aa, Salmonella bongori
MKILIVEDDTLLLQGLILAAQTEGYACDGVSTARAAEHSLESGHYSLMVLDLGLPDEDGLHFLARVRQKKYTLPVLILTARDTLNDRITGLDVGADDYLVKPFALEELHARIRALLRRHNNQGESELTVGKLTLNMGRHQVWMDGQELTLTPKEYALLSRLMLKAGSPVHREILYNDIYNWDNEPSTNTLEVHIHNLRDKVGKARIRTVRGFGYMLVATEES

SEQ ID NO: 106216 - DNA, 669 bp, Salmonella enterica
  CDS (1)..(669): transl_table=11
atgaagattctgattgttgaagacgacacgctattattacaggggttaatactcgccgcgcaaaccgaaggctacgcgtgtgatggcgtttcgacagcgcgtgccgctgagcgcagcctggagtcaggtcattacagtctgatggtgctggatttagggctgcccgatgaagatgggctgcatttcctgacgcgaatgcggcagaaaaaatatactcttccggtactcatcctgaccgcccgcgatacgctcaacgatcgcattaccgggctggatgtcggcgcggatgattatctggttaaacccttcgccctggaagagctgcacgcccgtatccgcgccctgctgcgccgccataacaatcagggtgaaagtgaactggctgtcggcaatctgacgctcaatatgggacggcatcaggcgtggatagaaggacaggaactgactctgacgcccaaggagtatgcgctgctttcacggttgatgctcaaggcgggcagtccggtgcaccgggagattctttataacgatatctacaactgggataacgaaccctcgactaacactctggaagtgcatattcataatttgcgcgacaaagtcggcaaatcgcgcattcgcacggtccgcgggtttggttacatgctggttgccactgaggaaaactaa

SEQ ID NO: 106217 - protein, 222 aa, Salmonella enterica
MKILIVEDDTLLLQGLILAAQTEGYACDGVSTARAAERSLESGHYSLMVLDLGLPDEDGLHFLTRMRQKKYTLPVLILTARDTLNDRITGLDVGADDYLVKPFALEELHARIRALLRRHNNQGESELAVGNLTLNMGRHQAWIEGQELTLTPKEYALLSRLMLKAGSPVHREILYNDIYNWDNEPSTNTLEVHIHNLRDKVGKSRIRTVRGFGYMLVATEEN

SEQ ID NO: 106218 - DNA, 669 bp, Salmonella enterica
  CDS (1)..(669): transl_table=11
atgaagattctgattgttgaagacgacacgctattattacaggggttaatactcgccgcgcaaaccgaaggctatgcgtgtgatggcgtttcgacagcgcgagccgccgagcgcagcctggagtcaggtcattacagcctaatggtgctggatttagggctgcccgatgaggatggcctgcattttctgacgcgaatgcggcagaaaaaatacaccctgccggtactcattctgaccgcccgcgatacgctcaacgaccgcattactgggctggatgtcggcgcggatgattatctggttaaacccttcgccctggaggagttgcacgcccgtatccgcgcactactgcgccgccataataatcagggcgaaagtgaactggcggtcggcaatctgacgctcaatatgggacgacatcaggcgtggatggacggacaggagctgaccctgacgcctaaggagtacgcgctgctctcacggttgatgctcaaggcgggcagtccggtacaccgggagattctttataacgatatctacaactgggataacgagccctcgaccaatactctggaagtgcatattcataatttgcgcgacaaagtcggtaaagcgcgcattcgcacggttcgcgggtttggctacatgctggttgccgctgaggaaagctaa

SEQ ID NO: 106219 - protein, 222 aa, Salmonella enterica
MKILIVEDDTLLLQGLILAAQTEGYACDGVSTARAAERSLESGHYSLMVLDLGLPDEDGLHFLTRMRQKKYTLPVLILTARDTLNDRITGLDVGADDYLVKPFALEELHARIRALLRRHNNQGESELAVGNLTLNMGRHQAWMDGQELTLTPKEYALLSRLMLKAGSPVHREILYNDIYNWDNEPSTNTLEVHIHNLRDKVGKARIRTVRGFGYMLVAAEES

SEQ ID NO: 106220 - DNA, 669 bp, Escherichia coli
  CDS (1)..(669): transl_table=11
atgaaaattctgattgttgaagacgatacgctgttattgcagggattgattctggcggcgcaaaccgaaggctacgcgtgcgatggcgtgacaaccgcgcggatggcggaacaaagccttgaggccggtcattacagcctggtggtactggatttagggttacccgacgaagatggactgcattttctcgcccgtatccggcagaaaaaatacaccctgccggtactgatcctcaccgctcgcgatacgctgaccgacaaaatcgccgggctggatgtcggtgccgatgactatctggtgaagccttttgcgctggaagagttacacgcccgtatccgcgccctgctacgacgccataataatcagggcgaaagtgagctgattgttggcaatctgacgctgaatatgggtcgccgccaggtatggatgagcggagaagaactgattctgacgcccaaagaatatgctctgctgtcgcgcctgatgcttaaagcaggcagcccggtgcatcgggaaattctctacaacgacatctataactgggacaatgaaccctcgaccaacaccctggaagtgcatatccacaatctgcgcgacaaagtgggcaaagcccgtatccgcaccgtgcgcggctttggctatatgctggtcgcaaatgaggaaaactaa

SEQ ID NO: 106221 - protein, 222 aa, Escherichia coli
MKILIVEDDTLLLQGLILAAQTEGYACDGVTTARMAEQSLEAGHYSLVVLDLGLPDEDGLHFLARIRQKKYTLPVLILTARDTLTDKIAGLDVGADDYLVKPFALEELHARIRALLRRHNNQGESELIVGNLTLNMGRRQVWMSGEELILTPKEYALLSRLMLKAGSPVHREILYNDIYNWDNEPSTNTLEVHIHNLRDKVGKARIRTVRGFGYMLVANEEN

SEQ ID NO: 106222 - DNA, 669 bp, Escherichia coli
  CDS (1)..(669): transl_table=11
atgaaaattctgattgttgaagacgatacgctgttattgcagggattgattctggcggcgcaaaccgaaggctacgcgtgcgatggcgtgagcaccgcgcggatggcggaacaaagccttgaggccggtcattacagcctggtggtactggatttaggcttacccgatgaagatgggctgcattttcttgcccgtatccggcagaaaaaatacactctgccagtgttaattctcaccgcccgcgatacccttaccgacaaaatcgccgggctggatgtcggggccgacgattatctggtgaagccttttgcgctggaagagttgcacgcccgtatccgcgccctgctacgacgccataataatcagggcgaaagtgagctgattgttggcaatctgacgctgaatatgggtcgccgtcaggtctggatgggcggtgaagagttgattctgacgcccaaagaatatgctctgctgtcgcgcctgatgcttaaagcaggcagcccggtgcatcgggaaattctctacaacgatatctacaactgggacaacgagccctcgaccaacaccctggaagtgcatatccataacctgcgcgacaaagtgggcaaagcccgtatccgcaccgtgcgcggatttggctatatgctggtcgcaaatgaggaaaactaa

SEQ ID NO: 106223 - protein, 222 aa, Escherichia coli
MKILIVEDDTLLLQGLILAAQTEGYACDGVSTARMAEQSLEAGHYSLVVLDLGLPDEDGLHFLARIRQKKYTLPVLILTARDTLTDKIAGLDVGADDYLVKPFALEELHARIRALLRRHNNQGESELIVGNLTLNMGRRQVWMGGEELILTPKEYALLSRLMLKAGSPVHREILYNDIYNWDNEPSTNTLEVHIHNLRDKVGKARIRTVRGFGYMLVANEEN

SEQ ID NO: 106224 - DNA, 669 bp, Escherichia coli
  CDS (1)..(669): transl_table=11
atgaaaattctgattgttgaagacgatacgctgttattgcagggattgattctggcggcgcaaactgaaggctacgcgtgcgatggcgtgacaaccgcgcggatggcggaacaaagccttgaggccggtcattacagcctggtggtactggatttagggttacccgacgaagatggactgcattttctcgcccgtatccggcagaaaaaatataccctgccggtactgatcctcaccgctcgcgatacgctgaccgacaaaatcgccgggctagatgtcggtgccgatgactatctggtgaagccttttgcgctggaagagttacacgcccgtatccgcgccctgctacgacgccataataatcagggcgaaagtgagctgattgttggcaatctgacgctgaatatgggtcgccgtcaggtatggatgggcggtgaagagttgattctgacgcccaaagaatatgctctgctgtcacggttaatgctcaaagcaggcagtccggtgcatcgggaaattctctacaacgacatctataactgggacaatgaaccctcgaccaacaccctggaagtgcatatccacaatctgcgcgacaaagtgggcaaagcccgtatccccaccgtgcgcggctttggctttatgctggtcgcgaatgaggaaaactaa

SEQ ID NO: 106225 - protein, 222 aa, Escherichia coli
MKILIVEDDTLLLQGLILAAQTEGYACDGVTTARMAEQSLEAGHYSLVVLDLGLPDEDGLHFLARIRQKKYTLPVLILTARDTLTDKIAGLDVGADDYLVKPFALEELHARIRALLRRHNNQGESELIVGNLTLNMGRRQVWMGGEELILTPKEYALLSRLMLKAGSPVHREILYNDIYNWDNEPSTNTLEVHIHNLRDKVGKARIPTVRGFGFMLVANEEN

SEQ ID NO: 106226 - DNA, 669 bp, Escherichia coli
  CDS (1)..(669): transl_table=11
atgaaaattctgattgttgaagacgatacgctgttattgcagggactgattctggcggcgcaaaccgaaggctacgcgtgcgatggcgtgacaaccgcgcggatggcggaacaaagccttgaggcaggtcattacagcctggtggtactggatttagggttacccgacgaagatggactgcattttctcgcccgtatccggcagaaaaaatataccctgccggtactgatcctcaccgctcgcgatacgctgaccgacaaaatcgccgggctggatgtcggtgccgacgactatctggtgaagccttttgcgctggaagagttacatgcccgtatccgcgccctgctacgacgccataataatcagggcgaaagtgagctgattcttggcaatctgacgctgaacatgggtcgccgtcaggtatggatgggcggtgaagagttgattctgacgcccaaagaatatgctctgctgtcacggttaatgctcaaagcaggcagtccggtgcatcgggaaattctctacaacgacatctataactgggacaatgaaccctcgaccaacaccctggaagtgcatatccacaatctgcgcgacaaagtgggcaaagcccgtatccgcaccgtgcgcggctttggctatatgctggtcgcgaatgaggaaaactaa

SEQ ID NO: 106227 - protein, 222 aa, Escherichia coli
MKILIVEDDTLLLQGLILAAQTEGYACDGVTTARMAEQSLEAGHYSLVVLDLGLPDEDGLHFLARIRQKKYTLPVLILTARDTLTDKIAGLDVGADDYLVKPFALEELHARIRALLRRHNNQGESELILGNLTLNMGRRQVWMGGEELILTPKEYALLSRLMLKAGSPVHREILYNDIYNWDNEPSTNTLEVHIHNLRDKVGKARIRTVRGFGYMLVANEEN

SEQ ID NO: 106228 - DNA, 687 bp, uncultured bacterium
  CDS (1)..(687)
atgcgagtgctcgtggttgaagacgatgaaggaatagccgatggcctgcggaccacgcttcgccagcatggcgcggtcgtggatgtggccggaaccgttgcggcggcctgggccgcgctccgctcggaacccttcgacctggtcctcctggaccttggcctgccggacgcggatggtggcaccttgctggcacgcctgcgcgcggcgcctgccgatggcttgcccgagcccaccacccccgtgctgatcatgaccgcccgcgaccaggtggcctcgcgcatcgccggcctcgacatgggcgccgacgactatgtggtcaagcccttcgattcgaatgaactcgcggcgcgcatgagggcgcttcagcgccgttcgcgtgggcgcgcccacccggtgctcagttgtggcgaactggaggtggacaccgctgcccggcaggtgcgccgggccggcgtggtggtcgagctctcggtgcgcgagtacgcgctgctgctcgccctggtcgaagtgcgcccgcgcgtgctgtcgcgcacgcagatcgaagagcgcctctacagtttcgaccaggcactcgacagcaacgcgatcgaggtgcacgtgcaccacctgcgccgcaagctgggcaacgacatcatcaggaccatgcgcggcgtgggctacttcatcccgggcgatggttcgccatga

SEQ ID NO: 106229 - protein, 228 aa, uncultured bacterium
MRVLVVEDDEGIADGLRTTLRQHGAVVDVAGTVAAAWAALRSEPFDLVLLDLGLPDADGGTLLARLRAAPADGLPEPTTPVLIMTARDQVASRIAGLDMGADDYVVKPFDSNELAARMRALQRRSRGRAHPVLSCGELEVDTAARQVRRAGVVVELSVREYALLLALVEVRPRVLSRTQIEERLYSFDQALDSNAIEVHVHHLRRKLGNDIIRTMRGVGYFIPGDGSP

SEQ ID NO: 106230 - DNA, 669 bp, Pectobacterium carotovorum subsp
  CDS (1)..(669): transl_table=11
atgaaattattgattgttgaagacgataagctgctgcaagaaggattattattggcgctgagtcatgaaggctatgcctgcgattgcgcaggcacggccaaagaagcggatgcgctcatcggcagcgcacactacagtctggtgatcctcgatcttggcttgccggacgacgacggcctcgccctactatcccgatggcgtaagaacaattatcagcatcccgtgctcatcttaacggcgcgggataaggtcgacgatcgcgtcagcggattggatgttggcgcagacgattatctcgccaagccttttgcactgacggaattacaggcgcgagtacgcgcgctaattcgccgcaatcaggggtcgagcaacagcaagatacaggtcgacaacattacgttggatttaaacaaccaacaggtgctgctggacgaaaagccggtagtgctgacgccaaaagagtttgcgatactttcccgcctggtgttgaaagccggttatcaggtacaccgagaacttctacatcaggatatttatgcctggaacgacgacccgtcctcgaattcgcttgaggtacatatccacaatctgcgtcaaaagatagggaaagaccggatccgaactctgagaggatttggctacctgctgaccaaaggggaacaaccatga

SEQ ID NO: 106231 - protein, 222 aa, Pectobacterium carotovorum subsp
MKLLIVEDDKLLQEGLLLALSHEGYACDCAGTAKEADALIGSAHYSLVILDLGLPDDDGLALLSRWRKNNYQHPVLILTARDKVDDRVSGLDVGADDYLAKPFALTELQARVRALIRRNQGSSNSKIQVDNITLDLNNQQVLLDEKPVVLTPKEFAILSRLVLKAGYQVHRELLHQDIYAWNDDPSSNSLEVHIHNLRQKIGKDRIRTLRGFGYLLTKGEQP

SEQ ID NO: 106232 - DNA, 684 bp, Xanthomonas campestris pv
  CDS (1)..(684): transl_table=11
gtgaagatattggttgttgaagacgagcccaagacgggggagtacctccggcagggattgaccgaagcgggatacgtttcggaccttgtgcctaacggcgcagacgggctgcatctggctttgcaaggtgagtacgacctggtgatcctggacgtcatgctgccggggttgaatggctggcaggtcttgcagtccctgcgcgaccgtggccttgagatgcccgtcctgttcctgaccgcccgcgaccaagtggaggatcgggtcaaagggctggagcttggggcggatgattaccttggcaagcccttctcgttcgcggagctgctggccagggttcggatcattctgcggcgcggtcatgccggcaacgagggcaccatgctcaaggtggccgatttggagctggatctgttgcgtcgccgtgtctcccgcaacggcaagcgtgttgacttgacagccaaggagtttggcttgctggagctgctgatgcgccgccatggtgaagtgctgccacgctccctgatcgcctcgcaggtctgggacatgaactttgacagcgacaccaatgtcatcgaagtggcgatgcgccgcttgcgcgtgaagatagatgaggggcatgccgtcaagctcatccagaccgtgcggggcatgggctacgtgctggacgtaccagaggaggaataa

SEQ ID NO: 106233 - protein, 227 aa, Xanthomonas campestris pv
MKILVVEDEPKTGEYLRQGLTEAGYVSDLVPNGADGLHLALQGEYDLVILDVMLPGLNGWQVLQSLRDRGLEMPVLFLTARDQVEDRVKGLELGADDYLGKPFSFAELLARVRIILRRGHAGNEGTMLKVADLELDLLRRRVSRNGKRVDLTAKEFGLLELLMRRHGEVLPRSLIASQVWDMNFDSDTNVIEVAMRRLRVKIDEGHAVKLIQTVRGMGYVLDVPEEE

SEQ ID NO: 106234 - DNA, 672 bp, Bordetella avium
  CDS (1)..(672)
atgcgcattttgctagtcgaggacaatcccgacctaggcgatgccgtggagagcaagctgcgcaacgccgggcatagcgtccaatgggtgcgcgacgggttggcggctgttcaatggggccaggctgaaccctgggatgcgctgttgctggatatttcactgccgggcaaggacggtgatgcggtgttgcgtgagttgcgagcggcgggtatggagtcgccggtgctggtgatgaccgcgcgcgccgagatcgaggacaaggtcgatatgctggacctcggcgccgatgactatctggtcaaaccttttgatctacgcgagctcgaggcaaggctgcgggccttgatgcggcgtcccggcggccagacctccagcgtggccatgttcggcaatctgacgctggatagcgcgaaccggggtgtatgggtcaacggtcagccgctggaattgggccgccgcgagttccgcttgctggagattttgctgacacggcagggacagacggtggccaaagagcgcttgatggctcaggtgtttgatgccgacgacgtttcgctcaatgcgctggaactgctgatttcgcgcttgcgtagaaaactggcggatgcttcggttgacatcgtcaccgtgcgtggggtgggttatcaggtgcgtcaagatggcgcggcatga

SEQ ID NO: 106235 - protein, 223 aa, Bordetella avium
MRILLVEDNPDLGDAVESKLRNAGHSVQWVRDGLAAVQWGQAEPWDALLLDISLPGKDGDAVLRELRAAGMESPVLVMTARAEIEDKVDMLDLGADDYLVKPFDLRELEARLRALMRRPGGQTSSVAMFGNLTLDSANRGVWVNGQPLELGRREFRLLEILLTRQGQTVAKERLMAQVFDADDVSLNALELLISRLRRKLADASVDIVTVRGVGYQVRQDGAA

SEQ ID NO: 106236 - DNA, 669 bp, Neisseria cinerea
  CDS (1)..(669): transl_table=11
atgcgtgttttgctggttgaagatgatgcgatgattgcggaagcggtgtcggcaaatttgaaagacggcggttatgcagtggattgggtcaaaaacggcgcgcaggttgcggcggcggccgctgcccagccttatgacctgatgctgctggatttgggtttgccggggcgcgatggtttggatgttttgtcggaaatacgcgcggcaggctgtaccgtccccgtgttgattgtgacggcgcgggatgatttgtacagccggctgaacggtttggacggcggtgcggacgactatatcgtcaagccgttcgatatggcggagcttaaggcgcggatgcgggcggtgttgaggcgcgggagcggtcaggcgcaggcgtgtctgtcaaatggtgcgttatccctcaatcctgcaacgtatcaggtagaaattattgccgagaggcggcaggtggcattgagcaacaaggagtttgcagtattgcaggctttgttggcgaggccgggtgtcattctgtcgcgttcggatttggaagataagatttacggctggggcgcggaagtagaaagcaatgcggtagatttcctgattcatgcgctgcgcaagaaactgggtaaggaaaatatccaaaatgtacgcggtgtcggttggcttgtgccgggtgccgtttga

SEQ ID NO: 106237 - protein, 222 aa, Neisseria cinerea
MRVLLVEDDAMIAEAVSANLKDGGYAVDWVKNGAQVAAAAAAQPYDLMLLDLGLPGRDGLDVLSEIRAAGCTVPVLIVTARDDLYSRLNGLDGGADDYIVKPFDMAELKARMRAVLRRGSGQAQACLSNGALSLNPATYQVEIIAERRQVALSNKEFAVLQALLARPGVILSRSDLEDKIYGWGAEVESNAVDFLIHALRKKLGKENIQNVRGVGWLVPGAV

SEQ ID NO: 106238 - DNA, 684 bp, Pseudomonas sp
  CDS (1)..(684): transl_table=11
atgcacgtactggtttgcgaagacgatgagttgatcgccagcggcattgtcgccggcctcaccgctcagggcctgacggtagagcatgtcgccactgcctcgtcggcccgggcgatgctcaaggtcgccgagttcgatgtgatggtgctcgacctcggtctgcccgatgaagatggcctgaagctgttgcagcaattgcgtcacagcggtctggaaatcccggtgctgatcctcaccgcccgggattcagtcaccgaccgcgtcgacggcttgcaggcgggcgccgacgattacttgctcaagcctttcgacctgcgcgaactcgccgcgcgcctgcataccttgctgcgacgagtggccggacgcagcgtcaacttgatcgaacatggtcgcctgacttacgacccgagcagccgcgaaaccatgcttggcggccagccggtggacctttcccgtcgtgagcagtcgttgttgcaggccttgctgcataatcggggccgggtgctgtccaccgagcaactcaaagacagcgtctacggtttcaacgatgaactggaaagcaacgccctcaacgtgcatatccatcacctgcgacgcaaactcggcaatggcattgtcgagacggtgcgcggcctgggctatcgcctggggccggctgatggtgcagaggaattgaaaaagtga

SEQ ID NO: 106239 - protein, 227 aa, Pseudomonas sp
MHVLVCEDDELIASGIVAGLTAQGLTVEHVATASSARAMLKVAEFDVMVLDLGLPDEDGLKLLQQLRHSGLEIPVLILTARDSVTDRVDGLQAGADDYLLKPFDLRELAARLHTLLRRVAGRSVNLIEHGRLTYDPSSRETMLGGQPVDLSRREQSLLQALLHNRGRVLSTEQLKDSVYGFNDELESNALNVHIHHLRRKLGNGIVETVRGLGYRLGPADGAEELKK

SEQ ID NO: 106240 - DNA, 669 bp, Escherichia coli
  CDS (1)..(669): transl_table=11
atgaaaattctgattgttgaagacgatacgctgttattgcagggactgattctggcggcgcaaaccgaaggctacgcgtgcgatagcgtgacaaccgcgcggatggcggaacaaagccttgaggcaggtcattacagcctggtggtactggatttagggttacccgacgaagatggactgcattttctcgcccgtatccggcagaaaaaatataccctgccggtactgatcctcaccgctcgcgatacgctgaccgacaaaatcgccgggctggatgtcggtgccgacgactatctggtgaagccttttgcgctggaagagttacatgcccgtatccgcgccctgctacgacgccataataatcagggcgaaagtgagctgattgttggcaatctgacgctgaacatgggtcgccgtcaggtatggatgggcggtgaagagttgattctgacgcccaaagaatatgctctgctgtcacggttaatgctcaaagcaggcagtccggtgcatcgggaaattctctacaacgacatctataactgggacaatgaaccctcgaccaacaccctggaagtgcatatccacaatctgcgcgacaaagtgggcaaagcccgtatccgcaccgtgcgcggctttggctatatgctggtcgcgaatgaggaaaactaa

SEQ ID NO: 106241 - protein, 222 aa, Escherichia coli
MKILIVEDDTLLLQGLILAAQTEGYACDSVTTARMAEQSLEAGHYSLVVLDLGLPDEDGLHFLARIRQKKYTLPVLILTARDTLTDKIAGLDVGADDYLVKPFALEELHARIRALLRRHNNQGESELIVGNLTLNMGRRQVWMGGEELILTPKEYALLSRLMLKAGSPVHREILYNDIYNWDNEPSTNTLEVHIHNLRDKVGKARIRTVRGFGYMLVANEEN

SEQ ID NO: 106242 - DNA, 669 bp, Salmonella typhimurium
  CDS (1)..(669): transl_table=11
atgaagatactgattgttgaagacgacacgctattattacaggggttaatactcgccgcgcaaaccgaaggctatgcgtgtgatggcgtttcgacagcgcgtgccgccgagcatagtctggagtctggtcattacagtctgatggtgctggatttagggctgcccgatgaggatggcctgcatttcctgacgcgaatccgacagaaaaaatataccctgccggtactcattctgaccgcccacgatacgctcaatgaccgcattaccgggctggatgtcggcgcagatgattatctggttaaacccttcgccctggaggagctgcacgcccgcatccgcgcgctgctgcgccgccataataaccagggtgaaagtgaactgacggttggcaatctgacgctcaatataggccgccatcaggcatggagggatggacaggaactgaccctgacgcctaaggagtacgcgttgctctcacggttgatgctcaaggcaggcagtccggtgcaccgggaaattctttataacgatatctacaactgggataacgaaccctcgaccaacactctggaagtgcatatacataatttgcgcgacaaagtcggcaagtcgcgcattcgcacggttcgcgggtttggctacatgctggttgccactgaggaaagctaa

SEQ ID NO: 106243 - protein, 222 aa, Salmonella typhimurium
MKILIVEDDTLLLQGLILAAQTEGYACDGVSTARAAEHSLESGHYSLMVLDLGLPDEDGLHFLTRIRQKKYTLPVLILTAHDTLNDRITGLDVGADDYLVKPFALEELHARIRALLRRHNNQGESELTVGNLTLNIGRHQAWRDGQELTLTPKEYALLSRLMLKAGSPVHREILYNDIYNWDNEPSTNTLEVHIHNLRDKVGKSRIRTVRGFGYMLVATEES

SEQ ID NO: 106244 - DNA, 684 bp, Pseudomonas syringae pv
  CDS (1)..(684): transl_table=11
atgaaactgctggtagccgaagacgaacctaaaactggaatctatctgcagcaaggcctgcgggaggccggcttcaacgtggaccgcgtggtcacaggcacagatgccgttgaccaggcgctcaatgaagcctatgacctgttgattctcgacgtgatgatgccaggccttgatggctgggaagtcatcagacgccttcgcaccgctggccagcccgtaccggtgctgtttctgaccgcacgggacggggtagacgaccgggtcaagggcctggagctgggcgccgatgattatctggtcaagccgtttgccctttcagaactgctggcacgggtgcgaacgctgttacggcgcggcagcagcctgcaggttcaaacgagcctgcaaatcggagaccttcaggtggatttgctcaagcgtcgggcgactcggggcggcaagcgaatcgagcttacggccaaagagtttgcactgctggaactgctgatgcgccggcagggtgaagtgctgtccaaatcgctgatcgcctcccaggtctgggacatgaatttcgacagcgacacaaatgttatcgaggtggcgatacgacggttgagggccaagattgacgatgacttcgaggtaaaactgctgcatacctgccggggaatgggttacatgctagaggcgcaggacgaaggatga

SEQ ID NO: 106245 - protein, 227 aa, Pseudomonas syringae pv
MKLLVAEDEPKTGIYLQQGLREAGFNVDRVVTGTDAVDQALNEAYDLLILDVMMPGLDGWEVIRRLRTAGQPVPVLFLTARDGVDDRVKGLELGADDYLVKPFALSELLARVRTLLRRGSSLQVQTSLQIGDLQVDLLKRRATRGGKRIELTAKEFALLELLMRRQGEVLSKSLIASQVWDMNFDSDTNVIEVAIRRLRAKIDDDFEVKLLHTCRGMGYMLEAQDEG

SEQ ID NO: 106246 - DNA, 684 bp, Escherichia coli
  CDS (1)..(684): transl_table=11
atgaaactgttgattgtcgaagatgaaaagaaaaccggagaatacttgaccaaagggttaaccgaagccggttttgtggtcgatttggccgacaacgggctgaatggctaccatctggcgatgaccggagattatgacctgataatcctcgatattatgctgccggacgtgaacggctgggatatcgtgcgcatgttgcgctccgccaataaagggatgccgattctgttgcttaccgcgcttggcaccattgaacatcgcgtcaaggggctggagttgggggccgatgactatctggtgaagccgttcgcgtttgctgaactgctggcgcgggtgcgcactctcctgcggcgcggggcggcggtgattatcgaaagtcagtttcaggttgccgatttgatggtcgatctcgtcagccgcaaagtcacccgcagcggcacgcgcatcactctgaccagtaaagagtttactctgctggagttttttctccgccatcagggcgaagtgctgccccgctcgcttatcgcctcgcaggtatgggacatgaattttgacagcgacactaacgccattgatgtggcggtgaagcggctacgcggcaaaatcgacaacgactttgagccgaagctgattcaaaccgtgcgcggcgtgggttacatgcttgaggtgccggatggtcagtaa

SEQ ID NO: 106247 - protein, 227 aa, Escherichia coli
MKLLIVEDEKKTGEYLTKGLTEAGFVVDLADNGLNGYHLAMTGDYDLIILDIMLPDVNGWDIVRMLRSANKGMPILLLTALGTIEHRVKGLELGADDYLVKPFAFAELLARVRTLLRRGAAVIIESQFQVADLMVDLVSRKVTRSGTRITLTSKEFTLLEFFLRHQGEVLPRSLIASQVWDMNFDSDTNAIDVAVKRLRGKIDNDFEPKLIQTVRGVGYMLEVPDGQ

SEQ ID NO: 106248 - DNA, 690 bp, Burkholderia pseudomallei
  CDS (1)..(690): transl_table=11
atgcgaatactgatcgtggaagacgagccgaagaccggcatgtatctgcgcaaggggctgaccgaagcgggcttcatcgcggactgggtcgaggacggcgtgacgggcctgcatcaggccgaaaccgaggagtacgacctgatcatcctcgacgtgatgctgcccggccacgacggctggacggtgctcgagcggctgcgccgcgcgcactcgacgcccgtgctgttcctgaccgcgcgcgacgacgtcggcgaccgcgtgaaggggctcgagctcggcgcggacgattacgtcgtcaagccgttcgatttcgtcgagctggtcgcgcgcgtgcgctcgatcctgcgccgcgggcaggcgcgcgaatcgacggtcctgcggatcgccgatctggagctcgacctgacgcggcgcaaggccacgcgccagggcgacgtcgtgctgctgaccgcgaaggaattcgcgctgctgtggctgctgatgcgccgcgagggcgagatcctgccgcgcgcgacgatcgcctcgcaggtgtgggacatgaatttcaacagcgacacgaacgtcgtcgacgcggcgatccgccggctgcgctcgaagatcgacgacgcgtacgagccgaagctgatccacacggtgcgcgggatgggctacgtgctcgaagtcagaagcgcgagcgcgccgagccgatga

SEQ ID NO: 106249 - protein, 229 aa, Burkholderia pseudomallei
MRILIVEDEPKTGMYLRKGLTEAGFIADWVEDGVTGLHQAETEEYDLIILDVMLPGHDGWTVLERLRRAHSTPVLFLTARDDVGDRVKGLELGADDYVVKPFDFVELVARVRSILRRGQARESTVLRIADLELDLTRRKATRQGDVVLLTAKEFALLWLLMRREGEILPRATIASQVWDMNFNSDTNVVDAAIRRLRSKIDDAYEPKLIHTVRGMGYVLEVRSASAPSR

SEQ ID NO: 106250 - DNA, 681 bp, Escherichia coli
  CDS (1)..(681): transl_table=11
atgcagcgtattttaatcgttgaagacgaacaaaaaacaggtcgttacctgcagcagggactggttgaggaaggctatcaggccgatctctttaataatggccgcgatggtctcggggccgcgtcgaagggacagtatgatttgataatactggacgtgatgctgcctttcctcgacgggtggcaaatcatcagcgcactgagggagtccgggcacgaagaaccggtcctgtttttaaccgcaaaggacaacgtgcgggacaaagtgaaaggactggagcttggcgcagatgactacctgattaagccctttgattttacggagctggttgcacgtgtaagaaccctactgcgccgggcacgctcgcaggccgcaacagtctgcaccatcgccgatatgaccgttgatatggtgcgccggaccgtgatccgttcggggaagaagatccatctcaccggtaaagaatacgttctgcttgagttgctgctgcaacgcaccggagaagtgttacccaggagtcttatctcgtccctggtctggaacatgaattttgacagtgatacgaatgtgattgatgtcgccgtgagacgtctgagaagtaaaattgatgatgactttgagccaaaactgatccataccgttcgcggtgccggatatgtcctggagatcagagaagagtga

SEQ ID NO: 106251 - protein, 226 aa, Escherichia coli
MQRILIVEDEQKTGRYLQQGLVEEGYQADLFNNGRDGLGAASKGQYDLIILDVMLPFLDGWQIISALRESGHEEPVLFLTAKDNVRDKVKGLELGADDYLIKPFDFTELVARVRTLLRRARSQAATVCTIADMTVDMVRRTVIRSGKKIHLTGKEYVLLELLLQRTGEVLPRSLISSLVWNMNFDSDTNVIDVAVRRLRSKIDDDFEPKLIHTVRGAGYVLEIREE

SEQ ID NO: 106252 - DNA, 666 bp, Haemophilus influenzae
  CDS (1)..(666): transl_table=11
atgagaattttattgatagaagacgataatctaatcggcaatgggttgcagattggtttaaccaaacttggttttgcggtggattggtttactgatggaaaaacaggaatggctgctttaacctctgcgccttatgatgcggtggtattggatttaaccttgcctaaacttgatggattagaggtattgcaacaatggcgatctaatcatcaagatgttcccgtattaattttgactgctcgcgatactttagatgaacgagttaaaggtttacaaagtggtgcagatgattatctttgcaagccttttgctttggctgaagtcgccgcacgtttacaagcccttattcgtcgtcgttatggatatcatcattctgtgatagaacaggctggtgttaagctcgatcagaatcaacgttctgtttggctgaataatcaacccatttctttaacaagccgtgaatataaattgcttgaattatttatgctgaataaagatcgcgtattgtctcgctcatccattgaagaaaaattatccagttgggatgaagaaattagtagtggcgcattggatgtgcatatttataatttacgccaaaaattggggaagcaatttattcgaacagtacacggtgttggatatgctttgggacaagttgaaaaatga

SEQ ID NO: 106253 - protein, 221 aa, Haemophilus influenzae
MRILLIEDDNLIGNGLQIGLTKLGFAVDWFTDGKTGMAALTSAPYDAVVLDLTLPKLDGLEVLQQWRSNHQDVPVLILTARDTLDERVKGLQSGADDYLCKPFALAEVAARLQALIRRRYGYHHSVIEQAGVKLDQNQRSVWLNNQPISLTSREYKLLELFMLNKDRVLSRSSIEEKLSSWDEEISSGALDVHIYNLRQKLGKQFIRTVHGVGYALGQVEK

SEQ ID NO: 106254 - DNA, 660 bp, Salmonella typhi
  CDS (1)..(660): transl_table=11
atgcgaattttactggtagaagatgacacacttattggcgatggcataaaagcaggtctgagtaaaatgggtttcagcgtcgactggtttaccgagggacgtccgggcaaagaggcgctttacagcgcgccttatgatgcggtcattttagatttaacgctgccaggaatggacggacgggatattttgcgcgaatggcgcgaaaagggtaaacaggaaccagtactgatcctgacggcgcgcgacgcgttagcagagcgcgtcgaggggctacgtctgggcgccgatgactatttatgtaaacctttcgcgctcattgaggtcgccgcccgtctggaggcgctggtacgccgcgccagcggtcaggccagtagcgaattgcgccacggccaggtgacgctcaatccaggcaatctcgtcgcgacgcttgccggcgaaccgctggccctaaaaccaaaagagttcgcgttgctggaactcttactgcgcaacaaaggtcgcgtgctaccgcgcaagcttattgaagagaagctgtataactgggatgacgacgtgtccagcaatgcagtggaagtccatgttcatcatttacgccgcaagctcggcagcgaatttattcgcaccgtacacggcatcggctacaccctgggtgacgcatga

SEQ ID NO: 106255 - protein, 219 aa, Salmonella typhi
MRILLVEDDTLIGDGIKAGLSKMGFSVDWFTEGRPGKEALYSAPYDAVILDLTLPGMDGRDILREWREKGKQEPVLILTARDALAERVEGLRLGADDYLCKPFALIEVAARLEALVRRASGQASSELRHGQVTLNPGNLVATLAGEPLALKPKEFALLELLLRNKGRVLPRKLIEEKLYNWDDDVSSNAVEVHVHHLRRKLGSEFIRTVHGIGYTLGDA

SEQ ID NO: 106256 - DNA, 660 bp, Serratia marcescens
  CDS (1)..(660): transl_table=11
gtgaacatattgttggtggaagacgacctgcaattaggcaaggcgctgtgccgcgcattggagctggccggctttaatttgtgctgggtgcgcctgatcgccgacgcggaaaataaactttcatccggcggattcgatctgatgctgctggatctcacgctgccggacggcgacggtttgcagaagctgatcgcctggcgcgccgccgggcaaaatatcccgatcatcatcctgaccgcccgcgaccgcattgaaagcctggtgaacagcctggactccggcgcgaacgactttctggccaaaccctttgcgctgcccgaactcatctcgcgcgtcaaggctgtcaaccggcgcatggcgggcttcgcgtcacaaacctggagcctcggcgcgctgtatctcgatccggtcaaccatcaggtcatgctggataacgaattgctgatgctgtcgaaaaaagagtatcacctgctgcacgaactgatgcgttgcgccggcaccgtggtgcgcaaagcggtgttggaacagcggctgttcggccacggcgatagcgtggaaagcaactcgctggaagtgcacatgcataatttacgacgcaagatcggtaaagacagagtgattaccgtacgcggcattggctatttgctgaagaaagagtag

SEQ ID NO: 106257 - protein, 219 aa, Serratia marcescens
MNILLVEDDLQLGKALCRALELAGFNLCWVRLIADAENKLSSGGFDLMLLDLTLPDGDGLQKLIAWRAAGQNIPIIILTARDRIESLVNSLDSGANDFLAKPFALPELISRVKAVNRRMAGFASQTWSLGALYLDPVNHQVMLDNELLMLSKKEYHLLHELMRCAGTVVRKAVLEQRLFGHGDSVESNSLEVHMHNLRRKIGKDRVITVRGIGYLLKKE

SEQ ID NO: 106258 - DNA, 687 bp, Salmonella typhimurium
  CDS (1)..(687): transl_table=11
atgaaaatattaatcgttgaagacgacattaaaacaggtgaatatctcagcaaggggctgacagaggcggggttcgtcgtggatcacgctgataatggtctgaccggatatcatcttgccatgacagccgagtatgatttagtcatcctggatatcatgctgcctgatgtaaacggctgggatatcatccgtatgctgcgcagtgccggaaaggggatgccggtattactgctgacggcccttggcacgattgaacacagggtcaaaggacttgagctgggtgcggacgattatctggtgaagccctttgcgtttgctgaactgctcgcccgggtaagaaccctcctcaggcggggaaacacgatgatcacggaaagccagcttaaagtggctgacctctcggttgatctcgtatccagaaaagtcagccgcgccgggaaccgcattgtgctcaccagtaaagagttcagcttgctggaattcttcattcgccatcagggagaagttcttccccgctccctgattgccttcttcatggtctgggtacatgaatttttgacagctgacactaacgcgattgatgtcgcagtaaagcgactccgggctaaaatagacaacgattacgggacaaaactgaaccagacagtgcggggcgtgggctacatgctggagatcccggatgcatag

SEQ ID NO: 106259 - protein, 228 aa, Salmonella typhimurium
MKILIVEDDIKTGEYLSKGLTEAGFVVDHADNGLTGYHLAMTAEYDLVILDIMLPDVNGWDIIRMLRSAGKGMPVLLLTALGTIEHRVKGLELGADDYLVKPFAFAELLARVRTLLRRGNTMITESQLKVADLSVDLVSRKVSRAGNRIVLTSKEFSLLEFFIRHQGEVLPRSLIAFFMVWVHEFLTADTNAIDVAVKRLRAKIDNDYGTKLNQTVRGVGYMLEIPDA

SEQ ID NO: 106260 - DNA, 675 bp, Salmonella typhimurium
  CDS (1)..(675): transl_table=11
atgcgtctcttattggcagaagataaccgtgagctggctcactggctggagaaagcgctggtgcaaaacggctttgccgtggactgcgtatttgacggcctggcggctgaccatcttctgcacagtgaaatgtacgcgctggcggtgctggatatcaatatgccgggaatggatggactggaggtggtgcaacggctgcgtaaacgcggtcagaccttgcccgttttgctgctcacggcgcgaagcgcggtggcggatcgcgtaaaaggtctcaacgtcggcgcggatgactatctgccgaaaccctttgaactggaagagctggatgcccgtttacgggccttgctccgacgcagcgctgggcaggttcatgaagttcagcaactgggggaattgatctttcatgatgaagggtattttctgttacaggggcagccgttagcgctgacgccgcgtgagcaggcgctcttaaccgtattgatgtaccgacgaacgcgaccagtttcgcgtcagcagctttttgaacaggtgttcagcctgaacgatgaggtaagccctgaaagcattgaactttatattcatcgactgcgtaaaaaacttcagggaagcgatgtacgaattacgacgctgcgcggcctgggttatgtgctggagcgcggcgatgaagtgggttaa

SEQ ID NO: 106261 - protein, 224 aa, Salmonella typhimurium
MRLLLAEDNRELAHWLEKALVQNGFAVDCVFDGLAADHLLHSEMYALAVLDINMPGMDGLEVVQRLRKRGQTLPVLLLTARSAVADRVKGLNVGADDYLPKPFELEELDARLRALLRRSAGQVHEVQQLGELIFHDEGYFLLQGQPLALTPREQALLTVLMYRRTRPVSRQQLFEQVFSLNDEVSPESIELYIHRLRKKLQGSDVRITTLRGLGYVLERGDEVG

SEQ ID NO: 106262 - DNA, 26 bp, Artificial sequence
  primer
atgcgaattttactgatagaagatga

SEQ ID NO: 106263 - DNA, 28 bp, Artificial sequence
  primer
ttatttctcacctaatgtgtaaccaata

SEQ ID NO: 106264 - protein, 270 aa, Artificial sequence
  Variant (10)..(11): xaa in position 10 to 11 is any amino acid
  Variant (13)..(15): xaa in position 13 to 15 is any amino acid
  Variant (17)..(19): xaa in position 17 to 19 is any amino acid
  Variant (21)..(23): xaa in position 21 to 23 is any amino acid
  Variant (24)..(24): xaa in position 24 is any or no amino acid
  Variant (27)..(27): xaa in position 27 is any amino acid
  Variant (30)..(33): xaa in position 30 to 33 is any amino acid
  Variant (35)..(36): xaa in position 35 to 36 is any amino acid
  Variant (38)..(45): xaa in position 38 to 45 is any amino acid
  Variant (46)..(55): xaa in position 46 to 55 is any or no amino acid
  Variant (57)..(58): xaa in position 57 to 58 is any amino acid
  Variant (64)..(64): xaa in position 64 is any amino acid
  Variant (67)..(69): xaa in position 67 to 69 is any amino acid
  Variant (71)..(72): xaa in position 71 to 72 is any amino acid
  Variant (75)..(77): xaa in position 75 to 77 is any amino acid
  Variant (79)..(83): xaa in position 79 to 83 is any amino acid
  Variant (84)..(90): xaa in position 84 to 90 is any or no amino acid
  Variant (99)..(100): xaa in position 99 to 100 is any amino acid
  Variant (102)..(102): xaa in position 102 is any amino acid
  Variant (106)..(106): xaa in position 106 is any amino acid
  Variant (109)..(110): xaa in position 109 to 110 is any amino acid
  Variant (117)..(117): xaa in position 117 is any amino acid
  Variant (121)..(123): xaa in position 121 to 123 is any amino acid
  Variant (126)..(126): xaa in position 126 is any amino acid
  Variant (130)..(131): xaa in position 130 to 131 is any amino acid
  Variant (136)..(142): xaa in position 136 to 142 is any amino acid
  Variant (143)..(151): xaa in position 143 to 151 is any or no amino acid
  Variant (153)..(154): xaa in position 153 to 154 is any amino acid
  Variant (156)..(156): xaa in position 156 is any amino acid
  Variant (158)..(171): xaa in position 158 to 171 is any amino acid
  Variant (172)..(194): xaa in position 172 to 194 is any or no amino acid
  Variant (196)..(196): xaa in position 196 is any amino acid
  Variant (199)..(200): xaa in position 199 to 200 is any amino acid
  Variant (202)..(203): xaa in position 202 to 203 is any amino acid
  Variant (206)..(207): xaa in position 206 to 207 is any amino acid
  Variant (210)..(214): xaa in position 210 to 214 is any amino acid
  Variant (217)..(217): xaa in position 217 is any amino acid
  Variant (219)..(220): xaa in position 219 to 220 is any amino acid
  Variant (222)..(224): xaa in position 222 to 224 is any amino acid
  Variant (227)..(233): xaa in position 227 to 233 is any amino acid
  Variant (234)..(236): xaa in position 234 to 236 is any or no amino acid
  Variant (238)..(238): xaa in position 238 is any amino acid
  Variant (242)..(242): xaa in position 242 is any amino acid
  Variant (244)..(245): xaa in position 244 to 245 is any amino acid
  Variant (248)..(248): xaa in position 248 is any amino acid
  Variant (251)..(254): xaa in position 251 to 254 is any amino acid
  Variant (255)..(259): xaa in position 255 to 259 is any or no amino acid
  Variant (261)..(261): xaa in position 261 is any amino acid
  Variant (266)..(266): xaa in position 266 is any amino acid
  Variant (269)..(269): xaa in position 269 is any amino acid
MRILLVEDDXXLXXXLXXXLXXXXGYXVDXXXXGXXAXXXXXXXXXXXXXXXXXXYXXVILDLXLPXXXGXXVLXXXRXXXXXXXXXXXXPVLILTARXXVXDRVXGLXXGADDYLXKPFXXXELXARVXXLLRRXXXXXXXXXXXXXXXXLXXGXLXXXXXXXXXXXXXXXXXXXXXXXXXXXXXXXXXXXXXLXLTXXEXXLLXXLMXXXXXVLXRXXLXXXLYXXXXXXXXXXNXIEVXIXXLRXKLXXXXXXXXXIXTVRGXGYXL

SEQ ID NO: 106265 - protein, 36 aa, Artificial sequence
  Variant (2)..(2): xaa in position 2 is His, Lys or Arg
  Variant (3)..(3): xaa in position 3 is Ile, Leu or Val
  Variant (5)..(5): xaa in position 5 is Ile, Leu or Val
  Variant (6)..(6): xaa in position 6 is Ala, Ile, Leu or Val
  Variant (9)..(15): xaa in position 9 to 15 is any amino acid
  Variant (16)..(19): xaa in position 16 to 19 is any or no amino acid
  Variant (21)..(27): xaa in position 21 to 27 is any amino acid
  Variant (28)..(28): xaa in position 28 is Ala, Asp, Glu, Gly, Asn, Gln, Ser or Thr
  Variant (29)..(35): xaa in position 29 to 35 is any amino acid
  Variant (36)..(36): xaa in position 36 is Ala, Asp, Gly, Asn, Ser, Thr or Val
MXXLXXEDXXXXXXXXXXXLXXXXXXXXXXXXXXXX

SEQ ID NO: 106266 - protein, 20 aa, Artificial sequence
  Variant (2)..(3): xaa in position 2 to 3 is any or no amino acid
  Variant (5)..(5): xaa in position 5 is Ile, Leu or Val
  Variant (6)..(6): xaa in position 6 is any amino acid
  Variant (9)..(10): xaa in position 9 to 10 is any amino acid
  Variant (11)..(11): xaa in position 11 is Asp, Glu, Asn, Pro or Ser
  Variant (13)..(19): xaa in position 13 to 19 is any amino acid
LXXDXXLPXXXGXXXXXXXR

SEQ ID NO: 106267 - protein, 47 aa, Artificial sequence
  Variant (2)..(3): xaa in position 2 to 3 is any or no amino acid
  Variant (5)..(6): xaa in position 5 to 6 is any or no amino acid
  Variant (8)..(8): xaa in position 8 is Ser or Thr
  Variant (10)..(10): xaa in position 10 is any amino acid
  Variant (11)..(11): xaa in position 11 is Ala, Asp, Glu, Gly, Ser or Thr
  Variant (12)..(16): xaa in position 12 to 16 is any amino acid
  Variant (17)..(17): xaa in position 17 is Ala, Ile, Leu or Val
  Variant (18)..(19): xaa in position 18 to 19 is any amino acid
  Variant (20)..(20): xaa in position 20 is Phe, Ile or Leu
  Variant (21)..(22): xaa in position 21 to 22 is any amino acid
  Variant (27)..(27): xaa in position 27 is Phe or Tyr
  Variant (28)..(29): xaa in position 28 to 29 is any amino acid
  Variant (32)..(32): xaa in position 32 is Phe or Ile
  Variant (33)..(35): xaa in position 33 to 35 is any amino acid
  Variant (37)..(37): xaa in position 37 is Phe, Leu or Val
  Variant (38)..(39): xaa in position 38 to 39 is any amino acid
  Variant (41)..(45): xaa in position 41 to 45 is any amino acid
PXXVXXLXAXXXXXXXXXXXXXGADDXXXKPXXXXEXXXRXXXXXRR

SEQ ID NO: 106268 - protein, 31 aa, Artificial sequence
  Variant (2)..(2): xaa in position 2 is any amino acid
  Variant (3)..(3): xaa in position 3 is Ile, Leu or Val
  Variant (4)..(4): xaa in position 4 is Ala, Asp, Glu, Asn, Gln or Ser
  Variant (5)..(6): xaa in position 5 to 6 is any amino acid
  Variant (7)..(7): xaa in position 7 is Ile, Met or Val
  Variant (8)..(9): xaa in position 8 to 9 is any amino acid
  Variant (12)..(12): xaa in position 12 is any or no amino acid
  Variant (14)..(23): xaa in position 14 to 23 is any amino acid
  Variant (24)..(27): xaa in position 24 to 27 is any or no amino acid
  Variant (29)..(29): xaa in position 29 is any amino acid
  Variant (31)..(31): xaa in position 31 is Phe, Trp or Tyr
NXXXXXXXXLRXKXXXXXXXXXXXXXXGXGX

SEQ ID NO: 106269 - DNA, 1488 bp, Escherichia coli K12
  CDS (1)..(1488)
atgcaatacatcaagatccatgcgctggataacgtcgcggtcgctttagcagatttggctgaaggcacagaagtcagtgtcgataaccagactgttacgctgcgccaggatgttgctcgtggacataaatttgcgttaacggatatcgcaaaaggggccaatgtcatcaaatatggcctgccgattggttatgcattggcggatattgcggcaggtgttcacgttcacgcccacaatacgcgcacgaatctgagcgatctggatcagtatcgctatcaacctgattttcaggatctgcctgcgcaagcggcagatcgtgaagtgcagatctatcgtcgcgctaacggcgatgtcggggtgcgtaatgagctgtggatcctgccaaccgtgggctgtgtcaacggcatcgcgcggcagatccagaaccgttttctgaaagagaccaacaacgccgaaggtactgacggcgtgttcctcttcagccacacctacggctgctcacagctgggcgacgatcacattaatacccgcaccatgctgcaaaacatggtgcgccacccgaacgcaggcgcagtgctggtgattggtctgggctgtgaaaacaaccaggttgccgcattccgtgaaacgctgggcgatatcgatcctgaacgcgttcatttcatgatctgccaacagcaggatgatgagatcgaagccggaatcgagcatttgcatcagctgtataacgtgatgcgcaacgataaacgcgagccaggcaaactcagcgaactgaagtttggtctggagtgcggtggttctgacggtctttctggtattactgctaacccgatgctggggcgtttctctgactacgtgattgctaacggcggtactaccgtactgaccgaagtgccggagatgtttggcgcagagcagttgctgatggaccattgccgcgacgaagcaacgtttgaaaaactggtcaccatggtcaacgacttcaaacagtactttattgcccatgatcagccgatctatgaaaacccatcgccggggaacaaagcgggcggtatcaccacgctggaagacaaatcacttggctgtacccagaaagcgggttccagcgtcgtggttgacgtgctgcgttacggcgagcgtctgaaaacgccagggctgaacttgttaagtgcgccgggtaacgatgccgtagcgaccagcgccctggcgggtgcgggctgccatatggtgctgttcagtactggtcgtggcacgccgtatggtggatttgtgccgacggtgaaaatcgccaccaacagtgaactggcggcgaagaaaaaacactggatcgactttgacgcgggtcagttgatccacggtaaagcgatgccgcagttgctggaagaatttatcgacaccatcgttgagtttgccaacggtaagcaaacctgtaacgagcgtaacgacttccgcgaactggcgatcttcaaaagcggcgtaacgctataa

SEQ ID NO: 106270 - protein, 495 aa, Escherichia coli K12
MQYIKIHALDNVAVALADLAEGTEVSVDNQTVTLRQDVARGHKFALTDIAKGANVIKYGLPIGYALADIAAGVHVHAHNTRTNLSDLDQYRYQPDFQDLPAQAADREVQIYRRANGDVGVRNELWILPTVGCVNGIARQIQNRFLKETNNAEGTDGVFLFSHTYGCSQLGDDHINTRTMLQNMVRHPNAGAVLVIGLGCENNQVAAFRETLGDIDPERVHFMICQQQDDEIEAGIEHLHQLYNVMRNDKREPGKLSELKFGLECGGSDGLSGITANPMLGRFSDYVIANGGTTVLTEVPEMFGAEQLLMDHCRDEATFEKLVTMVNDFKQYFIAHDQPIYENPSPGNKAGGITTLEDKSLGCTQKAGSSVVVDVLRYGERLKTPGLNLLSAPGNDAVATSALAGAGCHMVLFSTGRGTPYGGFVPTVKIATNSELAAKKKHWIDFDAGQLIHGKAMPQLLEEFIDTIVEFANGKQTCNERNDFRELAIFKSGVTL

SEQ ID NO: 106271 - DNA, 1491 bp, Yersinia pestis
  CDS (1)..(1491)
atgcaaaatattataaagattcacccgctggataatgtggccgttgccctgcaagatctggctgcagatgagcggatcgagagcggtgagtttagcgtcaaactggctcagcccgtggttcgtgggcataaattcgcgttaaccgctatcgaactggggcagatgatcgtcaagtatggtttgcctatcggccatgcattgaccttgatccaaccgggcgaacatattcattcacagaacgccaaaactaatctgagcgatttggatgagtatgaatatcagccagagttcagttctctaccgccacaaatggctgatcgtgacgtgcaaatttatcgtcggccaaagggtgacgtggggatccgtaatgaactgtggatcataccaacggttggttgcgttaatgggatcgcccgtcagatccagcaacgtttcctgaaagagacacaggatgctgaagggattgatggtgtttacctgttcagccatccatttggctgctcgcaactggggcaggatcatgaaaatacccgcactatgctacaaaacatggtgcgtcacccgaatgcgggggcggtactggtcattggcttaggctgtgaaaacaatcaggtagatgttttccaaacgacattgggcaaggttgacgaagagcgcgtacgctttatggtttgccagcagcatgatgatgaggttgaagccggtttagagcatttacatgctctgtatcaggtcatgcgtcatgatcgccgggaacccggccagttaagtgaactgaaatttggcctggaatgtgggggttctgatgggctgtccggtattacggccaacccattactgggacgtttctctgactatgtgattaccaacggcggaacatcggtgctgaccgaagtgccggaaatgtttggcgcagaacgtattctgatgagccgctgccgtgatgaagccacgtttgaaaaaacggtcagcatggtcaatgacttcaaacagtactttattgcgcacgaccaaccgatttatgaaaacccatcaccgggtaataaagcgggggggatcaccacgctggaagaaaaatctctcggttgtacgcaaaaagcgggtcagagccaagtggttgatgtgctgaagtatggtgagcgcttacagcgcccaggactgaatttactcagtgcgccgggcaatgatgcggttgcgaccagcgcattagcaggtgcgggctgccatatggtgctgttcagtactggccgtggcacaccatacggaggttttgtaccaacagtgaaactggcaactaacagtgaactggcggcgaaaaagccacattggatcgattttgatgcgggtaagctgatccatggcacctcaatggataccttgctgaacgagtttgttgatctgattgttgagattgctaatggtaaacctgcccgtaatgaagtgaatgacttccgtgaattagccatttttaagagcggtgtaaccttgtaa

SEQ ID NO: 106272 - protein, 496 aa, Yersinia pestis
MQNIIKIHPLDNVAVALQDLAADERIESGEFSVKLAQPVVRGHKFALTAIELGQMIVKYGLPIGHALTLIQPGEHIHSQNAKTNLSDLDEYEYQPEFSSLPPQMADRDVQIYRRPKGDVGIRNELWIIPTVGCVNGIARQIQQRFLKETQDAEGIDGVYLFSHPFGCSQLGQDHENTRTMLQNMVRHPNAGAVLVIGLGCENNQVDVFQTTLGKVDEERVRFMVCQQHDDEVEAGLEHLHALYQVMRHDRREPGQLSELKFGLECGGSDGLSGITANPLLGRFSDYVITNGGTSVLTEVPEMFGAERILMSRCRDEATFEKTVSMVNDFKQYFIAHDQPIYENPSPGNKAGGITTLEEKSLGCTQKAGQSQVVDVLKYGERLQRPGLNLLSAPGNDAVATSALAGAGCHMVLFSTGRGTPYGGFVPTVKLATNSELAAKKPHWIDFDAGKLIHGTSMDTLLNEFVDLIVEIANGKPARNEVNDFRELAIFKSGVTL

SEQ ID NO: 106273 - DNA, 1575 bp, Agrobacterium tumefaciens
  CDS (1)..(1575)
atgacaaacatagcaggcaatgtaccgggaggaggaaaacccgtgagtgagaattccgaggcaaccattttgctgaacgccaacgacaatgtcgcggtggcgcgtcggtctatcccggctggcggagcgacgggcaggggtgatctggcggcactcgagctgatcggacgcgggcacaaggtggcgctcaaactcatcaaatccggagacgaggtgctgaaatacgggcaggtcatcggcatcgcgacccaggacatcgaagccggccggcatgtgcacctgcacaatctcgccatggtgccgtcagaacatgcgcatcagttcagcgtcgacatcgaggagaagggcatggtgccggaagccgagcgccggaccttcatgggttatgaccgtggtctcggcggcgttggcacacgcaactatatcggcgtcatcgcctcggtgaactgttccgccactgtgtcgcgctacatcgccgattatttcaacaaacagggcggccttgacggcttcgacaatgtcgatggcgtcgtggcgctgacccacggtggcggctgtgcgctgaacaccaagtcggaaggttaccgccttctgatccgcaccattcagggttatgcccgccatccgaatttcggcgggattctgctgatcggccttggttgcgaaaccaaccagatcgcgcccattctcgaacattacaagatggaagagggcgagcggctgcgcaccatgaccatccagcagcatggtggcacccgcaagaccatcgatgcggcaataaccgaaatcaaggcgatgctaccgatggtgaacgccgcccgccgcaccgagcaaccgctttccaagctgaaggtcgcactggaatgtggcggctcggatggatattccggcatctccgccaatccggctctgggttatgcatccgacctaatcgtccgcaatggcggcacgaccgtgctttccgaaacgcccaaaatctacggcgcggagcacctgctgaccaaacgcgccgtcacacctgcggtcgccgaaaaactgctgcagcgcatcgactggtggcgggactataccgcccgcaatggcgacgaactcaacaacaatccttcgcacggcaacaagctcggcggcctgactaccattctggagaaatcgctgggcgcggtcgccaagggtggctccatgccgctgaaggcggtttatgaatttgccgagaccgtgacggagcaaggcttcgtcttcatggatacacccggctatgaccccgttgccgtcaccggccaggttgccggcggctgcaacgtcatctgtttcaccaccggccgtggctcggtttcaggtttcaagccctctccctgcatcaagatcgccaccaactccgaaatgtatgaacacatgaaggaagacatggatatcaactgcggcgagatcgtcaccggaacggaaaccatcgaagaatccggcaaacgaattttcgaacatattctcgcggtcgcttccggcgacaagacggtgagcgaaatttatgattacggtgacaatgaatttgtgccgtggcaggtcggcgcagtgacctga

SEQ ID NO: 106274 - protein, 524 aa, Agrobacterium tumefaciens
MTNIAGNVPGGGKPVSENSEATILLNANDNVAVARRSIPAGGATGRGDLAALELIGRGHKVALKLIKSGDEVLKYGQVIGIATQDIEAGRHVHLHNLAMVPSEHAHQFSVDIEEKGMVPEAERRTFMGYDRGLGGVGTRNYIGVIASVNCSATVSRYIADYFNKQGGLDGFDNVDGVVALTHGGGCALNTKSEGYRLLIRTIQGYARHPNFGGILLIGLGCETNQIAPILEHYKMEEGERLRTMTIQQHGGTRKTIDAAITEIKAMLPMVNAARRTEQPLSKLKVALECGGSDGYSGISANPALGYASDLIVRNGGTTVLSETPKIYGAEHLLTKRAVTPAVAEKLLQRIDWWRDYTARNGDELNNNPSHGNKLGGLTTILEKSLGAVAKGGSMPLKAVYEFAETVTEQGFVFMDTPGYDPVAVTGQVAGGCNVICFTTGRGSVSGFKPSPCIKIATNSEMYEHMKEDMDINCGEIVTGTETIEESGKRIFEHILAVASGDKTVSEIYDYGDNEFVPWQVGAVT

SEQ ID NO: 106275 - DNA, 1512 bp, Agrobacterium tumefaciens
  CDS (1)..(1512)
atggctcgctacatcaaactgactgaaaccgataacatcatcgtcgccgtcgaaccgatcacgctgggtgagagcgtggcagaggttactgcgcgcgagcgtattccgcgcggtcacaaaatggccctgcaggcgatcgcaaatgggacaccgatcgtcaaatatgggcagatcatcggcttttccacgcgggacatcgagccggggcaatgggtccacgagcataacgtgacgatgcagagcttcgaacgcggttatgcgagtggcgaggaagcaagaccgacgcgctatgtcgagccggagaaacgccacagcttcaacggtttcagacgccccagcggacgcttcggcacccgtaattacatcgccgttctcacctcggtgaactgttccgccaccgcctcgcgctttatcgccgatgagatcaaccgctctggcattctcgaccagttcccgaatgtggacggtgtcatatcgctcgtccacggcaccggatgcggattggatatccatggcgaggcctacgaattgctgaagcgcacccaatggggcgtggcaaagaacccgaatgtcggcggcgtgctgatggtggggctgggttgcgaggcgtttcagatcccgcgctggatggatgcttacggattaagggaaagcgagacctttcgcacgcttaccattcaggaacttggtggcacgcgcaaaacggtggaggccggcgtcgtggccatccgcgagatgctgccggtggtcaataaggccattcgtgtccccgcccccgcttcagaactgatgctggcattgcaatgcggcggctcggacggttattccggcatcacggccaatccggcgctcggtattgccgccgatatattgatcgccgaaggcggaaccgcgatcctctcggaaaccccggaaatatacggcgcggagcatcttttgatccgccgggcggaacgaccggaggtcggcgagaagctggccgaacgcatccgctggtgggagaactatacccggcggcacgacatggagatgaacaacaacccttcccccggcaacaaggcgggcggcctgacgaccattctcgaaaaatcgctgggagcggcgatgaagggcggctcgaccaatctgacggcagtattcaactacgccgaaccggtggacgccaggggactggtcttcatggatacgcccggttacgaccccgtttcagccacgggccaagtggcgggtggcgccaatattctctgtttcaccaccgggcggggctcggcatttggctgcaagcccaccccttcgatcaagctcgcttccaattcctacatctttgagaaaatgggagaagatatggacatcaattgtggtgacgtacttgatggcaagacgctgcagcagaagggcgaagaaatcttcacgagaatcctagccgtcgcctccggcgagcgcacaaaatccgagcttctggggtatggcgacaatgaattcgtcccatggtccatcggcgcgacgatgtaa

SEQ ID NO: 106276 - protein, 503 aa, Agrobacterium tumefaciens
MARYIKLTETDNIIVAVEPITLGESVAEVTARERIPRGHKMALQAIANGTPIVKYGQIIGFSTRDIEPGQWVHEHNVTMQSFERGYASGEEARPTRYVEPEKRHSFNGFRRPSGRFGTRNYIAVLTSVNCSATASRFIADEINRSGILDQFPNVDGVISLVHGTGCGLDIHGEAYELLKRTQWGVAKNPNVGGVLMVGLGCEAFQIPRWMDAYGLRESETFRTLTIQELGGTRKTVEAGVVAIREMLPVVNKAIRVPAPASELMLALQCGGSDGYSGITANPALGIAADILIAEGGTAILSETPEIYGAEHLLIRRAERPEVGEKLAERIRWWENYTRRHDMEMNNNPSPGNKAGGLTTILEKSLGAAMKGGSTNLTAVFNYAEPVDARGLVFMDTPGYDPVSATGQVAGGANILCFTTGRGSAFGCKPTPSIKLASNSYIFEKMGEDMDINCGDVLDGKTLQQKGEEIFTRILAVASGERTKSELLGYGDNEFVPWSIGATM

SEQ ID NO: 106277 - DNA, 1572 bp, Salmonella enterica subsp. enterica serovar Typhi
  CDS (1)..(1572)
atggccaatatcgaaattcgccaggaatcgccatcggcgttttatataaaagtacatgaaaccgataatgtcgcaattattgttaatgaccacggccttaaagccggaacacgttttccggatggcctggaactgactgaacatattccgcaaggccataaagtcgctctgacggatatccccgctcacggcgaaatcatccgttatggcgaagtcatcggttatgcggtacgcgacatcccgcgcggaagctggatcgacgagtcgctggttgaactgccaaaagcgccgccgctgaatacgctaccgctggcgaccaaagtaccggaaccgctgccgccgctggaaggctacacgtttgagggctatcgtaacgccgatggcagcgtcggcaccaaaaatctgcttggcattaccaccagcgtgcactgtgtggcgggcgtggtcgattatgtggtgaaagtgattgagcgcgatctcctgcccaaatacccgaatgtcgatggcgttgtagggctaaaccatctgtacggctgcggcgtggcaatcaacgcgccggcggcggtcgtgccgattcgcacaattcataatatcgcgctcaaccccaattttggcggcgaagtgatggtgattggcctcggttgcgaaaaactgcagccggaacgactgctggaaggcaccgaggatgtccccgccatcgccgttgaaaacgccagtattgtgcgtttacaggacgagcagcatgttggctttaaatcaatggtcgacgatattttgcgggtcgccgaacgccatctgacgaaactgaaccagcgccagcgcgaaacctgcccggcctccgagctggtcgtcgggatgcaatgcggcggcagcgatgcgttttctggcgtcacggcaaacccggcggtgggttatgcttccgatctgctggtacgctgcggcgcgaccgtcatgttctcggaggtcaccgaagtgcgcgatgccattcatcttctgacgccgcgcgccatcaacgaagccgtgggtaaacgcctactggatgaaatggcctggtacgataactaccttgatatggggaaaaccgatcgcagcgctaacccgtcccccggcaacaaaaaaggcggcctggcgaacgtcgtggaaaaagcgctgggctctatcgctaaatcgggtaagagcgccattgtcgaagtattgtcgccgggccagcgccccaccaaacgcggcctgatttacgccgcgacgcccgccagcgatttcgtctgcggcacgcagcaggtcgcttccggcattaccgtacaggtctttaccaccggacgcggcacgccgtacgggctgatggcggtgccggtcattaaaatggcgacgcgtaccgagctggcgaaccgctggtatgacttaatggatatcaatgcaggcaccatcgccacgggtgaagagacaatcgaagatgtgggctggaagctatttcactttattctcgatgtcgccagcggccggaaaaagactttctcagatcaatggggattgcataaccagctggcagtgtttaaccccgcacctgtgacctga

SEQ ID NO: 106278 - protein, 523 aa, Salmonella enterica subsp. enterica serovar Typhi
MANIEIRQESPSAFYIKVHETDNVAIIVNDHGLKAGTRFPDGLELTEHIPQGHKVALTDIPAHGEIIRYGEVIGYAVRDIPRGSWIDESLVELPKAPPLNTLPLATKVPEPLPPLEGYTFEGYRNADGSVGTKNLLGITTSVHCVAGVVDYVVKVIERDLLPKYPNVDGVVGLNHLYGCGVAINAPAAVVPIRTIHNIALNPNFGGEVMVIGLGCEKLQPERLLEGTEDVPAIAVENASIVRLQDEQHVGFKSMVDDILRVAERHLTKLNQRQRETCPASELVVGMQCGGSDAFSGVTANPAVGYASDLLVRCGATVMFSEVTEVRDAIHLLTPRAINEAVGKRLLDEMAWYDNYLDMGKTDRSANPSPGNKKGGLANVVEKALGSIAKSGKSAIVEVLSPGQRPTKRGLIYAATPASDFVCGTQQVASGITVQVFTTGRGTPYGLMAVPVIKMATRTELANRWYDLMDINAGTIATGEETIEDVGWKLFHFILDVASGRKKTFSDQWGLHNQLAVFNPAPVT

SEQ ID NO: 106279 - DNA, 1494 bp, Bacillus halodurans
  CDS (1)..(1494)
atgaacgaaaaatttgcctatattcacgaaaaggacaatgtcatcattgccttgtcgcctttagaacaaggggaagtgctcaatgttaacggcttacccattacgttaagtgaatctatcccaaggggacataaggtagccattgttacgatcgaacaaggggaagatgtaatcaaatatggatttcccattggtaaagccacgacgacaattcaacctggtgcctgggtccattcacaaaatatgaaaacgaagctggaaggtgttcaggaatacgactatacaccaagcactccctcgttccgaaaacaagtagagaaggtacggacattccaagggtatgtcagggataatggtaatgttggtatccgcaatgaaatttggattattaacaccgtaggatgcattaataaaacggcagaacgactcgcagcaataagtaacgaaacgtgcggagctggtgtagacggtgtgtatcattatcctcatttgttcgggtgctcccagcttggtgatgacctgctttatacgcagaaaatattaaggaatctcgtccttcatccgaatgcggcaggggtgctcgtattagggcttggctgtgaaaacaaccatattgctgcttttaagcaggtgcttggcgactatgatgacaggcgagtgaagtttcttgctgtccaagaggccgataatgaaatggaacaaggactcgcaattattgaggagttgattagttacgcgaaaacagccaagcgcgagcctatccccctttccaagctaaaagttggcctgaagtgcggagggtctgacggcttttccggaattaccgcaaaccccctcgtcggcgcgttttctgataaagtcgttgcccatggggggacaacggtgatgacagaggtacccgaaatgtttggggcggagacgattttaatgaatcgtgccaaggatcaggcaacctttgaaaaaatggttcggctcattaacgatttcaaagagtatttccttcggcacaatcaaccagtctatgaaaatccatctcctgggaacaaagagggagggattacgacacttgaagaaaagtcattaggctgtgtgcaaaagggtggttttgccgaagtcgtcgatgtcctcccatacggagaaaggttggaaaagccaggcttaaacttactgcaaggcccagggaatgatttagtatcggtgacagctctcgcggcagccggtgcccattttgtcttgtttacgacgggtcgtggaaccccttttggtggcccagtgccaacggtaaaaatttcgactaacacgtccctttatgaacgaaagaagcattggattgattttaacgccgggcggctagttgaaggggcaaccttggatgaagtagctgaagagttgctcaactatggggtgaagcttgcttcaggagaagtgagggcgaaaaacgaagagtatgggtttaaggaaatttccatttttaaggatggagtcatattgtaa

SEQ ID NO: 106280 - protein, 497 aa, Bacillus halodurans
MNEKFAYIHEKDNVIIALSPLEQGEVLNVNGLPITLSESIPRGHKVAIVTIEQGEDVIKYGFPIGKATTTIQPGAWVHSQNMKTKLEGVQEYDYTPSTPSFRKQVEKVRTFQGYVRDNGNVGIRNEIWIINTVGCINKTAERLAAISNETCGAGVDGVYHYPHLFGCSQLGDDLLYTQKILRNLVLHPNAAGVLVLGLGCENNHIAAFKQVLGDYDDRRVKFLAVQEADNEMEQGLAIIEELISYAKTAKREPIPLSKLKVGLKCGGSDGFSGITANPLVGAFSDKVVAHGGTTVMTEVPEMFGAETILMNRAKDQATFEKMVRLINDFKEYFLRHNQPVYENPSPGNKEGGITTLEEKSLGCVQKGGFAEVVDVLPYGERLEKPGLNLLQGPGNDLVSVTALAAAGAHFVLFTTGRGTPFGGPVPTVKISTNTSLYERKKHWIDFNAGRLVEGATLDEVAEELLNYGVKLASGEVRAKNEEYGFKEISIFKDGVIL

SEQ ID NO: 106281 - DNA, 1164 bp, Sulfolobus solfataricus
  CDS (1)..(1164)
atggaaaaaccaataataaggggttacattagggaaaacggtagtgtaggagttaggaattacgtagctgtaataccagtagatgatttatcaaattccgcttcaataggggtatcgaaattaattaggggtacggtagctattccccatccctacggtagattacagtttggtaaggatttagacttactctttcacgtattatctggtactggtgcaaatccaaacgtagctgctgcaatagttataggaattgaggaaaactgggcaaataaggtagctgataagatagctgagactggtaagccagttgaggtcttcccagttgagggaaatggtgatttgaaagtaatagagaaagctagcagaaaggcaaaggagttcgtccaagaggctagtgagaagcagaggactgaagtggacctatcatctttagttttaagcattaagtgtggcgagagcgatacaacatctggtttagcgtcaaacccagcaaccggttatgctgtggataaattgatagattacggttcaacagtgatgtttggagagacctcagagttaactggtgctgaagacattgtagccagtaggatacaagatccggttttgagggataagttcatgaggatttataacgaatacgttgctttcattgagagtcaaggagtcgacctattaggctcacaaccaactgagggaaacattaagggaggattatcgactatagaggaaaaggctctagggaatattcaaaaattaggcactaaaccaattacttgtgtgttagactatttggatccattagggaagggatcatctagactgtgtttcgttaatacttcgtctgctgctgctgaggcagttacgctgtttgccgctaagggttcagtacttcacttgtttacaactgggcaagggaatgtagttggtcatccgataattcctgtagtaaaaatttccgcaaatccaaagactattgcaacaatgagtgagcatattgacgttgacgtttctgatttacttcaattgaaggttagcttaaaagaagcaggggaaagaatattcaactatacgattagggttgccaacggtaggttaacttcagcggagatattacaacatgaggagttctctccaataaagctttacataagtgcttaa

SEQ ID NO: 106282 - protein, 387 aa, Sulfolobus solfataricus
MEKPIIRGYIRENGSVGVRNYVAVIPVDDLSNSASIGVSKLIRGTVAIPHPYGRLQFGKDLDLLFHVLSGTGANPNVAAAIVIGIEENWANKVADKIAETGKPVEVFPVEGNGDLKVIEKASRKAKEFVQEASEKQRTEVDLSSLVLSIKCGESDTTSGLASNPATGYAVDKLIDYGSTVMFGETSELTGAEDIVASRIQDPVLRDKFMRIYNEYVAFIESQGVDLLGSQPTEGNIKGGLSTIEEKALGNIQKLGTKPITCVLDYLDPLGKGSSRLCFVNTSSAAAEAVTLFAAKGSVLHLFTTGQGNVVGHPIIPVVKISANPKTIATMSEHIDVDVSDLLQLKVSLKEAGERIFNYTIRVANGRLTSAEILQHEEFSPIKLYISA

SEQ ID NO: 106283 - DNA, 1533 bp, Bacillus subtilis
  CDS (1)..(1533)
atggcgatgaacctcaggaagaaccaagcccccctttacatcaaagtgcatgaaatagataacaccgcgattattgtaaatgatggagggctgccaaagggcactgttttctcatgcgggctcgtacttgaagaggatgttcctcaaggccataaggtggccctcaccgatctcaatcaaggggacgagatcgtgcgttacggagaggtgatcggatttgctgatgagacgatcaaacgcgggagctggatacgggaagccctcgtgagaatgcccgctcctccggcgttagacgatcttcctctcgcaaacagggtgccgcagccgcggcccccacttgaaggatatacatttgaaggataccgaaatgcggatggcagtgcggggacaaaaaatatcctcggcatcacgacaagtgttcaatgtgttgttggcgttttggattatgcagtcaaacgaataaaagaagagctgctgccgaaatacccaaatgtcgatgacgttgtgccgctgcatcatcaatacggatgcggcgtggcgatcaatgcgcccgacgctgtcattccgatccgcacgattcaaaatcttgcgaagcatccgaacttcggcggtgaagtaatggtaatcggattgggatgtgaaaagctcctcccggaaagaattgcctccgaaaatgatgatgacattctatcgctccaggatcaccgaggttttgcggcgatgatccaatccattttggaaatggcggaggaacggttaatcaggctgaacagcagaacccgggtgtcatgccctgtttcggatctggttatcggcctgcaatgcggcggcagtgatgcgttttccggcgtgacggcgaaccctgccgtggggtatgcggctgatttattggttcgcgcaggtgcaacggttttgttttctgaagtgacagaggtgcgggatgccattcatttattaacgccgcgggctgtcagtaaagaggtcggacaatcgctgatcaaagagatgaagtggtatgacagctatcttcggcggggagacgcagaccgtagcgcaaacccgtcaccaggcaataaaaaaggcggattatccaatgtggtggaaaaagcgttaggttcggtagcgaaatcaggcacaagccccatctccggcgtgctcggccctggtgaaagagcaaagcaaaaaggcctgctgttcgcggcgacaccggcaagcgattttgtgtgcggcaccctgcagctggctgcgggcatgaatttgcaggtgtttacgacagggagaggaacaccatatggcctggctgctgcgccggttctgaaagtatcgacgcggcattccttatcagagcattgggctgatttaatcgatatcaatgccggccgaatcgcgacaggagaggccagtatcgaagacgtaggctgggaaatcttcaggacgattttggatgtggcaagcggccgcaaacaaacgtgggcagaccgttggggtcttcataatgatttgtgcttgtttaatcctgctccagtgacttga

SEQ ID NO: 106284 - protein, 510 aa, Bacillus subtilis
MAMNLRKNQAPLYIKVHEIDNTAIIVNDGGLPKGTVFSCGLVLEEDVPQGHKVALTDLNQGDEIVRYGEVIGFADETIKRGSWIREALVRMPAPPALDDLPLANRVPQPRPPLEGYTFEGYRNADGSAGTKNILGITTSVQCVVGVLDYAVKRIKEELLPKYPNVDDVVPLHHQYGCGVAINAPDAVIPIRTIQNLAKHPNFGGEVMVIGLGCEKLLPERIASENDDDILSLQDHRGFAAMIQSILEMAEERLIRLNSRTRVSCPVSDLVIGLQCGGSDAFSGVTANPAVGYAADLLVRAGATVLFSEVTEVRDAIHLLTPRAVSKEVGQSLIKEMKWYDSYLRRGDADRSANPSPGNKKGGLSNVVEKALGSVAKSGTSPISGVLGPGERAKQKGLLFAATPASDFVCGTLQLAAGMNLQVFTTGRGTPYGLAAAPVLKVSTRHSLSEHWADLIDINAGRIATGEASIEDVGWEIFRTILDVASGRKQTWADRWGLHNDLCLFNPAPVT

SEQ ID NO: 106285 - DNA, 1572 bp, Escherichia coli
  CDS (1)..(1572)
atggccaacatcgaaatcagacaagaaacgccaactgcgttttatataaaagttcacgacacagataatgtggcaattattgttaatgataatggcctgaaagcaggaacgcgttttccggatgggctggaattaattgaacatattccccaggggcataaagtcgcattgctggacattccggctaatggtgaaattattcgttatggcgaagtgattggttacgccgtgcgtgcaatcccacgcggaagctggatcgacgaatcaatggttgtactaccggaagcgccgccgttacacacgctgccactggcaaccaaagtcccggaacccttaccgccgctggaaggatacacctttgagggctatcgcaatgccgatggcagcgtgggcaccaaaaacctgctcggtatcaccaccagcgtccactgtgtggcaggcgtggtggactatgtagtaaaaatcattgaacgcgatctgctaccgaaatacccgaacgtcgatggcgtggtggggctgaatcatttgtacggttgtggcgtggcgattaacgcaccggcggcagttgtacctatccgtaccattcacaatatttcgctgaatcctaactttggcggcgaagtaatggtgattggcctgggttgtgaaaagttgcagcctgagcgcctgctgactggaacggatgatgtgcaagctattccagtagaaagcgccagcattgtcagtttgcaggatgaaaagcatgtcggttttcagtccatggtcgaggatattttgcagatcgccgaacgccatctacaaaaactgaatcaacggcagcgagaaacctgcccggcttcagaactggtcgttggtatgcagtgcggtggcagcgatgcgttttctggtgtaacggcaaacccggcggttggctatgcgtctgatctactggtgcgctgcggcgcaacggtgatgttttcagaagtaacggaagtgcgtgacgcgatccatctgctgacaccacgcgcagtgaacgaagaggtcggcaaacggctgctggaggagatggagtggtacgataactatctcaatatgggaaaaaccgaccgcagcgccaacccttcgccgggcaacaagaaaggcggtctggcaaacgtggtagagaaggcactcggctccattgctaaatcgggtaaaagcgcaattgttgaagtgctgtcgcccggtcaacgcccgactaaacgcggattaatttacgccgcgacgccagccagcgattttgtctgtggcacgcaacaggtggcttcgggtatcacagtgcaagtgtttacgaccggtcgtggtacgccgtacggcctgatggcggtacccgtcattaaaatggcaacccgcaccgagctggcgaaccgctggtttgatttaatggatattaatgcgggcaccatcgctaccggcgaagaaactattgaagaggtgggctggaagttgttccactttattctcgacgtcgccagcgggaagaagaaaaccttctcggatcaatgggggctgcataaccagctggcggtgtttaacccggcaccggtgacctga

SEQ ID NO: 106286 - protein, 523 aa, Escherichia coli
MANIEIRQETPTAFYIKVHDTDNVAIIVNDNGLKAGTRFPDGLELIEHIPQGHKVALLDIPANGEIIRYGEVIGYAVRAIPRGSWIDESMVVLPEAPPLHTLPLATKVPEPLPPLEGYTFEGYRNADGSVGTKNLLGITTSVHCVAGVVDYVVKIIERDLLPKYPNVDGVVGLNHLYGCGVAINAPAAVVPIRTIHNISLNPNFGGEVMVIGLGCEKLQPERLLTGTDDVQAIPVESASIVSLQDEKHVGFQSMVEDILQIAERHLQKLNQRQRETCPASELVVGMQCGGSDAFSGVTANPAVGYASDLLVRCGATVMFSEVTEVRDAIHLLTPRAVNEEVGKRLLEEMEWYDNYLNMGKTDRSANPSPGNKKGGLANVVEKALGSIAKSGKSAIVEVLSPGQRPTKRGLIYAATPASDFVCGTQQVASGITVQVFTTGRGTPYGLMAVPVIKMATRTELANRWFDLMDINAGTIATGEETIEEVGWKLFHFILDVASGKKKTFSDQWGLHNQLAVFNPAPVT

SEQ ID NO: 106287 - DNA, 1494 bp, Bacillus subtilis
  CDS (1)..(1494)
atgaagtcgtttataaagattcataagcaagataatgtccttcttgctctgcggtatattcaaaagggagagaggctgcatgcttacggcgtgtcgattgaagtaaaggatgatataaaaagaggccataagattgcattgcagtctatcaaagaaaacgacagcatcgtcaagtacgggtttccaatcggtcatgcatcacaagatatctcgatcggagagcatattcatgtccataatacgaaaacaaacctgtctgatatccaattatacagctatacaccgagatttgatgaaaatccgtattctaatgagaaccggacgtttaaaggttttagaagagaaaacggagatgcgggtgtacggaatgaattgtggattgtcccaactgtcggctgtgtcaatggaatagcagaaaaaatgctgcagcgttttgtcagagaaacaggggatatcgctccatttgataacgtactggtgttaaagcatcaatacggatgctcgcagcttggcgacgatcatgaaaatacgaagcagatcctgctgaatgccattcgccatccaaatgccggcggcgtcttggtgttagggcttggctgtgaaaacaatgagctggcaagaatgaaggaagcactgcaagatgtgaacttgaagcgggtgaagtttctggaatcccagtcggtgaccgacgaaatggaggcaggcgttgctttgctgaaggaaattcatgaagcggccaaaggagataagagagaagacattccgctgtctgaactgaagatcgggctgaaatgcggaggttcggacggtttttccggcataaccgcaaacccgctgcttggacgtttttcagattatctcattgcacagggagggagtactgtgctgacggaagtaccggaaatgttcggcgcagaaaccatcctgatgcagcgggctgccaatgaagaagtgtttcataagatagtcgatttaatcaatgatttcaaacaatactttattaaacatgatcagccggtgtacgaaaatccttcaccgggcaacaaagcgggcggcatttctacacttgaggataaatcgctgggctgtacgcaaaaagcggggatttctcctgtcacggatgtcttgaaatacggtgaagtactcaagacaaaagggctgactcttttgagcgcaccgggcaatgatttgatcgcctcctccgcattggcggctgccggctgccaaattgtcctctttacaacgggaagaggcacgccgtttggcacctttgtcccgacggtgaaagtagcgacaaacaccgagctgtatgaggcgaagccgcattggattgattttaacgcaggccttttagcagaggatgatgttcatgaggaatatgtgctgcgtgagtttatccactatatgattgaggtggcaagcggccagcttgtgaaccatgaaaaaaatgatttcaaagaactcgccatttttaaatcgggtgtgacgttataa

SEQ ID NO: 106288 - protein, 497 aa, Bacillus subtilis
MKSFIKIHKQDNVLLALRYIQKGERLHAYGVSIEVKDDIKRGHKIALQSIKENDSIVKYGFPIGHASQDISIGEHIHVHNTKTNLSDIQLYSYTPRFDENPYSNENRTFKGFRRENGDAGVRNELWIVPTVGCVNGIAEKMLQRFVRETGDIAPFDNVLVLKHQYGCSQLGDDHENTKQILLNAIRHPNAGGVLVLGLGCENNELARMKEALQDVNLKRVKFLESQSVTDEMEAGVALLKEIHEAAKGDKREDIPLSELKIGLKCGGSDGFSGITANPLLGRFSDYLIAQGGSTVLTEVPEMFGAETILMQRAANEEVFHKIVDLINDFKQYFIKHDQPVYENPSPGNKAGGISTLEDKSLGCTQKAGISPVTDVLKYGEVLKTKGLTLLSAPGNDLIASSALAAAGCQIVLFTTGRGTPFGTFVPTVKVATNTELYEAKPHWIDFNAGLLAEDDVHEEYVLREFIHYMIEVASGQLVNHEKNDFKELAIFKSGVTL

SEQ ID NO: 106289 - DNA, 1479 bp, Clostridium acetobutylicum
  CDS (1)..(1479)
atgaaaaatgttataaagataaatgaaaaagataatgttgtagttgctttaaatgatttaaacaaaggcgatgtaattgaaatagatggaaaagtaattacagcagaagagcctgtaaaaaaaggtcataaaattgcaattacagatatacaaaagaactctaatatatataagtatggatttcctattggtcatgcgttagaagaaataaaaaaaggtcaatgggtacatactcataatataaaaaccaatttggatggaataaaggattatgagtacaataaacaaacttttgagaatccatttaaaaatgaaaatttaacttttaagggttatagaagagaagacggaacagtaggaataagaaatgaattatggatagttccaactgttggttgtgtgaatggtacagctgatttaatagctgaaagatttaaaagtgaaactgagtttaaagatgtacatgtatttaagcataattttggatgttcacagcttggtgatgatcacaataacacaagaactatattaggtaacattgtaaagcatcctaatgcaggaggagtattagttcttggacttggttgcgaaaataatactatggagagtttcaaggaatcacttcatagctacaataaagaaagagtaagatttttaatagctcaagatgtagaagatgaaatatcttccggatgtgagttgttaaaagaattatatgaaaagatacaaaaggatgaaagagaagaggtatctatttcagaacttaaaataggacttaaatgtggagcatcagatggtttttctggaataactgcaaatccacttttaggaaagttatcagactttttaatagcacagggtggaacaactatacttacagaagttcctgaaatgtttggagcagaaacaatactcatgaatagggcaaaagatgagaaagtatttgcaaaaacggtaaacttgattaatgattttaaaaaatatttcatgagctataatcaacctgtatatgaaaatccttctccaggaaacaaagcaggtggaataactacattagaagataaatcattaggatgtacacaaaaatcaggaagctctgaagtagttggagtacttaagtacggagaaactttagaaaataaagggttaaatcttttaagtgcgccaggtaatgatttagtggcatctactgctcttgcatcggcaggatgtcatatggtgttgtttacaactggtagaggtacaccatttggaacttttgtgccaactgttaagatttcaactaactcagatatatataataagaagaaaaattggatagattttaatgcgggtgcacttttagaaaatcaatctatggatcaagtgcttaaagaatttattaattatttactcggagttgcaaacggaaatatggcaaacaatgagaaaaataacataagagaaatatctatatttaaaaacggtgtaacactataa

SEQ ID NO: 106290 - protein, 492 aa, Clostridium acetobutylicum
MKNVIKINEKDNVVVALNDLNKGDVIEIDGKVITAEEPVKKGHKIAITDIQKNSNIYKYGFPIGHALEEIKKGQWVHTHNIKTNLDGIKDYEYNKQTFENPFKNENLTFKGYRREDGTVGIRNELWIVPTVGCVNGTADLIAERFKSETEFKDVHVFKHNFGCSQLGDDHNNTRTILGNIVKHPNAGGVLVLGLGCENNTMESFKESLHSYNKERVRFLIAQDVEDEISSGCELLKELYEKIQKDEREEVSISELKIGLKCGASDGFSGITANPLLGKLSDFLIAQGGTTILTEVPEMFGAETILMNRAKDEKVFAKTVNLINDFKKYFMSYNQPVYENPSPGNKAGGITTLEDKSLGCTQKSGSSEVVGVLKYGETLENKGLNLLSAPGNDLVASTALASAGCHMVLFTTGRGTPFGTFVPTVKISTNSDIYNKKKNWIDFNAGALLENQSMDQVLKEFINYLLGVANGNMANNEKNNIREISIFKNGVTL

SEQ ID NO: 106291 - DNA, 1509 bp, Caulobacter crescentus
  CDS (1)..(1509)
atgaccaaaaacacccctgctcctggcgaatcgatccacgcggtggatccccgtgatcacgttgcgactgcgctacgtgatctggcctgcggcgagtctgtctcggcgcatggcgagcgtttcattgtccgcgcagacgtgccgaagggtcacaagatcgccacgcgcgtcgttcgctccggcgatgacgtcctgaagtacggctggccgatcggtcgcgccacagccgacatcgcggtcggcgaccatgtgcacgttcacaacgtgatcacccgcctggaaggcgtcgaaggctacgccttcgcgcccctgccgccggccggagcgccgtctgcagacacgcgaaccttccaaggcttccgtcgcaagaatggccgggccggaacgcggaacgagatctgggtgctgtgcacggtcggctgcgtcgccaacacggcccgccggatcgccgagaaggccaaccagcgcttcgccggacgcgtggacggcgtctacgccttcccccaccccttcggatgctcccagctcggagacgatctggcccatacgcggaaactgatcgccgctctggccagccatcccaacgccggaggcgtgctgatcctgggcctcggctgcgagaataaccaactcaaggcgctgctcgagagcgctccggacatcgaccgagagcgccttaagggcttcacgacccaaatggtcgaggacgagctggaggatggtctggccgccgtggaagccctggtcgagatcgccgagaaggaccggcgcgagcctgtgccggtttcggaactggtcgtcggcctcaagtgcggtggatcggacggcttttcggggatcacggccaatccgctggtcggccggatcgccgacaaggtcgctgaggccggcggcacccccgtgctgacggagattcccgaaatcttcggggccgagaatgttctgcttcagcgcgccgccagccgcgaggtcttcgacgccgcggtggcggtgatcgacgacttcaagcgctacttcatcgaagccaaccagcccatctatgagaacccctcgccgggcaacatcgcgggcggcatcaccagtctggaagaaaaatctctgggcgcggtgcagaagggcggacgcgcgccgttggtcgaggtgctgcgctatggcgaaaccgtcggacgccatggcctgaccctgctggaagcgcccgggaacgacgcggtgtcctccaccgccctgaccgcggctggtgcgacggtgatcctcttcaccacggggcgcggcacgccgctgggctttcctgcgccgaccctgaagatcgcctcgaactccggcttggcgcagcgcaagccgggctggatcgatttcgacgcgggccaggtcctcgaaggcgtatccatggatgtcgccgcagagaacctgatggaccttgtgatcgaaaccgcgtccggcaagaccaccaaggccgaactgaacggcgagcgcgagatcgccctctggaaatccggcgtcaccctatga

SEQ ID NO: 106292 - protein, 502 aa, Caulobacter crescentus
MTKNTPAPGESIHAVDPRDHVATALRDLACGESVSAHGERFIVRADVPKGHKIATRVVRSGDDVLKYGWPIGRATADIAVGDHVHVHNVITRLEGVEGYAFAPLPPAGAPSADTRTFQGFRRKNGRAGTRNEIWVLCTVGCVANTARRIAEKANQRFAGRVDGVYAFPHPFGCSQLGDDLAHTRKLIAALASHPNAGGVLILGLGCENNQLKALLESAPDIDRERLKGFTTQMVEDELEDGLAAVEALVEIAEKDRREPVPVSELVVGLKCGGSDGFSGITANPLVGRIADKVAEAGGTPVLTEIPEIFGAENVLLQRAASREVFDAAVAVIDDFKRYFIEANQPIYENPSPGNIAGGITSLEEKSLGAVQKGGRAPLVEVLRYGETVGRHGLTLLEAPGNDAVSSTALTAAGATVILFTTGRGTPLGFPAPTLKIASNSGLAQRKPGWIDFDAGQVLEGVSMDVAAENLMDLVIETASGKTTKAELNGEREIALWKSGVTL

SEQ ID NO: 106293 - DNA, 1575 bp, Erwinia carotovora subsp
  CDS (1)..(1575)
atgtcagataaatcagaaagtaatgctgcacaagagcagccactttatattaaggttcacgattccgataatgttgccattgttgttaataataatggcttacgtgccggaacccgttttaatgataatctggaattaattgaacatgttccgcaaggtcacaaagttgcccttgttgatatcgccaaatcaggcgcaatcatccgctatggcgaaattatcggctatgcgctgcgcgatattgccaaaggaagctggattgacgaatccgttgtcgagttacctcaggcacccgcgctggaaaccttaccgctggcgaccaacattcccccttctcttcctccgctggaaggctacacctttgaaggttatcgcaacgctgatggcagcgtaggcacgaaaaacctgttgggcattaccaccagcgtacactgcgtcgcgggcgtagtggactatgtcgtcaaaattatcgagcgagatttattacccaagtatcccaatgtggacggtgtggtcgcgctcaatcacctctatggctgtggcgtggcaatcaatgcccctgcggcggtcgttcctatccgcaccattcacaatctggcactgaacccgaattttggcggcgagatactggtggtgggtctgggctgtgaaaaattacagccggaacgcctgctagaaggaacgccagatgtacaggccatctccctcgatgacaccagcattgtccgcttgcaggatgaacaccatgttggtttcagatcgatggtggatgacattctgacgatggcagacaaacacctgcaacgattgaacaaacgtcaacgtgaaacctgtccagcatcagagttggttgtcggtatgcagtgtggcggcagcgatgctttctctggcgtcaccgctaacccagccgttggttttgcatctgacctgctggtacgttgcggcgcaaccgtcatgttctccgaagtgaccgaagtacgcgacgctatccatctgctaacaccacgcgtcatcaatgaagaggtcggtaaacgtctgttggaagaaatggcctggtacgataactacctcgacagcggccagaccgaccgtagcgccaacccatcgccgggcaacaaaaaaggtggcctcgcgaacgtggtggaaaaagcactcggctctatcgccaaatccggcaccagcgcaattgtcgaagtcctgtcccccggccagcgccccaccaaacgcgggttgatttacgcagcaacaccagccagcgactttgtgtgtggtacccagcagctcgcttccggcatcaccgtacaggtcttcaccaccggtcgcggtacgccctatggtctgctggccgtacccgtgatcaaaatggcgacccgtaccgcgttggcaaaccgctggcacgatctgatggatattgatgccggtacgattgcaaccggagacgccacgatcgaagacgtcggctggcagctttttcatttcattttggatatcgctagcagcaagaaaaaaacctggtccgatcaatgggggcttcataatgcccttgccgttttcaacccagccccagtaacctga

SEQ ID NO: 106294 - protein, 524 aa, Erwinia carotovora subsp
MSDKSESNAAQEQPLYIKVHDSDNVAIVVNNNGLRAGTRFNDNLELIEHVPQGHKVALVDIAKSGAIIRYGEIIGYALRDIAKGSWIDESVVELPQAPALETLPLATNIPPSLPPLEGYTFEGYRNADGSVGTKNLLGITTSVHCVAGVVDYVVKIIERDLLPKYPNVDGVVALNHLYGCGVAINAPAAVVPIRTIHNLALNPNFGGEILVVGLGCEKLQPERLLEGTPDVQAISLDDTSIVRLQDEHHVGFRSMVDDILTMADKHLQRLNKRQRETCPASELVVGMQCGGSDAFSGVTANPAVGFASDLLVRCGATVMFSEVTEVRDAIHLLTPRVINEEVGKRLLEEMAWYDNYLDSGQTDRSANPSPGNKKGGLANVVEKALGSIAKSGTSAIVEVLSPGQRPTKRGLIYAATPASDFVCGTQQLASGITVQVFTTGRGTPYGLLAVPVIKMATRTALANRWHDLMDIDAGTIATGDATIEDVGWQLFHFILDIASSKKKTWSDQWGLHNALAVFNPAPVT

SEQ ID NO: 106295 - DNA, 1491 bp, Erwinia carotovora subsp
  CDS (1)..(1491)
atgcaaagtattataaaaattcattctctggacaatgtggctgtcgccctgcgtgatgtcgagcaaggcgagacggtgtcggtggatagccatacggtgacacttcagcaacctgtcgtgcgtggacataagttcgcgctagaaaccatcgcaccgagagaaatgattaccaagtatggcctgccgatcggccatgcattggtgtctattgctcccggagaacatattcactcccagaacgcgaaaaccaatctgagcgatctggatgaatatgagtaccagcctgaatttctcgaattgccgtcacagatgggcgatcgggacgtgcagctttatcgccgcaaaaatggcgatgttggtatccgtaatgaactgtggatcctgccaaccgtcggctgtgtgaacgggattgctcgccagattcagcagcgcttcctgaaagaaaccaatgatgctgaaggtatcgacggcgtttacctgtttagccataccttcggctgttcacagctcggtcaggatcacgagaatacccgcacgatgctgcaaaacatggtgcgtcacccgaatgcgggggcggtgttggtgatcggtctgggctgtgagaacaatcaggttgacgcgttccgcagcacattgggtggttttgattctgaccgcgtcacgttcatggtatgtcagcagcaggacgatgaggttgaagccggtcttgagcgtctgcacacgttgtatgaagcgatgcgccatgacaaacgcgagccgggtaagctgagcgagctgaagtttggtttggaatgcggcggttccgatggattatccggtattactgccaacccgctgttaggtcgtttctccgactatctgatcgccaatggcggcaccactgtgctgaccgaagtgccggaaatgttcggtgcggaacgtattctgatgagccgctgccgtgatgaagccacgtttgagaaaaccgtgcacatggtgaatgacttcaaacagtacttcatcgcgcacaaccagccgatttatgagaacccatcgccgggtaacaaggcgggcgggatcactacgctggaagagaaatcactgggctgtacgcaaaaagcggggcagagcaaggtggtggatgtgctgaaatatggtgagcgcttacacaccccagggcttaacttgctcagcgcgccggggaatgatgccgtagcaaccagcgcgctggcgggcgcggggtgtcatatggtgctgttcagtaccgggcgcggcacaccttacggcggatttgtccctaccgtaaaactggcgaccaacagcgagctggcgaagaagaaaccgcactggattgatttcgatgcgggacgtctgatccacgacatgccgatggatgaactgctgagtcagtttgtagaactgattgtggagactgctgacggtaagcagacgaagaatgaagtaaacgacttccgtgaattagccatatttaagagcggcgtaacgttgtaa

SEQ ID NO: 106296 - protein, 496 aa, Erwinia carotovora subsp
MQSIIKIHSLDNVAVALRDVEQGETVSVDSHTVTLQQPVVRGHKFALETIAPREMITKYGLPIGHALVSIAPGEHIHSQNAKTNLSDLDEYEYQPEFLELPSQMGDRDVQLYRRKNGDVGIRNELWILPTVGCVNGIARQIQQRFLKETNDAEGIDGVYLFSHTFGCSQLGQDHENTRTMLQNMVRHPNAGAVLVIGLGCENNQVDAFRSTLGGFDSDRVTFMVCQQQDDEVEAGLERLHTLYEAMRHDKREPGKLSELKFGLECGGSDGLSGITANPLLGRFSDYLIANGGTTVLTEVPEMFGAERILMSRCRDEATFEKTVHMVNDFKQYFIAHNQPIYENPSPGNKAGGITTLEEKSLGCTQKAGQSKVVDVLKYGERLHTPGLNLLSAPGNDAVATSALAGAGCHMVLFSTGRGTPYGGFVPTVKLATNSELAKKKPHWIDFDAGRLIHDMPMDELLSQFVELIVETADGKQTKNEVNDFRELAIFKSGVTL

SEQ ID NO: 106297 - DNA, 1548 bp, Acinetobacter sp
  CDS (1)..(1548)
atgttaaagccaattctaattcaaattaatccacttgataatgtcgcaatagtggtcaacgaccatggtttagaaaaacaaaccgttattgaagaatatcaactaactttggtcgatgatgttcctcaaggacataaagtattattaaaagcattaaaaaaagatgaggcaattattcgctatggtgaaatcatcggatatgcaaatgcagatctggaagcaggtcgttgggttaatgaatctgtaacccgtatgcctgaggcaccagagctcgacaaacttgaactggcaactcgtcctgcacagccgttagaatctcttacaggatttacttttaaaggctataaaaataaagatggcagcgttggaaccaaaaatattttagggattaccaccagcgtgaactgtgtagaaggtattgtcgattatgtggttaaaattatagagcgagaactattatctaaatatccaaatgttgatggtgtagtcggattaaatcatttatatggttgtggcgtcgccattgatgcacctgcggctattgtcccaattcgtaccattcataatctggcgctaaatccaaattttggcggtgaaattatggtagtcagtttaggctgcgaaaaaatgcaacccgaacgtcttttaaatatgaccgcagaaaacaaacgtattgccttagcagatgaagatattattcagttgcaagatgaacgacatcacggctttgaaagtatggtcgcacatattttaacggtggcagaacagcatcttgaaaaattgaaccagcgccagcgtgaaactgtagatgcatcacatttagtggttggtatgcaatgcggcggtagtgatgctttttcaggtgtaacgtcaaatccagcagtgggttttgcaacagatttaattgttcgctgtggaggaacggtcatgttttcagaagttactgaagtccgcgacggtattcatttacttaccccacgtgcagcaaatgaagatgtcgctaaagatctcattcgagaaatgcaatggtacgatgactacttaactgcaggtaaagtagaccgtagtgccaacaccactcctggcaataaaaagggtggactgaataatattgtagaaaaggccatgggctcaattgccaagtcgggtacatcttcaattgttgaggtgttatcaccaggccaaagacccagtaaaaagggcttaatctttgcagcaacgccatcaagtgattttatttgcggtacacaacaaatggcctcaggaattacggttcaggtttttacaactggacgcggtacaccctacggattagctgcggttcctgtcattaaaatggccagtcgtaacaacattgcaaatcgctggtacgacttaattgatattagtgctggagatattgcagtaggtaaaaaaaccattgaagacgttggctgggagctctttgaaatgattttacgtgtcgcgagtggtgaacaacaaacctggtctgatcgctggggcattcataattctcttgcagtatttaatcctgctcctgttacctga

SEQ ID NO: 106298 - protein, 515 aa, Acinetobacter sp
MLKPILIQINPLDNVAIVVNDHGLEKQTVIEEYQLTLVDDVPQGHKVLLKALKKDEAIIRYGEIIGYANADLEAGRWVNESVTRMPEAPELDKLELATRPAQPLESLTGFTFKGYKNKDGSVGTKNILGITTSVNCVEGIVDYVVKIIERELLSKYPNVDGVVGLNHLYGCGVAIDAPAAIVPIRTIHNLALNPNFGGEIMVVSLGCEKMQPERLLNMTAENKRIALADEDIIQLQDERHHGFESMVAHILTVAEQHLEKLNQRQRETVDASHLVVGMQCGGSDAFSGVTSNPAVGFATDLIVRCGGTVMFSEVTEVRDGIHLLTPRAANEDVAKDLIREMQWYDDYLTAGKVDRSANTTPGNKKGGLNNIVEKAMGSIAKSGTSSIVEVLSPGQRPSKKGLIFAATPSSDFICGTQQMASGITVQVFTTGRGTPYGLAAVPVIKMASRNNIANRWYDLIDISAGDIAVGKKTIEDVGWELFEMILRVASGEQQTWSDRWGIHNSLAVFNPAPVT

SEQ ID NO: 106299 - DNA, 1182 bp, Picrophilus torridus
  CDS (1)..(1182)
atgaaagatgtttttctcggctatgaaagatccaatggcttcggcacaagaaatcatattttaataataccaactgtaacctgctctgaatttacagtgaggaggatagccagggaatcattaaaatattataataatcccgatggcagcatcaaggtactaaacaatccatatgggtgtggccagacaggggaagatctagagcagaccacaaggaccctaataaacatgggaattaatccaaatgtttcaggagtactggtattaagcctgggatgtgaaagtgttgattataataaagttgctgatgaaatatcaaaatacaaaccagtaaactttttaagaatacaggattatggcggtttaaaaactgttgaaactggtatagaaaaaatcaaagaccttgcagcaaatgcaattaaagagaagcgaaatgaaacagacctaaaaaatattaccgctggacttgaatgcggtggttcagactttaccagtgggcttgcatcaaatcctgtagttggaaaagtatccgactggataataaataacggtgggagtacaatcataagcgaggtaccggaatttattggtgccgagcacctatacgcggccagggctgtaaacgaggatgtcagagcccagatctttaaaactgtatatgcctttgaaaagaagttaaaggaagaggcaagagtagacttcagaaagggacagcccacaccaggaaatatggagggtgggctaacaaccatagaggaaaaatctctcggtgctgttaagaaatcagggtcggcaaaggtttcaggagttttaaaatatggtgaaaggctttcaaagcccgggcattatctgatgaatacaccaggatacgatgttgaatcggtatccggcgaagtcgcaggcggggcaaatatagtaatgtttaccactggcaggggaacacccacgggaaatataatttctccggtaataaaaataaccgcaaatgaggagacatttaaaaaaatggaggatattatagattttgatgcaagtcccataatgcgaggagatgagaccatagaatccgcctcagaaaggctcaaaaaattattaatagaaactgcaaacggaaggcttacaaaggccgaaataaatgagcaagatgattttgcaatatacagaattgggccaacatactaa

SEQ ID NO: 106300 - protein, 393 aa, Picrophilus torridus
MKDVFLGYERSNGFGTRNHILIIPTVTCSEFTVRRIARESLKYYNNPDGSIKVLNNPYGCGQTGEDLEQTTRTLINMGINPNVSGVLVLSLGCESVDYNKVADEISKYKPVNFLRIQDYGGLKTVETGIEKIKDLAANAIKEKRNETDLKNITAGLECGGSDFTSGLASNPVVGKVSDWIINNGGSTIISEVPEFIGAEHLYAARAVNEDVRAQIFKTVYAFEKKLKEEARVDFRKGQPTPGNMEGGLTTIEEKSLGAVKKSGSAKVSGVLKYGERLSKPGHYLMNTPGYDVESVSGEVAGGANIVMFTTGRGTPTGNIISPVIKITANEETFKKMEDIIDFDASPIMRGDETIESASERLKKLLIETANGRLTKAEINEQDDFAIYRIGPTY

SEQ ID NO: 106301 - DNA, 1500 bp, Photobacterium profundum
  CDS (1)..(1500)
atgcctgacatgaaagcatggattaaggtaaacaagaaagacaatgttattgttgcattgaaacgtctgcatagtaacaccaacatagtaatatcaggacgtaaaatatcgttaaaacaagaggttgaaaaagggcacaagattgctgtatccgatattaagcaaggacaaatgctcatcaaatatggtgagtattttggccatgcaacaaaaaatattgatgcaggagaatgggttcatagccacaacgtcaaaactaacttacataataaaaacaattatcagtacacccccgtctccgctgccgtattgaaccgttctttagatagaaacgttcaaatttatagacgcgccaatggtgatgtaggggttagaaatgagctttggatcataccgacagtaggatgtgtaaacggtatcgctcagatgatagttaaagcctttatggcgcaatatgatacttcgattattgacggagtacacatatttacacatcaatttggctgttctcaattgggggatgatcatataaaaaccaagcaactgcttcagaatatggtcacacatcccaatgctggtggcgtgttggtcctcggattgggctgtgaaaacaatcagataacaccttttaaacaagggcttaaaggtatagacgaatctaggattcaattcatggtggcccaacatcataacgatgaaattcaggcaggggtcgaccatctagcctctatattggaaagtatgagcggcgataaaagagtagaaggtaaactatcggaactccgcttcggactagaatgcggaggaagtgatggtttatctggaattactgctaatccacttctaggcgccttttctgataccgttattgccaatgaaggcaccaccgtactgacagaagttcccgaaatgtttggcgcagaatcattactgatgaatcgcgctaaaaataaagaagttttcagcaaaatcgtagacatgattaacgtctttaaagattactatcttcagcacaatcttcccatttatgaaaatccatcaccgggaaataaagcaggtgggatttcgacactcgaggataaatctctcggttgtactcaaaaggcaggaaccagtcagatcattgatattcttgaatatacacaaaaaatatccaaatcgggccttaacttattaagtgcaccaggtaatgatgcgatagcaaccagtgcattagccgcatctggctgccagctagtattattttctactggtagaggaacaccctacggcggttttgtacccacagtaaaaattgcaacaaatactgatttggcaaagcgaaagccacattggatcgacttcaatgctggtgtgttaattagcgaagatattgacatgggaagtttgttaaacctatttttagacaaagtagctaccatcgccagtggagagctcaccaagaacgaagtaaatgatatacgcgagctagcaatttggaagaacggtgtcactttatag

SEQ ID NO: 106302 - protein, 499 aa, Photobacterium profundum
MPDMKAWIKVNKKDNVIVALKRLHSNTNIVISGRKISLKQEVEKGHKIAVSDIKQGQMLIKYGEYFGHATKNIDAGEWVHSHNVKTNLHNKNNYQYTPVSAAVLNRSLDRNVQIYRRANGDVGVRNELWIIPTVGCVNGIAQMIVKAFMAQYDTSIIDGVHIFTHQFGCSQLGDDHIKTKQLLQNMVTHPNAGGVLVLGLGCENNQITPFKQGLKGIDESRIQFMVAQHHNDEIQAGVDHLASILESMSGDKRVEGKLSELRFGLECGGSDGLSGITANPLLGAFSDTVIANEGTTVLTEVPEMFGAESLLMNRAKNKEVFSKIVDMINVFKDYYLQHNLPIYENPSPGNKAGGISTLEDKSLGCTQKAGTSQIIDILEYTQKISKSGLNLLSAPGNDAIATSALAASGCQLVLFSTGRGTPYGGFVPTVKIATNTDLAKRKPHWIDFNAGVLISEDIDMGSLLNLFLDKVATIASGELTKNEVNDIRELAIWKNGVTL

SEQ ID NO: 106303 - DNA, 1905 bp, Rhodopirellula baltica
  CDS (1)..(1905)
atgcccatccaaaaccggcacgccggcggttcggaaaagctgtttgccttgatactcgtgaattttcatcgggggttcagcccagttggcaagcgaaaggaatgcgaaggtacgtctcctcgccatgatggcgagcgagtccggggtctgtcagactgcccagaagtgaaaatggtagcagctcggaaaattccaaccaccaccgctctattgatgactggcaccgacccacaatccgcctcctcgccaaaccgtaacgccaacgcggaaggtcccggagcagccggtccaacgatgaatgatttggctggcggcataccaaacggaaccgaccacggagtcgtccgactgcacgacggcgacaacgtttggatggccgcgtgggccttggtggcaggcgaaacgatcggcaacctccgcatcgcagggtcggccgttcccgccggacacaaagtcgccgcccaagcgattcccgccggcgaattggtgatcaagtttggccaaccgatcggcaaagcatcctgcgacatcggcgtcggtgaacacgtgcactcgcacaatttggtcgacgctcaccaagtcgactcggattggcgttcgctggtcggaaccgctttctcaaaatccgctcctgcaaaaaagccagccgttccagccgagaagacctttgaggggtttgtgcgaccggacggccaagtcggcacgcgaaactacgttcagattctggctcgcgtgaactgcagtgcgacggtttgccaccatgtcgcggctcggtttcctcccgaacgcttggccgaattccccaacgtggatggaatcgcgatcgggacgcacaccaccggctgcgcccttcgctacgccggccaaaaacagcaaatgctcggccgagtcctcaagggctacgccggtcacgcgaatgttggatcttgcctgacgatcggattgggctgcgaacaaacgacgcccgagtacctgagcgaacatcaccagctcgtcgcgatctccgaccctcgttcgctgccggtcacctcgcccgaatcagaatcggtctcgacgaccatgctgaccatgcaagccgaaggcggcacgcgagcgacgatcgatcgtgcggaaaagcatctcgaaacgatgctcgagatcgccaaccaaaattcgcgaaccacagtcccggctcatcaccttcgactcgctctggagtgcggcggcagcgatggccattcgggatggaccgcgaatccgttggtcggtgcgatcgctgatcgcatggtggcttttggtggtgcggccgtgctcagcgagaccacggaactgatcggtgccgaacatttgctggtcgctcgttcgcgtgacgaatcagtggcccagcgtttgatggacaaagtcgattggtggaagaagcatgtggcaatgtatggcggcgagatcgacaacaacccatcgatcggcaacaaagccggtgggctgaccacgatcactgaaaaatcactcggtgcagtcagcaagtccggaacgggaatcctcgacggtgtcctggactacgcggacacggttcccaaacaaggcttgtacgtgatggactcgccgggctttgatccgtccagcgtcacgggcaaggtcgctggcggttgcaacctagtgttgttcaccaccggccgcggaagttgcttcggcggcaaaccggttcccgtgatcaagatcgccagccattccactttgttccacgccatgcgagacgacatggactggaacgcgggccagttgctcgagggtgtcgcgatggaagagctcgcagatcaactgttcgaagagttgctgcgattcgccagcggaacacaaacggccagcgaacgcctcgggttgggcgatcacgaatttgtaccgtggacggtcgggccggtgctgtga

SEQ ID NO: 106304 - protein, 634 aa, Rhodopirellula baltica
MPIQNRHAGGSEKLFALILVNFHRGFSPVGKRKECEGTSPRHDGERVRGLSDCPEVKMVAARKIPTTTALLMTGTDPQSASSPNRNANAEGPGAAGPTMNDLAGGIPNGTDHGVVRLHDGDNVWMAAWALVAGETIGNLRIAGSAVPAGHKVAAQAIPAGELVIKFGQPIGKASCDIGVGEHVHSHNLVDAHQVDSDWRSLVGTAFSKSAPAKKPAVPAEKTFEGFVRPDGQVGTRNYVQILARVNCSATVCHHVAARFPPERLAEFPNVDGIAIGTHTTGCALRYAGQKQQMLGRVLKGYAGHANVGSCLTIGLGCEQTTPEYLSEHHQLVAISDPRSLPVTSPESESVSTTMLTMQAEGGTRATIDRAEKHLETMLEIANQNSRTTVPAHHLRLALECGGSDGHSGWTANPLVGAIADRMVAFGGAAVLSETTELIGAEHLLVARSRDESVAQRLMDKVDWWKKHVAMYGGEIDNNPSIGNKAGGLTTITEKSLGAVSKSGTGILDGVLDYADTVPKQGLYVMDSPGFDPSSVTGKVAGGCNLVLFTTGRGSCFGGKPVPVIKIASHSTLFHAMRDDMDWNAGQLLEGVAMEELADQLFEELLRFASGTQTASERLGLGDHEFVPWTVGPVL

SEQ ID NO: 106305 - DNA, 1554 bp, Pseudomonas syringae
  CDS (1)..(1554)
atgaacctgattcaacatgccgactctccgcgctacatccggctgcacccgctggataacgtcgtggtcgtggtcaacgaccagggtgtaccggccggaaccgaattcgacaacggcctggtgacggtcgataacgtgccgcagagccacaaggtcagcaccgttgacctggccgtgggcgaggccattattcgttatggtcacaccatcggttacgcgctgcagccgataccgcgtggcagttgggtcagggaagaccagttgcgcatgccgtctgcgcctgcgctcgacagcttgccaatgtccgatgcggtgcccgagaaacaggcagcgctggagggttataccttcgagggctaccgcaacgccgacggcacggtgggcacccgcaacattctggggatcaccaccaccgtgcagtgcgtgaccggcgtgctggaccatgcagtcaaacgcattcgtgacgaactgctgcccaaataccctaacgtcgatgacgtagtggccctgacccacagctacggctgcggcgtggccattaccgccaccgacgcttacattccgatccgtaccgtgcgcaatctggcgcgcaacccgaacctgggtggcgaggcgctggtgatcggcctgggctgcgagaaattgcaggccgggcaggtcatgcatgaggacgacagctcggtggacctgagcgagccgtggttgtatcggcttcaggattccagccacggcttcaacgaaatgatcgagcagatcatggaactggccgagacgcgcctcaagaaactggatgtgcgtcgccgcgaaacggttccggcctccgagctgattctgggcatgcagtgcggcggcagtgatgcgttctccggcattaccgccaacccggcgctgggctatgcctcggatctgctgttgcgtgcaggggcgacggtgatgttttccgaagtgaccgaggtgcgcgatgccatttacttgctgacctcccgcgcgcaggatcaggacgtcgcgcaggcgctggtacgggaaatggactggtacgaccgttacctggccaaaggtgaggcggatcgcagcgccaacaccacgcccggcaacaagaagggcgggttgtcgaacattgtcgagaagtccctggggtcgatcgtcaaatccggcagcagcgccatcaatggcgtgcttggcccgggggagcgcgtcaacagcaagggtttgatcttctgcgccacgcccgccagtgactttgtctgcggtacgctgcaactggccgccgggatgaacctgcacgtgttcaccaccgggcgcggcactccgtatggtctggcgatggcgccggtggtgaaggtctcgacccgcaccgaactggcccagcgctggcctgacctgatcgatatcgacgccggacgcatcgccacggggcgtgcgagcatcgaagatctcggctgggagctgtttcacttctacctggatgtggccagcggcaagaaaaagacctggaccgagcactaccgtttgcacaacgacatcaccctgttcaacccggcaccgatcacctga

SEQ ID NO: 106306 - protein, 517 aa, Pseudomonas syringae
MNLIQHADSPRYIRLHPLDNVVVVVNDQGVPAGTEFDNGLVTVDNVPQSHKVSTVDLAVGEAIIRYGHTIGYALQPIPRGSWVREDQLRMPSAPALDSLPMSDAVPEKQAALEGYTFEGYRNADGTVGTRNILGITTTVQCVTGVLDHAVKRIRDELLPKYPNVDDVVALTHSYGCGVAITATDAYIPIRTVRNLARNPNLGGEALVIGLGCEKLQAGQVMHEDDSSVDLSEPWLYRLQDSSHGFNEMIEQIMELAETRLKKLDVRRRETVPASELILGMQCGGSDAFSGITANPALGYASDLLLRAGATVMFSEVTEVRDAIYLLTSRAQDQDVAQALVREMDWYDRYLAKGEADRSANTTPGNKKGGLSNIVEKSLGSIVKSGSSAINGVLGPGERVNSKGLIFCATPASDFVCGTLQLAAGMNLHVFTTGRGTPYGLAMAPVVKVSTRTELAQRWPDLIDIDAGRIATGRASIEDLGWELFHFYLDVASGKKKTWTEHYRLHNDITLFNPAPIT

SEQ ID NO: 106307 - DNA, 1554 bp, Pseudomonas putida
  CDS (1)..(1554)
atgcagttgatcgaacattccgactcgccccgctacgtccgcctgcacgacgacgacaacgtcgtggtcgtcgtcaacgacggcggcttgggcgaaggcgcccgcttcgccgacggcctgaccctgatcgaaggcgtgccgcaaagccataaggtggccaccgtgtccatcgccaagggcgagcccgtgcgccgctacgggcaaatcatcggctacgcgctggaagacctgcgccaaggcagctgggtgcaggaaagccagctggccatgccggccgccccggaactggacagcctgccgcgctgcgatgcagtgccacaaccgctgccgccgctggagggcttcaccttcgagggctatcgcaacgccgacggcactgtcggcacccgcaatatcctcggcatcaccaccaccgtgcagtgcgtgaccggcgtgctggaacatgcagtcaagcgcattcgcaacgaactgctgcccaaataccccaacgtcgatgacgtggtggccattacccacagctacggctgcggtgtggcaatcaacgcccgcgacgcttacatcccgatccgcaccgtgcgcaacctggcgcgcaaccctaaccttggcggcgaggcactggtgatcagcctgggctgtgaaaaactgcaagccagccaggtgatgcacgacaacgacccttcggtggacctcagcgacccatggctgtaccgccttcaagatgccagccttggctttgttgaaatgatcgagcagatcatggacctggccgaaacccgcctgaagaagctcgaccagcgccgccgcgaaacggtcccggccagcgaactgatcctcggtatgcaatgcggtggcagcgacgccttctcgggcatcaccgccaacccggcactgggctatgccgccgacctgctggtccgcgctggcgccaccgtgctgttctctgaagtgaccgaggtgcgcgacgcgatctacatgctgacctcgcgcgcggaaaaccaggacgttgccgacgcgctggtgcgcgaaatggactggtacgaccgctacctgcagcaaggcgccgccgaccgcagcgccaacaccacaccgggcaacaagaaaggcgggctgtcgaacatcgtcgagaaatcgctgggttcgatcgtcaagtcgggcagcggcgctatccagggtgtgctcggcccaggcgagcgggccaaccgcaaaggcctgattttctgcgccaccccggccagcgactttgtctgtggcaccttgcaactggcggccggcatgaacctgcacgtcttcactaccggccgcggcaccccgtatggcctggccatggcgccggtggtcaaggtgtgtacccgcagcgaactggcccagcgctggcccgacctgatcgacatcgacgccggtcgcatcgccagtggtcgctcgaccatcgaggagctgggttgggagctgttccattactacctggacgtagccagcggtcgcaagcagacctgggccgaacaacaccggctgcacaacgacatcaccctgttcaacccggcgcccattacctga

SEQ ID NO: 106308 - protein, 517 aa, Pseudomonas putida
MQLIEHSDSPRYVRLHDDDNVVVVVNDGGLGEGARFADGLTLIEGVPQSHKVATVSIAKGEPVRRYGQIIGYALEDLRQGSWVQESQLAMPAAPELDSLPRCDAVPQPLPPLEGFTFEGYRNADGTVGTRNILGITTTVQCVTGVLEHAVKRIRNELLPKYPNVDDVVAITHSYGCGVAINARDAYIPIRTVRNLARNPNLGGEALVISLGCEKLQASQVMHDNDPSVDLSDPWLYRLQDASLGFVEMIEQIMDLAETRLKKLDQRRRETVPASELILGMQCGGSDAFSGITANPALGYAADLLVRAGATVLFSEVTEVRDAIYMLTSRAENQDVADALVREMDWYDRYLQQGAADRSANTTPGNKKGGLSNIVEKSLGSIVKSGSGAIQGVLGPGERANRKGLIFCATPASDFVCGTLQLAAGMNLHVFTTGRGTPYGLAMAPVVKVCTRSELAQRWPDLIDIDAGRIASGRSTIEELGWELFHYYLDVASGRKQTWAEQHRLHNDITLFNPAPIT

SEQ ID NO: 106309 - DNA, 1542 bp, Pseudomonas putida
  CDS (1)..(1542)
atgcaactgattgccaaatccggtgaccccgccgtcatccgcctcaaccctttggacaacgtcgtcatcgcccgccaggccctgctgccaggcgtgcgcctggatgccgaggcgattaccgtgcgccagcccatcccttcaggccacaagctcgccaccgagcctgtggcgcaaggccagccgttgcgccgttacgggcagatcatcggatttgcgtcccaggcgatcgacgctggcgaccatgtgcatgtgcacaacgtgcagatgggcgattttgcccgcgactatgcgtttggtgtcgatacccgcagcctgccaggcagcgccgcgcagttccagggcatcgtgcgcgccgatggccgtgtcgccacccgcaactacatcggcattctcacctcggtgaactgttcggcgaccgtggcccgggccgtggccgaccatttccgccgtgacattcaccccgaggtgctggccgactacccgaatgtcgacggtgtggtcgccctgagccacagtgccggttgcgcagtcgacccgagcggtgaagccctgggcctgttgcgccgcaccctggccgggtacgccgtccaccccaacttcgctgccgtgctgatcatcggcctgggctgcgaaaccaaccagatcgaaaccctgctggaaacccagggcctgcaggcgagtgcgcaactgcgcgcctttaccatccaagggatcgggggcacttcgaaaaccatcgctgccggtatcgcccaggtcaaggcgctgttggccgaggccaatcaggtacggcgccagccggtcagtgcccgccacctggtggtcggcctgcagtgcggcggctcagatggctattcggggatcaccgccaacccggcactgggcaatgccgttgaccgcctggtggccgccggtggtaccgccattctctccgaaaccccggaaatctatggtgccgagcacttgctcacgcgccgcgcggtaagccgtgaggtgggggagaagctggtggcgcgcattcgctggtgggaagactactgccagcgtatgaacgccgaattgaacaacaacccctcggccggcaacaaggcaggggggctgaccactatcctcgagaaatccctgggcgcagtggccaaggcaggctccagcaacctggtcgatgtgtatcagtacgcgcaagccgtgcgtgcccagggcctggtgttcatggacacccccggctacgacccggtctcggccaccggtcaggtggccggcggggccaacctgatcgccttcaccaccggccgcggctcggcctacggctgtgccccggcgccatcgatcaagctggcaaccaacaaccgggtgttcgagcaccagcaagaggacatggacgtcaattgcggcggcatcgccgatggctccaccagcatcgaggagcgcggcgcattcatcttcgagcagatgctgcgcattgcctccggggaacgcagcaagagcgaacagcacggctacgggcaaaacgagttcgtcccgtggcagatcggcgccgtgacctga

SEQ ID NO: 106310 - protein, 513 aa, Pseudomonas putida
MQLIAKSGDPAVIRLNPLDNVVIARQALLPGVRLDAEAITVRQPIPSGHKLATEPVAQGQPLRRYGQIIGFASQAIDAGDHVHVHNVQMGDFARDYAFGVDTRSLPGSAAQFQGIVRADGRVATRNYIGILTSVNCSATVARAVADHFRRDIHPEVLADYPNVDGVVALSHSAGCAVDPSGEALGLLRRTLAGYAVHPNFAAVLIIGLGCETNQIETLLETQGLQASAQLRAFTIQGIGGTSKTIAAGIAQVKALLAEANQVRRQPVSARHLVVGLQCGGSDGYSGITANPALGNAVDRLVAAGGTAILSETPEIYGAEHLLTRRAVSREVGEKLVARIRWWEDYCQRMNAELNNNPSAGNKAGGLTTILEKSLGAVAKAGSSNLVDVYQYAQAVRAQGLVFMDTPGYDPVSATGQVAGGANLIAFTTGRGSAYGCAPAPSIKLATNNRVFEHQQEDMDVNCGGIADGSTSIEERGAFIFEQMLRIASGERSKSEQHGYGQNEFVPWQIGAVT

SEQ ID NO: 106311 - DNA, 1542 bp, Bradyrhizobium japonicum
  CDS (1)..(1542)
atggaccagtcagtcgcagcgaaagagcagtcccgctacatcaagctcaacgagcgcgacaatgtcgcgatcgtggtcaatgatttcgggcttcccgccggctcccgcttcgcctgcggcctgacactgcgcgccttcgtgccgcaggggcacaagacggcgctggtcgacatcgcggaaggcacaccgatcatccgctatggcgaggtgatcggctacgcgctctcgccgatcctggccggcgaatgggtggatgaggcgcgcattcgcatgccggaggcccctgccctcgacaagctggaaatctcgaccgccgtgcccgctccgctgccgccgctcgaaggcttcaccttcgagggctaccgcaatccggacggctcggtcggcaccaagaacatcctcggcatctcctcctccgtgcaatgcgtcaagggcacgatggaatatgcggtgaagcgcatccgcgccgagctcttgccgaaatacccgaacgtcgacgacgtcgtgccgctgacgcacgcctatggctgcggcgtcgccattaacgcgcccgacgcggtggtgccgatccgcacgctgcagaacctcgcgctcaaccccaatttcggcggcgaaattctggtcatcagcctcggctgcgagaagctcgcgcccgagcggctggtgccggaaggcatcagcgatgccatcgtccgcatgcaggacgaagccttcgacggttttggcgcgatcgtcgatgcgatcatgacacaggccgaagcgcgcctgaagattctcaacaagcgcacccgcgagacctgcccggcctccgatctcgtcatcggcctgcaatgcggcggcagcgacgcgttctccggcgtcaccgcgaaccccgcggtcggctttgccgccgacctcctagtgcgcgccggcgccaccgtgatgttctcggaagtcaccgaggtgcgcgacgcgattcagctcctgacgcgacgcgccatcaacgaggatgtcggacgtgccttggtgcgcgagatggcctggtacgattcctacctagcccgcggcggcgccgaccgcagcgccaacaccacgcccggcaacaagaagggcggcctcgccaacatcgtcgagaaatcattgggctcgatcgtgaagtccggctcgtccgccatcaccggcgtgctctcgcccggcgagaaggcgacgcagaagggcatgctgttcgcggcaacgcctgcctccgacttcatctgcggcacgctccagctcgcctccggcatgaccttgcaggtgttcaccaccggccgcggcacgccctacggccttgcggcagcgcctgtgatcaaggtcgcgacccgcagcgagctcgcgcggcgctggaaggacctgatcgacttcgattcaggcagcatcgccaccggcgagaagaccatcgaggaatgcggctgggacctgttccgcctgatcctcgacgtcgcctccggccgcacaaaaccgtggtcggatcgctggggcatccacaacgacctcacgctgttcaatccggcgccggtgacctga

SEQ ID NO: 106312 - protein, 513 aa, Bradyrhizobium japonicum
MDQSVAAKEQSRYIKLNERDNVAIVVNDFGLPAGSRFACGLTLRAFVPQGHKTALVDIAEGTPIIRYGEVIGYALSPILAGEWVDEARIRMPEAPALDKLEISTAVPAPLPPLEGFTFEGYRNPDGSVGTKNILGISSSVQCVKGTMEYAVKRIRAELLPKYPNVDDVVPLTHAYGCGVAINAPDAVVPIRTLQNLALNPNFGGEILVISLGCEKLAPERLVPEGISDAIVRMQDEAFDGFGAIVDAIMTQAEARLKILNKRTRETCPASDLVIGLQCGGSDAFSGVTANPAVGFAADLLVRAGATVMFSEVTEVRDAIQLLTRRAINEDVGRALVREMAWYDSYLARGGADRSANTTPGNKKGGLANIVEKSLGSIVKSGSSAITGVLSPGEKATQKGMLFAATPASDFICGTLQLASGMTLQVFTTGRGTPYGLAAAPVIKVATRSELARRWKDLIDFDSGSIATGEKTIEECGWDLFRLILDVASGRTKPWSDRWGIHNDLTLFNPAPVT

SEQ ID NO: 106313 - DNA, 1524 bp, Bradyrhizobium japonicum
  CDS (1)..(1524)
atgaccatcagccccgccatccgcctgcatcccgatgatggcgtgctgatcgcgcgcgccagcctgccgcctggaacagcggtggccgacggcgtgacgacggtcgaacgcattccctccggccacaaggtcgcgatcaagccgatcgcggtgggcgagccgatcaagcgctacggccagatcatcggctttgccacggtgccgatcgcgcccggccagcacgtgcacacccagaattgcggcatgggcgatttcgccaaggactatgcctattgcgccgacgtcaagccgacgccgaacttcgacctgccggcgaccttcgaaggcatccgccgcccggacggccgcgtcgccacgcgcaactatatcggcatcctcacttcggtgaattgcagcgcgcatgtcgcgagcctcgtcgccgacgtcttcaagaagaaccccttcagcggcgacaacccgctggccgatttccccaacgtcgacggcgtggtcgcgctgacgcacaagaccggctgcggcatgacgcagaacgagccgctggcgctgctccgccgcacgctcggcggctacgcgcgccacgtcaatttctcccacgtcatcgtgctcggcctcggctgcgaggtgaaccagatcggcggcctgatggaggagcagaagctcgccggccgcctgcgcgcgatggacatccaggaggtcggcggcacccgcaagacggtggaggcgggaattgccttcgtgcgcgaggcgctcgccgacgccaacaaggtgaagcgcgaaacggtgccggcaagcgagctcaccgtggccctgcaatgcggcggctccgacggctattccggagtatcagccaatccggcactgggcgccgccagcgatctcatcgtgcgtcacggcggcaccgtgatcctgtcggagacgccggagacctacggcgccgagcacctgctcacccgccgcgccgtcagccgcgaggtcggcgagaagctggtcgatctcatgcgctggtgggacgcctacaccgagcgcgaaggcgccgagatgaacgccaatccgagccccggcaacaaggccggcggcctcaccaccatcctggaaaagtcgctcggcgcgatggccaaggccggcaccaccaacctcgtcgaggtgctgcgctacgccgagcccatcaccaagaagggtttcgtgttcatggacacgcccggctacgatcccgtcgcggcgaccgggcaggtcgccggcggcgccaatctggtctgcttcaccaccggccgcggcagcgtgttcggctgcaagccggcgccgtcgatcaagctcgccaccaacacgcccatgtacaagcgcatggaagaggacatggacgtcaattgcggcaccatcctcgagggcgaggagagcgtcgagcaatgcggccagcgcatcttcgagctcatcctcaagacggcctcgggacagccgaccaagagcgagagcttcgatttcggcggcgccgagttcgcgccctgggtgctgggcgcgacgatgtag

SEQ ID NO: 106314 - protein, 507 aa, Bradyrhizobium japonicum
MTISPAIRLHPDDGVLIARASLPPGTAVADGVTTVERIPSGHKVAIKPIAVGEPIKRYGQIIGFATVPIAPGQHVHTQNCGMGDFAKDYAYCADVKPTPNFDLPATFEGIRRPDGRVATRNYIGILTSVNCSAHVASLVADVFKKNPFSGDNPLADFPNVDGVVALTHKTGCGMTQNEPLALLRRTLGGYARHVNFSHVIVLGLGCEVNQIGGLMEEQKLAGRLRAMDIQEVGGTRKTVEAGIAFVREALADANKVKRETVPASELTVALQCGGSDGYSGVSANPALGAASDLIVRHGGTVILSETPETYGAEHLLTRRAVSREVGEKLVDLMRWWDAYTEREGAEMNANPSPGNKAGGLTTILEKSLGAMAKAGTTNLVEVLRYAEPITKKGFVFMDTPGYDPVAATGQVAGGANLVCFTTGRGSVFGCKPAPSIKLATNTPMYKRMEEDMDVNCGTILEGEESVEQCGQRIFELILKTASGQPTKSESFDFGGAEFAPWVLGATM

SEQ ID NO: 106315 - DNA, 1491 bp, Bacteroides thetaiotaomicron
  CDS (1)..(1491)
atggaaacaaagtatttaagaattaatcctgccgacaacgttgccgttgccattgttaacctcccggcaggagagcatctatccgtagatggaatagagattacactaaacgaagacattcctgctggacataagtttgcattaaaagattttgcagaaggcgagaacgtaatcaagtacggctaccctatcggtcatgcccgtatggcaaaaaaacagggagactggatgaatgaaacgaatatcaagactaatctcgccggactgttggagtatacctaccatccgactcaggttactctggatatccctcataaaaacctcacttttaaaggctaccgccgtaaaaatggtgatgtcggcgtaagaaatgaaatctggattatcccgactgtaggttgcgttaacggtatcatcggacaactggccgaaggcctgcgccgtgaaacggaaggaaaaggggtagatgccatcgtggctttcccgcacaactacggttgctcacagcttggagacgatcacgaaaacacgaaaaagattcttcgcgatatggtacttcacccgaatgcaggcgcagtactgatagtaggcttgggctgcgaaaacaaccagccggacgtattccgtgaattcttaggagactatgaccaggaccgtgtgaaattcatggtaacccagaaagttggtgacgaatacgaagaaggaatggatattctgcgcgatttatatgccaaagcatccaaagatgaacgtacggaagtacctttgtcagaacttcgtgtcggactgaaatgtggtggttccgacggtttctcaggtatcactgccaatccgttgctgggcatgttctcagacttcctgattgcacaaggcggtacaagcgtgctgactgaagttccggaaatgtttggtgcggaaacaattctgatgaaccgttgcgagaacaaagacctgttcgaacagaccgtacacttgatcaatgacttcaaagaatatttcctgtcccatggcgagcctgtgggtgaaaatccatctccgggaaataaagccggcggcatctccactctggaagaaaaagcactgggatgtacacagaaatgtggtaaaagctatgtatccggcgtgatgccttacggagaacgtctgcaaaagaaaggactgaacctgctttccgccccgggcaatgacctagtagctgctactacccttgccgcaagcggatgccatatggtactctttaccaccggacgtggtactcctttcggcactttcgttccgacgatgaagatttccaccaattctactttggctaaaaacaaaccgggatggattgatttcaatgccggagtcatcgttgagaacgaaccgatggaaaagacttgcgaacgctttatcgagtatgtgattaaagtagcaagcggtgagttcgttaataacgagaagaaaggttatcgtgaaattgccatctttaaaacaggagttacattataa

SEQ ID NO: 106316 - protein, 496 aa, Bacteroides thetaiotaomicron
METKYLRINPADNVAVAIVNLPAGEHLSVDGIEITLNEDIPAGHKFALKDFAEGENVIKYGYPIGHARMAKKQGDWMNETNIKTNLAGLLEYTYHPTQVTLDIPHKNLTFKGYRRKNGDVGVRNEIWIIPTVGCVNGIIGQLAEGLRRETEGKGVDAIVAFPHNYGCSQLGDDHENTKKILRDMVLHPNAGAVLIVGLGCENNQPDVFREFLGDYDQDRVKFMVTQKVGDEYEEGMDILRDLYAKASKDERTEVPLSELRVGLKCGGSDGFSGITANPLLGMFSDFLIAQGGTSVLTEVPEMFGAETILMNRCENKDLFEQTVHLINDFKEYFLSHGEPVGENPSPGNKAGGISTLEEKALGCTQKCGKSYVSGVMPYGERLQKKGLNLLSAPGNDLVAATTLAASGCHMVLFTTGRGTPFGTFVPTMKISTNSTLAKNKPGWIDFNAGVIVENEPMEKTCERFIEYVIKVASGEFVNNEKKGYREIAIFKTGVTL

SEQ ID NO: 106317 - DNA, 1545 bp, Brucella suis
  CDS (1)..(1545)
atgaagaatgtggttgccgcagcggttgcgcccgttatcattctgcatccatcggacgatgttgcggtagcgcgtgtacccgttcgtgctggcgatccgatcgggattgatgagataacggctcgcgaattgatcgggcgcggccacaaggttgcactccgcgccattccggcaggcagggaagtcctgaaatacggacaggtcattggcgtcgctacgagggatattgcgccgggagaacatgtgcatcttcagaatctcgccatgctgccttctgaacatgcacatcaattttccatcgacatcgaagaacacggtatggtgccggacgcggaacgacggcatttcatggggtatgaccgtggggctggcggtgtcggtacgcgcaatttcatcggcgtgatttcgtcggtaaactgttctgccacggtttcgcgctatattgccgattatttcaatcgcatgggcggtttggatggcttcgacaatgtggatggtgtggtggccttgacgcatggcagcggctgcgcactcaacaccaggtcggaaggctaccgccttttgacacgcaccattcagggctatgccaaacatccgaatttcggcggtgtattgttgatcgggcttggatgtgaaaccaaccagattgccccgatcctcgaacattatcggatagaagaaggctcacgcctgcgtgccatgaccatccagcagcatggtggcacacgtaagaccattgatgcggcaatcggtgagatcaaggacatgttgcctatggtcaatgccgcaaagcgcagcccgcaacccttgtcgaatttgaaggttgcgctcgaatgtggtggctcggacgggtattccggcatttccgccaacccggcgctgggttatgcctccgacctgatcgtgcggaatggcggaacaaccgttctttcggaaacgccggagatttatggagccgaacacctcctgacgcggcgcgcggtgacgcctgccgtggcggaaaagctgctgcaacgcatcgattggtggcgcgattatacggcgcgcaacggtgacgaactcaacaataatccatcctatggcaacaagctcggcggtctcaccaccattctggaaaaatcgctgggtgcggtggccaagggcggctccatgccgctcaaggcggtttatgaattcgcggaaaccataacggagcaaggttttgtcttcatggatacgccgggctatgaccctgttgcagtgacggggcaggttgcgggcggatgcaatgttatttgctttaccacaggccggggttcggtctccggtttcaagccgtcaccctgtatcaagatcgccacgaattccgaaatgtatgagcacatgaaggaagatatggacattaattgcggtggcattgtcaccggcaatgagacgatcgaggaagccggcgcacgtatttttgaccatattctcgcggtcgcatccggccagaagacgctgagtgagatttatgactatggcgataacgagttcgtgccgtggcaggtcggtgcggtgacgtaa

SEQ ID NO: 106318 - protein, 514 aa, Brucella suis
MKNVVAAAVAPVIILHPSDDVAVARVPVRAGDPIGIDEITARELIGRGHKVALRAIPAGREVLKYGQVIGVATRDIAPGEHVHLQNLAMLPSEHAHQFSIDIEEHGMVPDAERRHFMGYDRGAGGVGTRNFIGVISSVNCSATVSRYIADYFNRMGGLDGFDNVDGVVALTHGSGCALNTRSEGYRLLTRTIQGYAKHPNFGGVLLIGLGCETNQIAPILEHYRIEEGSRLRAMTIQQHGGTRKTIDAAIGEIKDMLPMVNAAKRSPQPLSNLKVALECGGSDGYSGISANPALGYASDLIVRNGGTTVLSETPEIYGAEHLLTRRAVTPAVAEKLLQRIDWWRDYTARNGDELNNNPSYGNKLGGLTTILEKSLGAVAKGGSMPLKAVYEFAETITEQGFVFMDTPGYDPVAVTGQVAGGCNVICFTTGRGSVSGFKPSPCIKIATNSEMYEHMKEDMDINCGGIVTGNETIEEAGARIFDHILAVASGQKTLSEIYDYGDNEFVPWQVGAVT

SEQ ID NO: 106319 - DNA, 1545 bp, Xanthomonas campestris
  CDS (1)..(1545)
atgatgtccgccacccagcaactgccgcgctggctcagtctgcaagcgcatcctcaggacaacgtcgccatcgtcgtcaacgatggcggtgcgccgccgggcgccacgttccaggacgggatgaccgcgatcgagcacattccgcaaggtcacaagattgcattgcaggcgctgcacaagggcacggcagtgcgccgcctgggcgcggtcatcggcaccgcggccgacgacatcgcacgcggcgcctgggtcagcgagcagttgctggagatgcccaccgcaccggaactggcagcactggatctgacgccgcagccaccggctgccgccgcgccactggacgggtatacgttccagggctatcgcaatcgcgacggcagcgtcggcacccgcaacattctcggcatcatgaccagcgtgcagtgcgtggtgggtgtgctgggccatgcggttgcccggatccgcgccgaactgctgcccaagtaccccaatgtcgatgacgtggtggcgatcaatcatgtctacggctgcggcgtggccatcaccgcgcccgaggccatcattcccatccgcacgctgcgcaatatcgcgcgcagccccaacttcggcgggcaggcattgatcgtgggcctgggctgcgaaaaactcgcgcccgagcgcctgctgccggacgatgccagcgccgacgatagcggcatttatcggctgcaggaggctagcctgggcttcgccgacatggttggctcaatcatgcagatggccgaagaacggctgcgccacctcgacacccgccgccgcgaaaccgtgcccgccagcgagctggtggtgggcatgcaatgtggtggcagcgatgcgttttcaggcgtcactgccaacccgggcctgggcatcgcggccgacctgctggtgcgtgctggcgcgaccgtgatgttttcggaaaacaccgaagtgcgcgatggcattcacctgctggtgccacgcgccgccaatgccgaggtcgccaaggcgctggtgcgcgagatggcctggtatgacgcctacctggcgcgcggccaggccgatcgcagcgccaacaccaccccgggcaacaagaagggcgggctggccaatatcgtggaaaaggcgatgggctcgatcgccaagtccggctcgtcacccatcaacggcgtggtgccgccgggtgagcgggtcaaggggcgcggcttgcagtactgcgccacgccggccagcgattttgtctgcggcaccttgcaggtggccgccggcatgaacctgcacgtcttcaccaccgggcgtggcacgccgtacgggctgggcatggtgccggtgatcaaggtggccacgcgcaccgagctggcgcagcgctggtccgatctgatggatatcgatgccggtggggtggcgagcggggccaagacgctggaccaactcggctgggaactgttccagcgttatctcgatgtagccagcgggcagcgcacctggaccgagcaacaccgcctgtacaacgacctggcgttgttcaatccggcgccgatcacctga

SEQ ID NO: 106320 - protein, 514 aa, Xanthomonas campestris
MMSATQQLPRWLSLQAHPQDNVAIVVNDGGAPPGATFQDGMTAIEHIPQGHKIALQALHKGTAVRRLGAVIGTAADDIARGAWVSEQLLEMPTAPELAALDLTPQPPAAAAPLDGYTFQGYRNRDGSVGTRNILGIMTSVQCVVGVLGHAVARIRAELLPKYPNVDDVVAINHVYGCGVAITAPEAIIPIRTLRNIARSPNFGGQALIVGLGCEKLAPERLLPDDASADDSGIYRLQEASLGFADMVGSIMQMAEERLRHLDTRRRETVPASELVVGMQCGGSDAFSGVTANPGLGIAADLLVRAGATVMFSENTEVRDGIHLLVPRAANAEVAKALVREMAWYDAYLARGQADRSANTTPGNKKGGLANIVEKAMGSIAKSGSSPINGVVPPGERVKGRGLQYCATPASDFVCGTLQVAAGMNLHVFTTGRGTPYGLGMVPVIKVATRTELAQRWSDLMDIDAGGVASGAKTLDQLGWELFQRYLDVASGQRTWTEQHRLYNDLALFNPAPIT

SEQ ID NO: 106321 - DNA, 1560 bp, Ralstonia solanacearum
  CDS (1)..(1560)
atgctgcaggcaacccaggccgatcgcgtgaccgacaacggcccgctgatccggctgaacccggccgacaacgtgctgatcgcccgcgcggcactgtcgctcgggcagccgctgtcgctgggcggcgcgacggtgcggctgcgcgcccaggtgccggccggccacaagatcgccgcctgccgcatcgcgcgcggcgaggcgatccgcaagtacgacaccgtcatcggccgcgccgcgcgcgacatcgagccgggcgagcacgtgcacacgcacaacgtcgagctgatcgatttcgagcgcgaccccggcttctgccaggacgtgcgccccgtcgactacctgcccgaggcgcagcgcgccaccttccagggcatcgtgcggccggacgggcgcgtggccacgcgcaacttcatcggcatcctggcctcggtcaactgctcgtccagcgtcatcaagaacatcgccgcgtggttcacgccgcagcggctggcgccgtttcccaacgtggacggcgtggtcgccttcgcgcagacgagcggctgcggcatgtcttcgccgtcggagcatttcgatgtgctgcgccgcacgctggccggctatgcgcggcacccgaacctggccggcgtgctgatcgtcggcctgggctgcgagcgcaaccaggtggccgatctgatggcctcgcagggcctggagaccggcaagctgatgcacacgctggtgatgcaggagaccggcggcacgcgcgccaccatcgaggcgggcatcgatgccatccggaagatgctgccgcaggcgaacgacgtggcgcgccagccggtgagcgccagccacctgaagatcggcctggagtgcggtggctcggacggcttctcgggcattaccgccaacccggcgctgggcgcggcgatggacctgctggtgcgccacggcggcacggccatcctgtcggagacgcccgagatccatggcgtggaatacatgctgacgcgccgcgcggtgtcgcccgaggtcggccagaagctgctcgaccgcctggcctggtgggagcgctatacgcacggacacaacggtcagttcaacggcgtggtgggcccgggcaaccagcagggcggcctggccaacatcttcgagaagtcgctcggctcggccatgaagggcggcaccacgccgctgcaggccgtctacgaatacgccgagccgatcgatcgcgccggcttcgtcttcatggattcgccgggctacgacccggtcgccgtgacgggccagatcgccagcggcgccaacctgatctgcttcaccaccgggcgcggctcgatgttcggctccaagcccgcgcccaccctcaagctcgccagcaacacgccgatgttcacgcgtctggaggaggacatggacatcaactgcggccgcatcctcgacggcgagcgctcggtggaagcgatggggcaggagatcttcgagcacatcctgcgcgctgcctcgggcgagcgcaccaagagcgaattgctcggtctgggcgatcatgaattcgtgccctggcatatgggcatcgtgagctga

SEQ ID NO: 106322 - protein, 519 aa, Ralstonia solanacearum
MLQATQADRVTDNGPLIRLNPADNVLIARAALSLGQPLSLGGATVRLRAQVPAGHKIAACRIARGEAIRKYDTVIGRAARDIEPGEHVHTHNVELIDFERDPGFCQDVRPVDYLPEAQRATFQGIVRPDGRVATRNFIGILASVNCSSSVIKNIAAWFTPQRLAPFPNVDGVVAFAQTSGCGMSSPSEHFDVLRRTLAGYARHPNLAGVLIVGLGCERNQVADLMASQGLETGKLMHTLVMQETGGTRATIEAGIDAIRKMLPQANDVARQPVSASHLKIGLECGGSDGFSGITANPALGAAMDLLVRHGGTAILSETPEIHGVEYMLTRRAVSPEVGQKLLDRLAWWERYTHGHNGQFNGVVGPGNQQGGLANIFEKSLGSAMKGGTTPLQAVYEYAEPIDRAGFVFMDSPGYDPVAVTGQIASGANLICFTTGRGSMFGSKPAPTLKLASNTPMFTRLEEDMDINCGRILDGERSVEAMGQEIFEHILRAASGERTKSELLGLGDHEFVPWHMGIVS

SEQ ID NO: 106323 - DNA, 1602 bp, Ralstonia solanacearum
  CDS (1)..(1602)
atgtccgaatccacgctggcccccgaggccggcaccgaaaccgagaaagcgctgaccatccgcgtgcacgacagcgacaacgtcgccatcgtcgtcaacgcgcgcggcctgcccgcgggcaccgcgctggccgatggcaccgtgctggccgagggcgtgccgcagggccacaaggtggcgctggccgacctggccgaaggcgacgcggtggtccgctacggcgaggtgatcggctacgccgtcaaggcgctgccgcgcggcagctgggtcaatgagcacgcggtgcgcctgccgtccgccccggcgctggacgacctgccgctggccacgcgccccgatcccgggctgccgccgctgcagggctacaccttcgagggctaccgcaatgccgacggcacggtcggcaccaagaacgtgttgggcatcatgaccagcgtgcaatgcgtggccggcgtgaccgaccacgtggtggcccgcatcaagcgcgagctgctgccgcgctatcccaatgtcgacgacgtggtcgcgctcaaccacgcctatggctgcggcgtggccatcaacgccccggcggccatcgtgccgatccgcacgctgcagaacctggcgctcaacccgaacttcggcggcgaggtgatggtgatcggcctgggctgcgagaagctcgtacccgagcgcctggtgcccgagacgctcgcgccgggcgggcgcattcccatcgaggtggcgggcaccgcggattcgcccgtgctgcgcctgcaggacgaagccttcgacggcttcaccggcatggtcgaggccatcctggaaatggccgagcgccgcctggcgcagctgaacacgcgccggcgcgagacctgcccggcctccgatctggtggtcggcgtgcagtgcggcggcagcgatgctttctccggcgtgaccgccaacccggcggtgggctttgccgccgacctgatcgtgcgcgccggcggcacggtgatgttctcggaggtgaccgaggtgcgcgacgccatccacctgctgacgccgcgcgccatcgatgcggacatcggccgcgcgctgctgcgcgagatggcctggtacgacagctacctgagcggcggccagaccgaccgcagcgccaatccgtcgcccggcaacaagaagggcgggctgtccaacgtggtggagaaggcgctgggctccatcgtcaagtcgggcagcagccccatcgtcgatgtgctcggcccgggcgagaaggtgcgccgcaagggcctgatcttcgcggccacgcccgccagcgatttcgtctgcggcacgctgcagctcgcctccggcatgaacctgcaggtgttcaccaccgggcgcggcacgccgtacggcctgtcgatggcgccggtgatcaaggtgtcgacgcgcaaggcgctgtccgagcgctggcacgacctgatcgacctcgacgccggccgcatcgccaccggcgaggcctccattgccgacatcggctgggagctgttccgcctgatcctggatgtggccagcggccgcaagcaggtgtgcgccgacaggctcggcctgcacaacgcgctgaccctgttcaaccccgcaccggtgacctga

SEQ ID NO: 106324 - protein, 533 aa, Ralstonia solanacearum
MSESTLAPEAGTETEKALTIRVHDSDNVAIVVNARGLPAGTALADGTVLAEGVPQGHKVALADLAEGDAVVRYGEVIGYAVKALPRGSWVNEHAVRLPSAPALDDLPLATRPDPGLPPLQGYTFEGYRNADGTVGTKNVLGIMTSVQCVAGVTDHVVARIKRELLPRYPNVDDVVALNHAYGCGVAINAPAAIVPIRTLQNLALNPNFGGEVMVIGLGCEKLVPERLVPETLAPGGRIPIEVAGTADSPVLRLQDEAFDGFTGMVEAILEMAERRLAQLNTRRRETCPASDLVVGVQCGGSDAFSGVTANPAVGFAADLIVRAGGTVMFSEVTEVRDAIHLLTPRAIDADIGRALLREMAWYDSYLSGGQTDRSANPSPGNKKGGLSNVVEKALGSIVKSGSSPIVDVLGPGEKVRRKGLIFAATPASDFVCGTLQLASGMNLQVFTTGRGTPYGLSMAPVIKVSTRKALSERWHDLIDLDAGRIATGEASIADIGWELFRLILDVASGRKQVCADRLGLHNALTLFNPAPVT

SEQ ID NO: 106325 - DNA, 1506 bp, Rhizobium meliloti
  CDS (1)..(1506)
atgcccgcaccgtcttcgatccttctttcgccggacgataacgtcgtcgtcgccaccgcggcgattgcgccgggcgaccggctggccggcggagtgtcggcggtcgcgcgcatagagccgggccacaaggccgcgatccgcaggatcgacgtcggtgagccggtggtcaaatacggccaggcgatcggccgcgccacatcccccatcgcgcccggcgagcacgttcattctcataatcttgccttcgatcagggccggctcgccgttggcgccgccgttccgccggaggctgcgagcgaggcggacaaggcgcgcacattcctcggctatcgccgggcggacggtagggccgcaacgcgcaactatatcggcatcgtcgccagcgtgaactgttccaccacggtctgtcgcgcgatcgccgacgaggcgaacaggcgcattctgccaaaatatgaaggcatcgacggtttcgtgccgatcgtccacgaccagggatgcggcatgtcgtccaccggcgacggcatgaagaacctgcaccggacgctcgccggctatgcgcgccacgcgaatttcggcggcgtgctgatggtcgggctcggctgcgaggtcaatcagctgacgctctacggccagagcggggccggggccgagaagcggcatttcaacatccaggaggccggcggttcgcgccgctcggtcgagcgcgccctcggcattctcgacgaaatcgccaaggaagtcgcggccgcccggcgcgtgccgatcccggtcagcgagatcatcgtcggcctgcaatgcggcggttcggacgggctttccggcatcaccgccaatccggcgctcggcgcggcggtcgacatactcgccgccgccggcggcacggcgatcctttccgagacctccgagatctacggagccgagcatctgctgcgcagccgagcggtcaacgagacggtcgcggtcaagctcgacggcctgatagcctggtgggaggactatgtggcgatgcatggcgcctcgctcgacaataatccttcgccgggtaacaagcgcggcggcctgacgacgattctcgagaagtcgcttggcgccgtcgccaagggcggccgctcgccgttgacggctgtctacaattacgccgagcgcgtgaccgagcccggcctggtcttcatggacacgcccggctacgatccggtctcggcaaccggccaggtcgccggcggagccaacgtcatcgcgttcacgaccggccgcggcagctgtttcggctgtcggccggcgccgtcgatcaagctcaccagcaacacggcgctctatcgggccatggaagaggacatggacatcgactgcggcgtcattgcctcgggtgaaaccaccatcgccgatcttggccgggggattttcgagctcatcatagagaccgcatcgggccgcaagaccaagagcgagcttttcggctacggcgacaacgaattcgtgccctggcatctgggggcgacgctctag

SEQ ID NO: 106326 - protein, 501 aa, Rhizobium meliloti
MPAPSSILLSPDDNVVVATAAIAPGDRLAGGVSAVARIEPGHKAAIRRIDVGEPVVKYGQAIGRATSPIAPGEHVHSHNLAFDQGRLAVGAAVPPEAASEADKARTFLGYRRADGRAATRNYIGIVASVNCSTTVCRAIADEANRRILPKYEGIDGFVPIVHDQGCGMSSTGDGMKNLHRTLAGYARHANFGGVLMVGLGCEVNQLTLYGQSGAGAEKRHFNIQEAGGSRRSVERALGILDEIAKEVAAARRVPIPVSEIIVGLQCGGSDGLSGITANPALGAAVDILAAAGGTAILSETSEIYGAEHLLRSRAVNETVAVKLDGLIAWWEDYVAMHGASLDNNPSPGNKRGGLTTILEKSLGAVAKGGRSPLTAVYNYAERVTEPGLVFMDTPGYDPVSATGQVAGGANVIAFTTGRGSCFGCRPAPSIKLTSNTALYRAMEEDMDIDCGVIASGETTIADLGRGIFELIIETASGRKTKSELFGYGDNEFVPWHLGATL

SEQ ID NO: 106327 - DNA, 1164 bp, Sulfolobus tokodaii
  CDS (1)..(1164)
atggaaaaggttactattaaaggttatataagggaaaacggtagtgttggaataaggaatcatgttgcgataataccggttgatgatttatcaaatagtgcagcagtagcagtttcaagaattattaggggcacaattgctttacctcatccttatggtaggttacaatttgggaaagatttagatttactcttccacatattgtctgggaccggagcaaacccgaatgttgctggagctattgttattggaattgaggataactgggctcataaagttgctgataaaatcgctgaaaccggtaaaccagtggaagtttttccaattgaaggaaatggtgatttaagagtaattgagaaagcgtctagaaaggctaaagaatttgttcaatacgcaagtgagaaacaaaggacagaagttgacttatcatcaattgttgtgagtataaagtgtggagagagtgatacaacatctggtttagcatcaaacccagcaacaggctatgctgtagataaattaattgattatggtgctacagttctatttggtgagacttcagagttaacgggagctgaggacatagttgctaataggattccagatctaacattaagagaaaaattcatgaagatttataaagagtacgttagttttattgaatcacaaggagttgatctattaggctctcagcctacggaaggaaatattaaaggcggtttatctacgattgaagaaaaggctttaggaaatatacagaaacttggtaccaaaccaatcacatgtgtattggactacttagatcctcttccttccggatcatctcgcttatgtttcgtaaacacctcttctgctgcagctgaagcagtaacgttatttgctgctaaaggttctgttctacatttattcacaactgggcagggaaatgttgttggtcatcctattattccagtaataaaaatatcggcaaatcctaaaactgtaacaacaatggctgaacacatagatgttgatgtatcggacttacttcaacttaaggtttcattaaaagaggctggagaaagaatatttaattatgctttaagggtaatgaatggaagattaacatcagcagaagtacttcagcatgatgaattctctcctataaaattatacataagtgcataa

SEQ ID NO: 106328 - protein, 387 aa, Sulfolobus tokodaii
MEKVTIKGYIRENGSVGIRNHVAIIPVDDLSNSAAVAVSRIIRGTIALPHPYGRLQFGKDLDLLFHILSGTGANPNVAGAIVIGIEDNWAHKVADKIAETGKPVEVFPIEGNGDLRVIEKASRKAKEFVQYASEKQRTEVDLSSIVVSIKCGESDTTSGLASNPATGYAVDKLIDYGATVLFGETSELTGAEDIVANRIPDLTLREKFMKIYKEYVSFIESQGVDLLGSQPTEGNIKGGLSTIEEKALGNIQKLGTKPITCVLDYLDPLPSGSSRLCFVNTSSAAAEAVTLFAAKGSVLHLFTTGQGNVVGHPIIPVIKISANPKTVTTMAEHIDVDVSDLLQLKVSLKEAGERIFNYALRVMNGRLTSAEVLQHDEFSPIKLYISA

SEQ ID NO: 106329 - DNA, 1506 bp, Rhizobium loti
  CDS (1)..(1506)
atgaacgtctcgaacaccattcttctgtcccccgccgacaatgtcgccgttgccaatggccgtatcgagatcggcacggctctgccgggcggcgcacttgccaccgccgtcatcgagcccggccacaaggtggcgatcaagccgattgccgccggtgaagccgtggtcaaatatgcccaggcgatcggccgcgccacgcaggacatcgcgccgggcgagcatgtccattcgcacaatctggtgttcgaggccggccgccttccggtggtgccgccgagcgaggccgagcatgcgacagcggccgaccgcgcccgtactttcatgggctatcgccgcgccgatggccgcgccggcacgcgcaacttcatcggcatcatcgccagcgtcaattgttcggccacggtctgccattccatcgccgacaccgccaaccggaccttgctgccgaaatatcccggcatcgacggtttcgtgccgatcgtccacggtcagggctgcggcatgagcggcactggcgacggcatgatggtgctgcaccgcacgcttgccggctatgcccgccacccgaatttcggcggcgtgctgatggtcggcctgggatgcgaggtcaaccagctcaccctctatggccagaagggcgccgccgccggaaaacgccatttcaacatccaggacgccggcggatcgcgcaaatcggtggaaaaggcgatgggcgtgctggccgaaatcgccgaggaagtcggtcagttgaagcgcgagccgatcccggtcagcgagatcgtcgtcggcctgcaatgcggcggctccgacggcatgtcgggcatcaccgccaatccggctctgggggcggccgttgacattctggccggtgtcggcggcatcggcatcctctccgagaccacggaaatctacggcgccgagcatctgctcgcctaccgcgccgcgacgcccgagatcgccaagaagctcgatggctatgtcaaatggtgggaagatcacgtcgccaagcatggcgcctcgatcgacaacaacccctcgcctggaaacaagcgcggcggcctcaccaccatcctggaaaagtcgctgggcgcggtcgccaagggcggacagacgccgctcaatggtgtgttcggctatgccgagaaggtcaccggcaacggactggtgttcatggacacgcccggctacgacccggtctcggccaccggccaggtcgctggcggcgccaatgtcatcgtcttcaccaccggccgcggttcctgcttcggctgccggccgacaccgtcgatcaagatcgccaccaactcgaccatgtataaccagatggaagaggacatggacgtcaattgcggcgtcatcgcctcgggcgaaaagaccatcgccggcatgggccgcgagatcttcgaactcatcgtcgagacggcttccggccgcaagaccaagagcgaggatttcggctatggcgacaacgagttcgtgccctggcatctcggcgcgacgctctga

SEQ ID NO: 106330 - protein, 501 aa, Rhizobium loti
MNVSNTILLSPADNVAVANGRIEIGTALPGGALATAVIEPGHKVAIKPIAAGEAVVKYAQAIGRATQDIAPGEHVHSHNLVFEAGRLPVVPPSEAEHATAADRARTFMGYRRADGRAGTRNFIGIIASVNCSATVCHSIADTANRTLLPKYPGIDGFVPIVHGQGCGMSGTGDGMMVLHRTLAGYARHPNFGGVLMVGLGCEVNQLTLYGQKGAAAGKRHFNIQDAGGSRKSVEKAMGVLAEIAEEVGQLKREPIPVSEIVVGLQCGGSDGMSGITANPALGAAVDILAGVGGIGILSETTEIYGAEHLLAYRAATPEIAKKLDGYVKWWEDHVAKHGASIDNNPSPGNKRGGLTTILEKSLGAVAKGGQTPLNGVFGYAEKVTGNGLVFMDTPGYDPVSATGQVAGGANVIVFTTGRGSCFGCRPTPSIKIATNSTMYNQMEEDMDVNCGVIASGEKTIAGMGREIFELIVETASGRKTKSEDFGYGDNEFVPWHLGATL

SEQ ID NO: 106331 - DNA, 1164 bp, Thermoplasma acidophilum
  CDS (1)..(1164)
atggtaataatgagcagcacgtttatgggttatgaaagggagaatggcaggatagggacaagaaatcatgtattgattattccagttgacgatctctcaaacacggtggccgctgcggttgagaacaacatattcggtacaagggcaatacttcatccctatggcagacttcagtttggtgcagatcttgatctgacgttcagaaccctggcagggtatggcaggaatccaaatgtagcgtctgcaatagtcgtaggcatagaggacaactggactaacagaatcgctgaccagatctcgcaaactgggaagcatgttgaaactgttagtatagagggtagcggcgatctaaaggcgatagagaaagcatcaaggctcgccaaggaaatggcccaagaatcgtccacaaagacaaggaaggaattcgatgtttcgaatctaatagttagtacaaaatgcggtgaatccgacaccacttctggactcgctagcaatccaactgtaggcgttgtattcgacaggctagttgacgaaggtgcaacagtgatttttggagagacaagtgagttaaccggcgcagagaagtacatcgcagagaagatggcgaacaacgaactaaaggataaattcatgaagatattcaatgattatcaggacgtcataaaatcgcagggtgtagatcttctcggatcacagcctaccgaaggaaacataaaaggaggattgagtacaatagaggagaaagctctaggaaacatacaaaaagctgggaccaagaagataacgggtgtattagattacgccgaagagccaaaaagtaaaggattgaactttatgaatacatcctctgcggccgctgaagccgttacgctttttgcagcggcaggtgcagttgttcacctgttcacaaccggccaaggcaacatcgttggaaaccacatcttacctgtgataaagactacggcgaacccgaagactgcaaaaaacatggccgagcatatagatcttgacctttctggtctgttgaagttcgaatatacactcaaagatgctggagacaagctgtataacctccttctggagaccgcatctggaaagctgacttcaaatgaagtgctgaagcactatgaatttgctcttacgaagctttacatatcggcctga

SEQ ID NO: 106332 - protein, 387 aa, Thermoplasma acidophilum
MVIMSSTFMGYERENGRIGTRNHVLIIPVDDLSNTVAAAVENNIFGTRAILHPYGRLQFGADLDLTFRTLAGYGRNPNVASAIVVGIEDNWTNRIADQISQTGKHVETVSIEGSGDLKAIEKASRLAKEMAQESSTKTRKEFDVSNLIVSTKCGESDTTSGLASNPTVGVVFDRLVDEGATVIFGETSELTGAEKYIAEKMANNELKDKFMKIFNDYQDVIKSQGVDLLGSQPTEGNIKGGLSTIEEKALGNIQKAGTKKITGVLDYAEEPKSKGLNFMNTSSAAAEAVTLFAAAGAVVHLFTTGQGNIVGNHILPVIKTTANPKTAKNMAEHIDLDLSGLLKFEYTLKDAGDKLYNLLLETASGKLTSNEVLKHYEFALTKLYISA

SEQ ID NO: 106333 - DNA, 24 bp, Artificial sequence
  primer
atgcaatacatcaagatccatgcg

SEQ ID NO: 106334 - DNA, 24 bp, Artificial sequence
  primer
ttatagcgttacgccgcttttgaa

SEQ ID NO: 106335 - protein, 505 aa, Artificial sequence
  Variant (2)..(2): xaa in position 2 is any amino acid
  Variant (4)..(31): xaa in position 4 to 31 is any amino acid
  Variant (35)..(35): xaa in position 35 is any amino acid
  Variant (37)..(48): xaa in position 37 to 48 is any amino acid
  Variant (51)..(52): xaa in position 51 to 52 is any amino acid
  Variant (55)..(55): xaa in position 55 is any amino acid
  Variant (57)..(62): xaa in position 57 to 62 is any amino acid
  Variant (64)..(107): xaa in position 64 to 107 is any amino acid
  Variant (109)..(113): xaa in position 109 to 113 is any amino acid
  Variant (115)..(116): xaa in position 115 to 116 is any amino acid
  Variant (118)..(119): xaa in position 118 to 119 is any amino acid
  Variant (121)..(123): xaa in position 121 to 123 is any amino acid
  Variant (125)..(127): xaa in position 125 to 127 is any amino acid
  Variant (129)..(129): xaa in position 129 is any amino acid
  Variant (131)..(159): xaa in position 131 to 159 is any amino acid
  Variant (161)..(166): xaa in position 161 to 166 is any amino acid
  Variant (168)..(169): xaa in position 168 to 169 is any amino acid
  Variant (172)..(193): xaa in position 172 to 193 is any amino acid
  Variant (196)..(204): xaa in position 196 to 204 is any amino acid
  Variant (209)..(275): xaa in position 209 to 275 is any amino acid
  Variant (277)..(281): xaa in position 277 to 281 is any amino acid
  Variant (283)..(283): xaa in position 283 is any amino acid
  Variant (285)..(289): xaa in position 285 to 289 is any amino acid
  Variant (295)..(296): xaa in position 295 to 296 is any amino acid
  Variant (299)..(300): xaa in position 299 to 300 is any amino acid
  Variant (304)..(305): xaa in position 304 to 305 is any amino acid
  Variant (307)..(309): xaa in position 307 to 309 is any amino acid
  Variant (311)..(315): xaa in position 311 to 315 is any amino acid
  Variant (317)..(317): xaa in position 317 is any amino acid
  Variant (319)..(322): xaa in position 319 to 322 is any amino acid
  Variant (324)..(325): xaa in position 324 to 325 is any amino acid
  Variant (327)..(329): xaa in position 327 to 329 is any amino acid
  Variant (331)..(333): xaa in position 331 to 333 is any amino acid
  Variant (335)..(336): xaa in position 335 to 336 is any amino acid
  Variant (338)..(356): xaa in position 338 to 356 is any amino acid
  Variant (358)..(369): xaa in position 358 to 369 is any amino acid
  Variant (372)..(373): xaa in position 372 to 373 is any amino acid
  Variant (377)..(377): xaa in position 377 is any amino acid
  Variant (380)..(384): xaa in position 380 to 384 is any amino acid
  Variant (387)..(387): xaa in position 387 is any amino acid
  Variant (390)..(392): xaa in position 390 to 392 is any amino acid
  Variant (394)..(394): xaa in position 394 is any amino acid
  Variant (396)..(401): xaa in position 396 to 401 is any amino acid
  Variant (403)..(412): xaa in position 403 to 412 is any amino acid
  Variant (414)..(415): xaa in position 414 to 415 is any amino acid
  Variant (417)..(421): xaa in position 417 to 421 is any amino acid
  Variant (423)..(424): xaa in position 423 to 424 is any amino acid
  Variant (426)..(429): xaa in position 426 to 429 is any amino acid
  Variant (431)..(433): xaa in position 431 to 433 is any amino acid
  Variant (435)..(435): xaa in position 435 is any amino acid
  Variant (437)..(441): xaa in position 437 to 441 is any amino acid
  Variant (448)..(450): xaa in position 448 to 450 is any amino acid
  Variant (452)..(455): xaa in position 452 to 455 is any amino acid
  Variant (457)..(458): xaa in position 457 to 458 is any amino acid
  Variant (460)..(474): xaa in position 460 to 474 is any amino acid
  Variant (476)..(478): xaa in position 476 to 478 is any amino acid
  Variant (480)..(502): xaa in position 480 to 502 is any amino acid
  Variant (504)..(504): xaa in position 504 is any amino acid
DXVXXXXXXXXXXXXXXXXXXXXXXXXXXXXGHKXAXXXXXXXXXXXXYGXXIGXAXXXXXXGXXXXXXXXXXXXXXXXXXXXXXXXXXXXXXXXXXXXXXXXXXXXGXXXXXGXXGXXNXXXIXXXVXCXXXXXXXXXXXXXXXXXXXXXXXXXXXXXDXXXXXXHXXGCXXXXXXXXXXXXXXXXXXXXXXPNXXXXXXXXXLGCEXXXXXXXXXXXXXXXXXXXXXXXXXXXXXXXXXXXXXXXXXXXXXXXXXXXXXXXXXXXXXXXXXXXRXXXXXSXLXXXXXCGGSDXXSGXXANPXXGXXXDXXXXXGXTXXXXEXXEXXXAXXXLXXRXXXXXXXXXXXXXXXXXXXYXXXXXXXXXXXXNPXXGNKXGGXXXXXEKXLGXXXKXGXXXXXXVXXXXXXXXXXGXXLXXXXXPXXDXXXXTXXXAXGXXXXXFTTGRGXXXGXXXXPXXKXXXXXXXXXXXXXXXDXXXGXXXXXXXXXXXXXXXXXXXXXXXAXG

SEQ ID NO: 106336 - protein, 38 aa, Artificial sequence
  Variant (1)..(1): xaa in position 1 is Val or Ile
  Variant (2)..(3): xaa in position 2 to 3 is any amino acid
  Variant (4)..(4): xaa in position 4 is Gly or Ser
  Variant (7)..(7): xaa in position 7 is any amino acid
  Variant (8)..(8): xaa in position 8 is Ala, Leu or Ser
  Variant (9)..(11): xaa in position 9 to 11 is any amino acid
  Variant (12)..(12): xaa in position 12 is Ile, Leu, Val or Phe
  Variant (13)..(17): xaa in position 13 to 17 is any amino acid
  Variant (18)..(18): xaa in position 18 is Ile, Val or Leu
  Variant (19)..(19): xaa in position 19 is any amino acid
  Variant (20)..(20): xaa in position 20 is Lys or Arg
  Variant (21)..(21): xaa in position 21 is Tyr, Leu or Phe
  Variant (22)..(22): xaa in position 22 is Gly, Asp or Ala
  Variant (23)..(24): xaa in position 23 to 24 is any amino acid
  Variant (25)..(25): xaa in position 25 is Ile or Phe
  Variant (27)..(27): xaa in position 27 is any amino acid
  Variant (28)..(28): xaa in position 28 is Ala or Ser
  Variant (29)..(31): xaa in position 29 to 31 is any amino acid
  Variant (32)..(32): xaa in position 32 is Ile, Lys or Leu
  Variant (33)..(34): xaa in position 33 to 34 is any amino acid
  Variant (36)..(36): xaa in position 36 is any amino acid
  Variant (37)..(37): xaa in position 37 is Trp or His
  Variant (38)..(38): xaa in position 38 is Val, Ile or Met
XXXXHKXXXXXXXXXXXXXXXXXXXGXXXXXXXXGXXX

SEQ ID NO: 106337 - protein, 31 aa, Artificial sequence
  Variant (1)..(1): xaa in position 1 is Gly, Ile or Leu
  Variant (2)..(2): xaa in position 2 is Tyr, Phe or Ile
  Variant (3)..(3): xaa in position 3 is any amino acid
  Variant (4)..(4): xaa in position 4 is Arg or Asn
  Variant (5)..(6): xaa in position 5 to 6 is any amino acid
  Variant (8)..(8): xaa in position 8 is any or no amino acid
  Variant (9)..(9): xaa in position 9 is Val, Ala, Phe or Ile
  Variant (10)..(10): xaa in position 10 is Gly or Ala
  Variant (11)..(11): xaa in position 11 is Thr, Ile or Val
  Variant (12)..(12): xaa in position 12 is Arg or Lys
  Variant (14)..(14): xaa in position 14 is any amino acid
  Variant (15)..(15): xaa in position 15 is Leu, Ile or Val
  Variant (16)..(16): xaa in position 16 is any amino acid
  Variant (17)..(17): xaa in position 17 is Ile or Val
  Variant (18)..(19): xaa in position 18 to 19 is any amino acid
  Variant (20)..(20): xaa in position 20 is Ser, Thr, Val or Arg
  Variant (21)..(21): xaa in position 21 is Val or Asp
  Variant (22)..(22): xaa in position 22 is any amino acid
  Variant (23)..(23): xaa in position 23 is Cys or Leu
  Variant (24)..(24): xaa in position 24 is Val, Ser or Ile
  Variant (25)..(26): xaa in position 25 to 26 is any amino acid
  Variant (27)..(27): xaa in position 27 is Val, Ile, Thr or Ala
  Variant (28)..(30): xaa in position 28 to 30 is any amino acid
  Variant (31)..(31): xaa in position 31 is Ile, Val, Leu, Met or Ala
XXXXXXGXXXXXNXXXXXXXXXXXXXXXXXX

SEQ ID NO: 106338 - protein, 47 aa, Artificial sequence
  Variant (1)..(1): xaa in position 1 is Val, Thr, Ile or Phe
  Variant (2)..(5): xaa in position 2 to 5 is any amino acid
  Variant (6)..(6): xaa in position 6 is His, Gln or Asn
  Variant (7)..(8): xaa in position 7 to 8 is any amino acid
  Variant (10)..(10): xaa in position 10 is Cys or Arg
  Variant (11)..(11): xaa in position 11 is Gly, Ser, Ala or Leu
  Variant (12)..(12): xaa in position 12 is Gln, Val, Met or Leu
  Variant (13)..(13): xaa in position 13 is any amino acid
  Variant (14)..(15): xaa in position 14 to 15 is any or no amino acid
  Variant (16)..(16): xaa in position 16 is Gly, Ala, Ser or Asn
  Variant (17)..(21): xaa in position 17 to 21 is any amino acid
  Variant (22)..(22): xaa in position 22 is Thr, Leu or Pro
  Variant (23)..(25): xaa in position 23 to 25 is any amino acid
  Variant (26)..(26): xaa in position 26 is Leu, Ile, Val or Gln
  Variant (27)..(27): xaa in position 27 is any amino acid
  Variant (28)..(28): xaa in position 28 is Asn, Gly, Ala or Asp
  Variant (29)..(31): xaa in position 29 to 31 is any amino acid
  Variant (32)..(32): xaa in position 32 is His, Asn or Ser
  Variant (33)..(33): xaa in position 33 is Pro, Ala or Val
  Variant (35)..(35): xaa in position 35 is Phe, Ala, Val or Leu
  Variant (36)..(36): xaa in position 36 is Gly, Ala or Ser
  Variant (37)..(37): xaa in position 37 is any amino acid
  Variant (38)..(40): xaa in position 38 to 40 is any or no amino acid
  Variant (41)..(41): xaa in position 41 is Val, Ile, Leu, Met or Ala
  Variant (42)..(42): xaa in position 42 is Ile, Val or Leu
  Variant (43)..(43): xaa in position 43 is Gly, Ser or Val
  Variant (44)..(44): xaa in position 44 is Leu, Ile or Val
  Variant (46)..(46): xaa in position 46 is Cys or Ile
XXXXXXXXGXXXXXXXXXXXXXXXXXXXXXXXXNXXXXXXXXXXGXE

SEQ ID NO: 106339 - protein, 62 aa, Artificial sequence
  Variant (2)..(5): xaa in position 2 to 5 is any amino acid
  Variant (6)..(6): xaa in position 6 is Ala, Leu, Val or Ile
  Variant (7)..(7): xaa in position 7 is Ser, His, Arg or Lys
  Variant (8)..(8): xaa in position 8 is any amino acid
  Variant (9)..(9): xaa in position 9 is Leu or Ile
  Variant (10)..(10): xaa in position 10 is any amino acid
  Variant (11)..(11): xaa in position 11 is Val, Ile, Leu, Phe or Ala
  Variant (12)..(12): xaa in position 12 is Gly, Ala or Ser
  Variant (13)..(13): xaa in position 13 is Leu, Met, Val, Ile or Thr
  Variant (14)..(14): xaa in position 14 is Gln, Glu or Lys
  Variant (17)..(17): xaa in position 17 is Gly, Glu or Ala
  Variant (20)..(20): xaa in position 20 is Gly, Ala, Thr or Phe
  Variant (21)..(21): xaa in position 21 is any amino acid
  Variant (24)..(24): xaa in position 24 is Ile, Val, Leu or Trp
  Variant (25)..(25): xaa in position 25 is Thr, Ala or Ser
  Variant (26)..(26): xaa in position 26 is Ala or Ser
  Variant (29)..(29): xaa in position 29 is any amino acid
  Variant (30)..(30): xaa in position 30 is Leu, Val or Thr
  Variant (32)..(34): xaa in position 32 to 34 is any amino acid
  Variant (36)..(36): xaa in position 36 is any amino acid
  Variant (37)..(37): xaa in position 37 is Leu, Ile, Val or Met
  Variant (38)..(38): xaa in position 38 is Val, Ile, Ala or Leu
  Variant (39)..(40): xaa in position 39 to 40 is any amino acid
  Variant (41)..(41): xaa in position 41 is Gly or Glu
  Variant (42)..(42): xaa in position 42 is Gly, Ala or Ser
  Variant (43)..(43): xaa in position 43 is Thr, Ser, Ala or Ile
  Variant (44)..(44): xaa in position 44 is any amino acid
  Variant (45)..(45): xaa in position 45 is Val, Met, Ile or Leu
  Variant (46)..(46): xaa in position 46 is Leu, Phe, Met or Ile
  Variant (47)..(47): xaa in position 47 is Ser, Thr or Gly
  Variant (49)..(49): xaa in position 49 is Val, Thr, Asn or Ile
  Variant (50)..(50): xaa in position 50 is Pro, Thr or Ser
  Variant (51)..(51): xaa in position 51 is Glu or Lys
  Variant (52)..(52): xaa in position 52 is Val, Ile, Leu, Met or Phe
  Variant (53)..(53): xaa in position 53 is any amino acid
  Variant (54)..(54): xaa in position 54 is Gly or Asp
  Variant (55)..(55): xaa in position 55 is Ala, Gly or Val
  Variant (56)..(56): xaa in position 56 is Glu or Ile
  Variant (57)..(58): xaa in position 57 to 58 is any amino acid
  Variant (59)..(59): xaa in position 59 is Leu, Val, Ile or Tyr
  Variant (60)..(61): xaa in position 60 to 61 is any amino acid
  Variant (62)..(62): xaa in position 62 is Arg, His or Lys
RXXXXXXXXXXXXXCGXSDXXSGXXXNPXXGXXXDXXXXXXXXXXXXEXXXXXXXXXXXXXX

SEQ ID NO: 106340 - protein, 44 aa, Artificial sequence
  Variant (1)..(1): xaa in position 1 is Asn or Gln
  Variant (2)..(2): xaa in position 2 is Pro or Thr
  Variant (3)..(3): xaa in position 3 is Ser or Thr
  Variant (4)..(4): xaa in position 4 is any amino acid
  Variant (7)..(7): xaa in position 7 is Lys, Ile, Gln or Met
  Variant (8)..(8): xaa in position 8 is any amino acid
  Variant (11)..(11): xaa in position 11 is Leu or Ile
  Variant (12)..(12): xaa in position 12 is Thr, Ser, Ala or Asn
  Variant (13)..(13): xaa in position 13 is Thr, Asn or Ser
  Variant (14)..(14): xaa in position 14 is Ile, Leu or Val
  Variant (15)..(15): xaa in position 15 is any amino acid
  Variant (16)..(16): xaa in position 16 is Glu or Asp
  Variant (18)..(18): xaa in position 18 is Ser or Ala
  Variant (19)..(19): xaa in position 19 is Leu or Met
  Variant (21)..(21): xaa in position 21 is Ser, Ala, Cys or Asn
  Variant (22)..(23): xaa in position 22 to 23 is any amino acid
  Variant (25)..(25): xaa in position 25 is any amino acid
  Variant (27)..(29): xaa in position 27 to 29 is any amino acid
  Variant (30)..(30): xaa in position 30 is Ile, Leu or Val
  Variant (31)..(32): xaa in position 31 to 32 is any amino acid
  Variant (33)..(33): xaa in position 33 is Val or Ile
  Variant (34)..(35): xaa in position 34 to 35 is any amino acid
  Variant (36)..(36): xaa in position 36 is Tyr, Pro or Phe
  Variant (37)..(37): xaa in position 37 is Gly, Ala, Leu or Thr
  Variant (38)..(38): xaa in position 38 is Glu, Gln or Asp
  Variant (39)..(43): xaa in position 39 to 43 is any amino acid
  Variant (44)..(44): xaa in position 44 is Gly or Ser
XXXXGNXXGGXXXXXXKXXGXXXKXGXXXXXXXXXXXXXXXXXX

SEQ ID NO: 106341 - protein, 60 aa, Artificial sequence
  Variant (1)..(1): xaa in position 1 is Pro or Ser
  Variant (2)..(2): xaa in position 2 is Gly, Ala or Ser
  Variant (3)..(3): xaa in position 3 is any amino acid
  Variant (4)..(4): xaa in position 4 is Asp or Ala
  Variant (5)..(5): xaa in position 5 is any amino acid
  Variant (6)..(6): xaa in position 6 is Val, Ile, Glu or Ser
  Variant (7)..(7): xaa in position 7 is Ala, Cys or Ser
  Variant (8)..(8): xaa in position 8 is any amino acid
  Variant (9)..(9): xaa in position 9 is Thr or Ser
  Variant (10)..(12): xaa in position 10 to 12 is any amino acid
  Variant (13)..(13): xaa in position 13 is Ala, Gly or Ser
  Variant (14)..(14): xaa in position 14 is Ala, Ser, Gly or Lys
  Variant (16)..(17): xaa in position 16 to 17 is any amino acid
  Variant (18)..(18): xaa in position 18 is Leu, Ile, Val, Met or Phe
  Variant (19)..(20): xaa in position 19 to 20 is any amino acid
  Variant (22)..(22): xaa in position 22 is Thr or Ser
  Variant (25)..(25): xaa in position 25 is Arg or Gln
  Variant (27)..(27): xaa in position 27 is Thr, Ser or Asn
  Variant (28)..(29): xaa in position 28 to 29 is any amino acid
  Variant (31)..(33): xaa in position 31 to 33 is any amino acid
  Variant (34)..(34): xaa in position 34 is any or no amino acid
  Variant (36)..(36): xaa in position 36 is Val, Thr, Ser or Cys
  Variant (37)..(37): xaa in position 37 is Ile, Val, Leu or Met
  Variant (39)..(39): xaa in position 39 is Ile, Leu, Val, Met or Thr
  Variant (40)..(40): xaa in position 40 is Ala, Ser, Thr or Cys
  Variant (41)..(41): xaa in position 41 is Thr, Ser or Ala
  Variant (42)..(42): xaa in position 42 is Asn, Arg or His
  Variant (43)..(44): xaa in position 43 to 44 is any amino acid
  Variant (45)..(45): xaa in position 45 is Leu, Met, Ile, Val or Thr
  Variant (46)..(52): xaa in position 46 to 52 is any amino acid
  Variant (53)..(53): xaa in position 53 is Ile or Met
  Variant (55)..(55): xaa in position 55 is any amino acid
  Variant (56)..(56): xaa in position 56 is Asn, Asp or Ser
  Variant (57)..(57): xaa in position 57 is any amino acid
  Variant (58)..(58): xaa in position 58 is Gly or Ser
  Variant (59)..(59): xaa in position 59 is any amino acid
  Variant (60)..(60): xaa in position 60 is Ile, Leu or Val
XXXXXXXXXXXXXXGXXXXXFXTGXGXXXGXXXXPXXKXXXXXXXXXXXXXXXDXXXXXX

SEQ ID NO: 106342 - DNA, 678 bp, Escherichia coli K12
  CDS (1)..(678): transl_table=11
atgacaatgctactgccgctcttcattctggttggttttattgcagattattttgttaatgccatcgcctatcacctctcgccgttggaggataaaacggcgttaacgtttcgccaggtattggttcatttcaggcaaaaaaaatatgcctggcatgatacagtgcccctgatactttgtgttgctgctgctatcgcctgcgccctggcacctttcacgcccatcgtgactggcgcactctttctctatttctgtttcgtactcacgctcagtgttattgattttcgcactcagctcctgcccgacaaactcaccttaccgctgctctggcttggcttggtatttaatgcgcagtatggattaattgatttacatgatgcggtttacggcgcggtagcgggctatggggtgctgtggtgtgtttactggggcgtctggttagtttgtcacaaagagggattgggctacggtgatttcaagctactggccgctgcaggcgcatggtgtggctggcaaacgttgccaatgatactgctgattgcctcgctgggtggcattggttacgccatcgtttcacaacttctgcaacgccggactataaccactatcgcattcggcccgtggcttgcgctcggcagcatgataaacctggggtatctggcctggatctcttattaa

SEQ ID NO: 106343 - protein, 225 aa, Escherichia coli K12
MTMLLPLFILVGFIADYFVNAIAYHLSPLEDKTALTFRQVLVHFRQKKYAWHDTVPLILCVAAAIACALAPFTPIVTGALFLYFCFVLTLSVIDFRTQLLPDKLTLPLLWLGLVFNAQYGLIDLHDAVYGAVAGYGVLWCVYWGVWLVCHKEGLGYGDFKLLAAAGAWCGWQTLPMILLIASLGGIGYAIVSQLLQRRTITTIAFGPWLALGSMINLGYLAWISY

SEQ ID NO: 106344 - DNA, 717 bp, Escherichia coli O157:H7
  CDS (1)..(717): transl_table=11
atgttggagaggcggtggcggcgtgaagcgctgacgctattggcacattctgtgcctgagtccgggccggcctttaacctgatgataccgcagtctcattgtccctgctgttttcatccgctcggcatcagggataacattcccctgttaagctacctatttctgaaggggaaatcacgctgttgtggcgagcgtattcccgtttactacccgctagtcgaaataacgaactcagtgttattcattctggccgcgagcaggtttccaccagggctgacattagcggctgcctggctttttatttccatgctgttggttctggcggttattgactgccatacggcgctgctgccggatgtgctgacgttgccattgctctggcttggcctgttattcagtttacagagaggcgttgtcaccttagaggaggcggtagtgggggcggtatctgggtatctctgtctgtggggactgtactggctttttcgtttcgctaccgggagggaagggttaggttacggtgattttaagctagctgcggcattgggagcatggatgggttggcaggcattaccctcaatacttttgtttgcctcagtcagtgggttaatcgtaacagtactgttgcgtattgtaacagctacggactttacccgcccgctgccttttgggccgtggctcgctttgagcggagtgtgccattttttgttgatgtag

SEQ ID NO: 106345 - protein, 238 aa, Escherichia coli O157:H7
MLERRWRREALTLLAHSVPESGPAFNLMIPQSHCPCCFHPLGIRDNIPLLSYLFLKGKSRCCGERIPVYYPLVEITNSVLFILAASRFPPGLTLAAAWLFISMLLVLAVIDCHTALLPDVLTLPLLWLGLLFSLQRGVVTLEEAVVGAVSGYLCLWGLYWLFRFATGREGLGYGDFKLAAALGAWMGWQALPSILLFASVSGLIVTVLLRIVTATDFTRPLPFGPWLALSGVCHFLLM

SEQ ID NO: 106346 - DNA, 750 bp, Escherichia coli
  CDS (1)..(750): transl_table=11
atgcaagaaagtatatttctattattggtttttatatatgcggccacaattaccagttttatatggctcgctgtggaacgtcttccccatcagttaaaatgggtagacaatcctgtttctgatataacaatatggtctccgggaagtaaatgtaataattgtggtaaaaaaattcgttggtattatcttattcctgttttggggtattttttgtgtcgaggggaatgtggctattgtcatgctaaagttcccgtccggtatccacttacagagtttatctgtggtgtttgcagtgttattatatttgtatttttgggagacagactgtatgatgcagtaatagtttcgctactttttctttgccttgtttttcttgctctgattgatttaagagagaactggctaccagcttgtgttacgtaccctctattttgggcaggtatgattactccagggtttgcatccagcgatgataagattttcggtgcatttaccggttttttaataatgtatatttcaatgaaactagttagcgccttaagaaaggaggatgtttttgcaggcggagacattgctctggctacagcggccggtgcatggttaggaatagataaaatgcctttttttcttattttgtcttcatttatatttattctttactctcttccagcaaggttaagaggtcaggtttttgttcctatgggaccagctctttccgcgtcattttttatatgtttagtttatcattaa

SEQ ID NO: 106347 - protein, 249 aa, Escherichia coli
MQESIFLLLVFIYAATITSFIWLAVERLPHQLKWVDNPVSDITIWSPGSKCNNCGKKIRWYYLIPVLGYFLCRGECGYCHAKVPVRYPLTEFICGVCSVIIFVFLGDRLYDAVIVSLLFLCLVFLALIDLRENWLPACVTYPLFWAGMITPGFASSDDKIFGAFTGFLIMYISMKLVSALRKEDVFAGGDIALATAAGAWLGIDKMPFFLILSSFIFILYSLPARLRGQVFVPMGPALSASFFICLVYH

SEQ ID NO: 106348 - DNA, 495 bp, Mesorhizobium loti MAFF303099
  CDS (1)..(495): transl_table=11
atggtgacgcacccctctctcgtgcttgccgcgacgatcgccctggcggttgtgcttggcgccatttcgatcgccgatttccgccggcagatcatcccggacgggctcaacctggcgctcgccgggatcggcctttcctatcagctggcggccgacgccgacgcaatgccgcagcgcctgctcttcgccgccgcgaccttcgccgccgcctggctgctgaggcgcggccatttcctcatgaccggacgcatcggcctcggcctcggcgacgtcaagatgctggcggccgcttcatgctggatcagcccgctgctgttgccggtgctgctgttcatcgccagcgccagcgctttgctgttcgtcggcggccaggtggtcgcgacggggccggcggcggcgcgggcccgcgtcgccttcggtccgttcatcgccatcggcctcggcgcaagctgggcgctggagcaatttgcaggtctagacatgggactgctctga

SEQ ID NO: 106349 - protein, 164 aa, Mesorhizobium loti MAFF303099
MVTHPSLVLAATIALAVVLGAISIADFRRQIIPDGLNLALAGIGLSYQLAADADAMPQRLLFAAATFAAAWLLRRGHFLMTGRIGLGLGDVKMLAAASCWISPLLLPVLLFIASASALLFVGGQVVATGPAAARARVAFGPFIAIGLGASWALEQFAGLDMGLL

SEQ ID NO: 106350 - DNA, 765 bp, Aquifex aeolicus VF5
  CDS (1)..(765): transl_table=11
ttgaaggaattttggccctacttggctgttttccttttcggcttaattctggggagtttttacaacgtccttatatacagacttccgagaaatatatctatagtttttccctcttctcactgtccggagtgtaaaacacctataaagtggtacgacaacattcctttaatttcttacgtgatcttaaagggaaggtgcagacactgcggggaaaaaatacctcctcgttatcctttagtggagctcgcttcgggttttttagcggtgctttcctattacaagtggggactttccgttgacggagtcgtttactacttcttcttttccgcactcctcgttatgtccataatagactggtactacttcatactcccgcccgggataaacataggaggtctggttttaggtattcttgtttccccgttcaggcaagatataacaccaaaagagagcattataggagcggttgtaggagtacttatcccattcgttatatacctttactacgtgaagttcaggaaaatagaaggactgggcttcggggatgtcatactccttggctttataggttctgtgagcggagtttacggagtgttttcagccctttttatagggagttttctgggacttctttacgctcttcccatgataatcaggcacaaaagtatgaactttgccctgcctttcgggcctttcctttcccttggagcttttatcggaatagtgtttaaggagcaaattctaacttacattatcagtgtataa

SEQ ID NO: 106351 - protein, 254 aa, Aquifex aeolicus VF5
MKEFWPYLAVFLFGLILGSFYNVLIYRLPRNISIVFPSSHCPECKTPIKWYDNIPLISYVILKGRCRHCGEKIPPRYPLVELASGFLAVLSYYKWGLSVDGVVYYFFFSALLVMSIIDWYYFILPPGINIGGLVLGILVSPFRQDITPKESIIGAVVGVLIPFVIYLYYVKFRKIEGLGFGDVILLGFIGSVSGVYGVFSALFIGSFLGLLYALPMIIRHKSMNFALPFGPFLSLGAFIGIVFKEQILTYIISV

SEQ ID NO: 106352 - DNA, 723 bp, Thermotoga maritima MSB8
  CDS (1)..(723): transl_table=11
ttgtggtatctcctgacgttcgcaataggcaccatagttggaagttttctgaacgttgtcatatacagatctacgaaggaggatctcaagctgtgggatcctcctcattcattctgtcctaactgtaaaaggaaaatagagtggtacgacaacattcccgttatcagctatattcttttgaggggaaaatgccggcactgtggatggagaattccgatcagataccccatcgtggagatttcaacggggactttgtttctgatgaatcgtgttctcataaaagatcccctgctgtttgtatcttcgtgcgtgattgcctctgccctcatcgcgatatcactcatagaccttgaaacgtacctgattccagattatctgaattttaccgttctgatcttttccttcgtggtagctttgagaacctcctttctggagcatctgatttcctttctcatcgtgacgatcatgtttttgattctgaaagcgatgtacagagacggtctgggagcaggtgacgtgatccttgcaatgggaataggcttcctcctctctccagttccttccatttttgccatcttgatcgcttcaatttctggaatactctatgcactgatcaaaggaaaaggtaaaatggatataaaaacgcgtataccattcggccccttccttgcccttggaggttacactctctttctcatatcgtacggaatggggtggttgtag

SEQ ID NO: 106353 - protein, 240 aa, Thermotoga maritima MSB8
MWYLLTFAIGTIVGSFLNVVIYRSTKEDLKLWDPPHSFCPNCKRKIEWYDNIPVISYILLRGKCRHCGWRIPIRYPIVEISTGTLFLMNRVLIKDPLLFVSSCVIASALIAISLIDLETYLIPDYLNFTVLIFSFVVALRTSFLEHLISFLIVTIMFLILKAMYRDGLGAGDVILAMGIGFLLSPVPSIFAILIASISGILYALIKGKGKMDIKTRIPFGPFLALGGYTLFLISYGMGWL

SEQ ID NO: 106354 - DNA, 876 bp, Vibrio cholerae O1 biovar eltor str. N16961
  CDS (1)..(876): transl_table=11
atggaactgttttacttctacccttggctgtttccggtgctcgccacgctgtttggcttgattgtcggtagctttctcaatgtggtgatctatcgcttacccaaaatcatggagcgtgaatggcgcgcggaatgtgcggcgagttttcctgaatatggcatcacgccaccagagggtaaactgaccctcagtttgccgcgttccacttgcccacactgtcaaacgccgattcgcgtcattgataatatcccgctactgagttggctagcgctgcgcggtcaatgctcacactgtaaagcgccgatcagcgctcgctatcccttgattgagctactcactgccctcatgagcttagtgattgccactcactttccgttcggagtttttgccgtggcgctgctgtttttcagctatgtgttgattgcggcaaccttcatcgacttcgataccctgttgttgcccgaccaattaacgctacctttactgtggggcggtattgcactggcactgcttggtttttctcctgtttcactcagtgatgcggtgatcggagccatggcgggttatctctcgctgtggtcgatttactggctatttaaactgctgacaggtaaagaaggcatgggttatggcgatttcaaattgctcgccgctctcggcgcttggctgggttggcagcagttgcctgtcatcgtactgctctcatcggtggttggggtgattttcggtttaatccaactgcgccagcagaaaaaaggtatcgatatggcctttccgtttggcccttatctcgccatcgcgggatggtttgccttgctgtggggcgataaggtaattgattggtacttcaccacttgggtaggacaaccgttatga

SEQ ID NO: 106355 - protein, 291 aa, Vibrio cholerae O1 biovar eltor str. N16961
MELFYFYPWLFPVLATLFGLIVGSFLNVVIYRLPKIMEREWRAECAASFPEYGITPPEGKLTLSLPRSTCPHCQTPIRVIDNIPLLSWLALRGQCSHCKAPISARYPLIELLTALMSLVIATHFPFGVFAVALLFFSYVLIAATFIDFDTLLLPDQLTLPLLWGGIALALLGFSPVSLSDAVIGAMAGYLSLWSIYWLFKLLTGKEGMGYGDFKLLAALGAWLGWQQLPVIVLLSSVVGVIFGLIQLRQQKKGIDMAFPFGPYLAIAGWFALLWGDKVIDWYFTTWVGQPL

SEQ ID NO: 106356 - DNA, 861 bp, Neisseria meningitidis MC58
  CDS (1)..(861): transl_table=11
atgtctgatttgtctgtattgtcgccgtttgccgtgcctttggcagcggtgttcgggctgctggtcggaagtttcttaaatgtcgtcatttaccgcgtgccggtcatgatggaacgcggctggacggtatttgccaaagaatatttaaacctgccgctgaccgaagaggaaagccgtaccttcaacctgatgaaaccggattcctgctgtcccaaatgccgcgtgccgatacgcgcgtggcagaacatcccgattgtcagctacctgctcctgcgcggcaaatgcgcttcctgccaaaccaaaatcagcatacgttatcccttaatcgagctgctgaccggcgtattgttcgggctggtcgcctggcaatacggctggtcttggattacgctgggcggattggtactgaccgcgtttctgatttccctgacctttatcgatgcggacacccaatacctgcccgactcgatgacactgcccttaatttggctgggtctgatatttaatttggacggcggcttcgtgcctttgcagtctgccgttttaggtgcggtcgccggctatggttcattatggctcttatgtgcagtgtataaactgctcacaggaaaaaccggtatgggcaacggagatttcaaactgattgccgcattgggcgcgtggctcggcatatccgcattgcccgtactgatttttgtttcctcgctgatcggtttggtcgcggcaatcgttatgcgcgtcgccaaggggcagcattttgccttcggccccgcactgacagtttcgggctggataatttttacggcaaacgattccgtatggcgggcggtcaactggtggctgacccatccggtgctgtaa

SEQ ID NO: 106357 - protein, 286 aa, Neisseria meningitidis MC58
MSDLSVLSPFAVPLAAVFGLLVGSFLNVVIYRVPVMMERGWTVFAKEYLNLPLTEEESRTFNLMKPDSCCPKCRVPIRAWQNIPIVSYLLLRGKCASCQTKISIRYPLIELLTGVLFGLVAWQYGWSWITLGGLVLTAFLISLTFIDADTQYLPDSMTLPLIWLGLIFNLDGGFVPLQSAVLGAVAGYGSLWLLCAVYKLLTGKTGMGNGDFKLIAALGAWLGISALPVLIFVSSLIGLVAAIVMRVAKGQHFAFGPALTVSGWIIFTANDSVWRAVNWWLTHPVL

SEQ ID NO: 106358 - DNA, 861 bp, Neisseria meningitidis Z2491
  CDS (1)..(861): transl_table=11
atgtctgatttgtctgtattgtcgccgtttgccgtgcctttggcagcggtgttcgggctgctggtcggaagtttcttaaatgtcgtcatttaccgcgtgccggtcatgatggaacgcggctggacggtatttgccaaagaatatttaaacctgccgctgaccgaagaggaaagccgtaccttcaacctgatgaaaccggattcctgctgtcccaaatgtcgcgtgccgatacgcgcgtggcagaacatcccgattgtcagctacctgctcctgcgcggcaaatgcgcttcctgccaaaccaaaatcagcatacgttatcccttaatcgagctgctgaccggcgtattgttcgggctggttgcctggcaatacggctggtcttggattacattgggcggtttgatactgaccgcgtttctgatttccctgacctttatcgatgcggacacccaatacctgcccgactcgatgaccttacccttgatttggctggggctgatatttaatttggacggcggcttcgtgcctttgcagtctgccgttttaggtgcggttgccggctatggttcgatatggcttttatgcgcggtatataaactgattaaaggcgaaatcggtatgggcaacggagatttcaaactgattgccgcattgggcgcgtggctcggcatatccgcattgcccgtgctgatttttgtttcctcgctgatcggtttggtcgcggcaatcgttatgcgcgtcgccaaggggcagcattttgccttcggccccgcactgacagtttcgggctggataatttttacggcaaacgattccgtatggcgggcggtcaactggtggctgacccatccggtgctgtaa

SEQ ID NO: 106359 - protein, 286 aa, Neisseria meningitidis Z2491
MSDLSVLSPFAVPLAAVFGLLVGSFLNVVIYRVPVMMERGWTVFAKEYLNLPLTEEESRTFNLMKPDSCCPKCRVPIRAWQNIPIVSYLLLRGKCASCQTKISIRYPLIELLTGVLFGLVAWQYGWSWITLGGLILTAFLISLTFIDADTQYLPDSMTLPLIWLGLIFNLDGGFVPLQSAVLGAVAGYGSIWLLCAVYKLIKGEIGMGNGDFKLIAALGAWLGISALPVLIFVSSLIGLVAAIVMRVAKGQHFAFGPALTVSGWIIFTANDSVWRAVNWWLTHPVL

SEQ ID NO: 106360 - DNA, 1167 bp, Deinococcus radiodurans R1
  CDS (1)..(1167): transl_table=11
gtgaacgtcgacaccctcatcgtcctcttcgccgggctgctgggcctgctggtggggtctttttccaatgtgctgatctggcgcctgccgagaggcgaaaacatcgcttttccgccgagccactgccccaagtgcgaccatccgctcaagcccaccgacctcgtgccggtcttttcctggctggcgctgggaggccgctgccgctactgccgcgcacccattaacccgcgctatccggtggtggaactgctcacgggcgtcgcctacgccgtcattgccgcgacgtttccgctgagcacctacgaggcgggcacgctgggactgatggtgctgttcacgattttgctcgtcggcagcgcgattgacctcgacaccatgactctccctgacgagctgacgctgcccggcaccctgctcggcgtgctgttcgggctcgcgggcgcggggctctacgcgcaggagggtcagttgggcctgcccaacgtcgcgcaggcggtggaaggcgcgctgatgggcgcgggcgtcatcgtcttgatcagcgtgtacggctcgtgggtgctgcggcgcttccgcgaacggcagtggcctgaagcgcccatcggttaccagcaaatcagcctggggctgctggcaggcgcgtggctggggccgtggtggggcctgggcgtcgcgctgctctcggcggcggtcaacgtggcggcgaaaaaggccgtgcggattcctgaactgctcacgctgggcggctttctggtcagcctcgccctgagcagcgcgggcacagggccgggcctgctcgacatgctgcgcggcggcctgatggcggcgggcgccgtctcgctcgtctgcggcgtgtactggtggatctactggcggcgcaacaagcaggctgaagacgacggcaccgacgacgagcagagtgacccggtggcgatgggcttcggggacgtgaagctcgccgctgtgattggcgcctttctgggctgggagcggctgctgcttgccgtggtggtggcaatttttgcgggcgccgtgctggggctggtgcaactcgcgctcaagcaggaaaaccgggtcaagttcggcccttacctcgccctgggggccgtcgtcgcgctgctgtggggcgggccgctgctggactggtaccgggggctgctagggatgtaa

SEQ ID NO: 106361 - protein, 388 aa, Deinococcus radiodurans R1
MNVDTLIVLFAGLLGLLVGSFSNVLIWRLPRGENIAFPPSHCPKCDHPLKPTDLVPVFSWLALGGRCRYCRAPINPRYPVVELLTGVAYAVIAATFPLSTYEAGTLGLMVLFTILLVGSAIDLDTMTLPDELTLPGTLLGVLFGLAGAGLYAQEGQLGLPNVAQAVEGALMGAGVIVLISVYGSWVLRRFRERQWPEAPIGYQQISLGLLAGAWLGPWWGLGVALLSAAVNVAAKKAVRIPELLTLGGFLVSLALSSAGTGPGLLDMLRGGLMAAGAVSLVCGVYWWIYWRRNKQAEDDGTDDEQSDPVAMGFGDVKLAAVIGAFLGWERLLLAVVVAIFAGAVLGLVQLALKQENRVKFGPYLALGAVVALLWGGPLLDWYRGLLGM

SEQ ID NO: 106362 - DNA, 864 bp, Xylella fastidiosa 9a5c
  CDS (1)..(864): transl_table=11
atggcatttcttgaccagcaccccggtctcggttatccccttgcgtccggtttggggttgttgcttggtagttttctcaatgtggtgatcctgcgtttgccgcgccgtttggaatggcaatggaagcgcgatgcgcgcgaaatcctggagatgccggacatttatgatccgccaccaccgggaattgtggtcgagccttcccacgatccagtgactggtgatcggttgaagtggtgggaaaacattccggtgcttagctggttgttgctacgtggacgttcgcgttacagcggcaagtcaatctcgttgcagtatccgttggtcgaattgctgacttgcctgctggtgctggccagtgtttggcgttttggattcggttggcatggttttggggcaattgtgttcagttgtttcctggttgcgttggctgggattgatttgcgtactcggctcttacctgaccagttaactttaatgctcatgtggctgggtttgattggatcgacggataacttgtttatggcagccaaacctgcgttattgggggctgtagttggttatttatctctgtggattgtggcggcgttgttcaaactgatctttaacaaggaagggatgggccatggtgacttcaaaatgctggccgcgcttggggcatggtgtgggttgaagggtattctcccgatcattttgatttcatcactggctggagtggtattgggctccgtttggcttgttgtgcgtggtcataaccgtacaacgatgattccgtttggaccttatctggcagttggtggatggatcgtgttctttttcggcgatcagatcatccatgcttatctggagctattaagtatcgggtga

SEQ ID NO: 106363 - protein, 287 aa, Xylella fastidiosa 9a5c
MAFLDQHPGLGYPLASGLGLLLGSFLNVVILRLPRRLEWQWKRDAREILEMPDIYDPPPPGIVVEPSHDPVTGDRLKWWENIPVLSWLLLRGRSRYSGKSISLQYPLVELLTCLLVLASVWRFGFGWHGFGAIVFSCFLVALAGIDLRTRLLPDQLTLMLMWLGLIGSTDNLFMAAKPALLGAVVGYLSLWIVAALFKLIFNKEGMGHGDFKMLAALGAWCGLKGILPIILISSLAGVVLGSVWLVVRGHNRTTMIPFGPYLAVGGWIVFFFGDQIIHAYLELLSIG

SEQ ID NO: 106364 - DNA, 843 bp, Yersinia pestis CO92
  CDS (1)..(843): transl_table=11
atgatggatatacaggttttttttgtgagctatttaatttttggggccatggtaggcagctttcttaatgttttaatctatagattgcctattatgctggctaatttatcatcacgatctgagtcacacggtgaagaaattaagatgcgttctcatttgagaaatattaatttatttcaacccggctctttttgccatcattgcaatgagtcaataccaataaaatataatataccgatactcggttggatttttctgcgtggtgccagtcgttgttgtaacaagaagataagcacccgctatctatttattgaagtattagctgtcattcaaacactcttggttcttatgatttttaaagaggacttacttatctgcactagcttggtgctaatttggtcacttacggcattggcatttatagatttcgatacctacctccttcctgattgtatgacaatacctttgctgtggcttggtcttcttatcaatatagatacggtttttgcaccactaacctctgcagtactgggtgctgtcagtggatacctttttctttggctatcatattggttgtttaaaatagtaagaggtgttgatggaatgggctatggtgattttaaattaatggccgcattaggtgcttggtttggtgtgagtgcagtaccttttttaatattgttctcttccttttttggtcttgtcgcatatgctattttttatttttttgataaaaaagataatggaaaagagattaattacatcgcatttggcccttatatttcattggcgggtgttctatacctgtttcttgggagtcatgtgactaatttattttcttaa

SEQ ID NO: 106365 - protein, 280 aa, Yersinia pestis CO92
MMDIQVFFVSYLIFGAMVGSFLNVLIYRLPIMLANLSSRSESHGEEIKMRSHLRNINLFQPGSFCHHCNESIPIKYNIPILGWIFLRGASRCCNKKISTRYLFIEVLAVIQTLLVLMIFKEDLLICTSLVLIWSLTALAFIDFDTYLLPDCMTIPLLWLGLLINIDTVFAPLTSAVLGAVSGYLFLWLSYWLFKIVRGVDGMGYGDFKLMAALGAWFGVSAVPFLILFSSFFGLVAYAIFYFFDKKDNGKEINYIAFGPYISLAGVLYLFLGSHVTNLFS

SEQ ID NO: 106366 - DNA, 933 bp, Escherichia coli K12
  CDS (1)..(933): transl_table=11
atgcgcctgcttatcgggcctacagacggggaaagccgcgattatttgcgctggcagacacccgtaggacggataaggcgttttacgccgcatccagcaagttacaacaaacaacctttaaccatgctttttgatgtttttcagcaataccccacggcgatgcccgtcctggcaaccgtcggaggattgatcatcggcagttttttgaatgtggtgatttggcgttacccaatcatgctgcgccaacaaatggcggagtttcacggtgaaatgtcgagtgcgcagtcaaaaataagccttgcgctaccgcgttcgcactgcccacattgtcagcagaccatccggatacgtgacaatattccgctgttctcctggctgatgctcaaagggcgctgccgcgactgtcaggcgaaaatcagcaagcgttatccgctggtggagttattgacagcacttgcttttttgctggcgagtctggtctggccagaaagtggatgggggctggcggtgatgatattatccgcctggctgattgccgcgagtgtcatcgacctcgatcaccaatggctgcccgatgtttttactcagggcgtattgtggacaggactgattgcggcatgggcgcagcagagtccgctcacgctacaagatgcagtcaccggcgtcctggtgggatttatcactttttactctctgcgttggatagccggaatagttctgcgtaaagaagcattaggcatgggcgatgtattacttttcgccgcgttaggtggctgggtgggggcattgtcgctgcccaatgttgctttaatcgcctcatgctgcggcctgatatatgccgttattacaaaaagaggatcaaccacactgccttttggaccgtgtttaagtctgggcggtatagcaacactttatctacaggcattgttttaa

SEQ ID NO: 106367 - protein, 310 aa, Escherichia coli K12
MRLLIGPTDGESRDYLRWQTPVGRIRRFTPHPASYNKQPLTMLFDVFQQYPTAMPVLATVGGLIIGSFLNVVIWRYPIMLRQQMAEFHGEMSSAQSKISLALPRSHCPHCQQTIRIRDNIPLFSWLMLKGRCRDCQAKISKRYPLVELLTALAFLLASLVWPESGWGLAVMILSAWLIAASVIDLDHQWLPDVFTQGVLWTGLIAAWAQQSPLTLQDAVTGVLVGFITFYSLRWIAGIVLRKEALGMGDVLLFAALGGWVGALSLPNVALIASCCGLIYAVITKRGSTTLPFGPCLSLGGIATLYLQALF

SEQ ID NO: 106368 - DNA, 810 bp, Caulobacter crescentus CB15
  CDS (1)..(810): transl_table=11
ttggggcggctttgggccaaggctcctccaaccccacacgagccgctcttgaccatcgaccatctctgggctgtttcggcgctgatcctcgcgcccttcgtcggcagcttcatcggactgctgacgcttcgcctgccggcggaccggccctgggcgatgtcgcggtcagcgtgcgacacatgcaagcgccggctcggtgtcgtggatctggttccgctggtcagctttcttgtgctgcgcggacgatgcaggacctgcgggacggccattcccaggcgctaccctctccttgaaggcgggtgcctggtgatcgccctctggagcgttctggccttttcgggcggcatgatcctgctgaccgccctgatgggctggtcgttgttgttgatcgcgacgatcgacaccgagcatctgtggcttcccgacaggctgaccctgcccttcggcgccctgggcgtcatcgcaacgctcgcgatcggcgaggtcccggtctggacgccattggtcggcgccgccgtcggctttggcggcctggctctgatcgcctggctctacaagacggtccggggatttgacggcatgggcggcggcgatccgcgcctgctcggcgcgatcggggcctgggtggggtggcaaggcctgccgtcggtgctggtctgggcgtgtgtcgcgggcctgagcgtggcgatcgcccagaccctcgtccgtcgccgcttctcaggcgatcagcaactcccgttcggcgccttcctggcgatcggcgcctggctgacctggctctggggtccgctgcatgctctgctgacctag

SEQ ID NO: 106369 - protein, 269 aa, Caulobacter crescentus CB15
MGRLWAKAPPTPHEPLLTIDHLWAVSALILAPFVGSFIGLLTLRLPADRPWAMSRSACDTCKRRLGVVDLVPLVSFLVLRGRCRTCGTAIPRRYPLLEGGCLVIALWSVLAFSGGMILLTALMGWSLLLIATIDTEHLWLPDRLTLPFGALGVIATLAIGEVPVWTPLVGAAVGFGGLALIAWLYKTVRGFDGMGGGDPRLLGAIGAWVGWQGLPSVLVWACVAGLSVAIAQTLVRRRFSGDQQLPFGAFLAIGAWLTWLWGPLHALLT

SEQ ID NO: 106370 - DNA, 810 bp, Nostoc sp. PCC 7120
  CDS (1)..(810): transl_table=11
atggaaactttgatagtaaccctggcgagtgtgttcgttttcgccttgggtgcatctattggcagctttattaatgttgtagtttatcggttaccggcgggattatcaattctgtggccgccctctcgttgtcctcattgtctaaaccagctcaaagcttatgataatgtgcctgtgctgggctggatttggttaaaagggcgttgtcgtttttgtaaaaatccgatttccataagataccctgtagtggaagcagtgacagggataatttttctttgcgtatttttgatatttaaagtttcaattctgaccttaggatactggacattttgcggctggctattagcattgtccctaattgatttagatactatgaccctacctaatcccctcactaaatcaggattggtcttgggtttggtgtttcaaatgattgttggctatgctgctgaccctactttgtcaggattaattagacacttaatgatgggtatcgttggcgctgttttgggtttatggttatttgaggcgatcgctcttttaggggttgtcttccaaaaagaagcaatgggtgcaggagatgccaagcttgctgccatgatgggtgcttggttgggttggcgatacttacttctggctggattgattgcctgtaccttaggcgcattggtaggtgttggggctatcctgctctcaaaacgcaaatgggggcaaaaaatcccctttggcccttttctcgcctcaggagctttgatcaccctctttggtggacaaccaatcttgtctgcttatttacagttgtttttttaa

SEQ ID NO: 106371 - protein, 269 aa, Nostoc sp. PCC 7120
METLIVTLASVFVFALGASIGSFINVVVYRLPAGLSILWPPSRCPHCLNQLKAYDNVPVLGWIWLKGRCRFCKNPISIRYPVVEAVTGIIFLCVFLIFKVSILTLGYWTFCGWLLALSLIDLDTMTLPNPLTKSGLVLGLVFQMIVGYAADPTLSGLIRHLMMGIVGAVLGLWLFEAIALLGVVFQKEAMGAGDAKLAAMMGAWLGWRYLLLAGLIACTLGALVGVGAILLSKRKWGQKIPFGPFLASGALITLFGGQPILSAYLQLFF

SEQ ID NO: 106372 - DNA, 885 bp, Ralstonia solanacearum GMI1000
  CDS (1)..(885): transl_table=11
atgatgcccggaatgttcgtcattcccacgctggcgcaactgccggcgtggttcgtgatcggcgcggggacgctgctgggcttgctggtcggcagcttcctcaacgtggtgattcaccgcctgccgcgcatgatcgagcgcgaagaggccaactacatcgccgagctgcgcaacgaaccgctgccgcatcccgagccgtacaacctggtcgtgccgcgctcggcctgcccgtcgtgcggccaccagatcaaggcggtcgagaacatcccggtgctgagctggctggcgttacgcggccgctgcagcgcctgcaagacccccatctcctggcgctatcccgccgtggagctggtgaccggcgtgctgaccggcgcctgcctgtggcacttcggaccgacctgggtagcggtggcctcggccgcgctgctgtggttcctgatcgccggctcgatgatcgacgccgacacgcaactcctgcccgatgccatcacccagccgctgctgtggctcggcctgctggtgaacctgttcagcatgttcgcgcggctgccggacgcggtaatcggcgcgacggcggggtatctgttcctgtgggccatctactgggcctataagctcctgcgcggccgggaaggcatgggctacggcgacttcaagctgatgggcgcgctgggcgcctggttcggctggcaggcgctgccgctgctggtgctgctgtcgtcggtggtcggcctggtgttcggggtggtgcgcatcgcgcgcggcgccacgagcgaatcgccgttctcgttcggcccgttcatcgcgggtgccggcgtgatcgcgctgctggccggcccgcaactggtggcgctgacggggctcgcgccactgctggcgcggtaa

SEQ ID NO: 106373 - protein, 294 aa, Ralstonia solanacearum GMI1000
MMPGMFVIPTLAQLPAWFVIGAGTLLGLLVGSFLNVVIHRLPRMIEREEANYIAELRNEPLPHPEPYNLVVPRSACPSCGHQIKAVENIPVLSWLALRGRCSACKTPISWRYPAVELVTGVLTGACLWHFGPTWVAVASAALLWFLIAGSMIDADTQLLPDAITQPLLWLGLLVNLFSMFARLPDAVIGATAGYLFLWAIYWAYKLLRGREGMGYGDFKLMGALGAWFGWQALPLLVLLSSVVGLVFGVVRIARGATSESPFSFGPFIAGAGVIALLAGPQLVALTGLAPLLAR

SEQ ID NO: 106374 - DNA, 780 bp, Streptomyces coelicolor A3(2)
  CDS (1)..(780): transl_table=11
atgagcatcgacaccgccatcgactccgtcatgaacagcgccatcgacatcgacctcgtggtcgtcctcgtcgccgcgctgtggggcgcggcgacgggcgcgctgctgccccgcgcggcctaccggttctccgccccgtccggggaggcgtggcgcgagcggtgcccggacgggcaccccgtacgcggctggctcggccgggcccggtgcgggcagtgcccggccggtcaggcgtcccacggcccgcgcaccgcgtccctcgccgtcgccaccgccctcgtctgcgccgcgctcgccgccgccaccgggacccggcccgaggccgccgtctggctgctgctcgccccggtcggcgtgctcctggccgtcgtcgacctgaaggtacggcggctgcccgacccgctcaccctgccgctggccggcgccgcgctcgtcctgctcgggctcaccgcgctcgtgcccgagcacgcgggggagtgcacgaccgccctgctgggcgccctcgccctcggcgccggctatctcgtgctgttcctcatcaacccggccggcatgggcttcggcgacgtcaagctcgccctcacggccggtgccgtcctcggctggtacggctggcccaccctgatgctgggcaccttcgccgggttcctgctcggggcgctgtacggcggcgccctcctcgtcgcccggcgcgcggaccgcaagacggccatccccttcgggccgttcctgatcgccggcgccttcctcggcgtcctggccggggcctacgcggcctga

SEQ ID NO: 106375 - protein, 259 aa, Streptomyces coelicolor A3(2)
MSIDTAIDSVMNSAIDIDLVVVLVAALWGAATGALLPRAAYRFSAPSGEAWRERCPDGHPVRGWLGRARCGQCPAGQASHGPRTASLAVATALVCAALAAATGTRPEAAVWLLLAPVGVLLAVVDLKVRRLPDPLTLPLAGAALVLLGLTALVPEHAGECTTALLGALALGAGYLVLFLINPAGMGFGDVKLALTAGAVLGWYGWPTLMLGTFAGFLLGALYGGALLVARRADRKTAIPFGPFLIAGAFLGVLAGAYAA

SEQ ID NO: 106376 - DNA, 864 bp, Xanthomonas axonopodis pv. citri str. 306
  CDS (1)..(864): transl_table=11
atggcatttctcgaccagcatcccggtctcggctttcctgccgcggccggactgggactgctgatcggcagcttcctgaacgtggtgatcctgcgcttgcccaagcgtatggagtggcaatggcggcgggatgcgcgcgagattttggaactgcccgatatctacgagccgccgccgcccgggatcgtggtggagccgtcgcacgacccggtgacaggcgacaagctcaagtggtgggaaaacattccggtcctgagctgggcgatgctgcgcggcaagtcacgctacagcggcaagccgatctccatccagtatccactggtcgagttgctcacctccatcctgtgcgtcgccagcgtgtggcgcttcggctttggctggcagggcttcggcgcgatcgtgctgagctgctttcttgtggcgatgtcgggcatcgacctgcgccacaagctgctgcccgaccagttgaccctgccgttgatgtggttggggctcgtcggatcgatggacaacctctacatgccggccaagcctgctctgctgggcgcggcggtcggctatgtgtcgctatggacggtgtggtggttgttcaagcagctcaccggcaaggaaggcatgggccacggcgacttcaagttgctggccgcgcttggcgcgtggtgcgggttgaaaggcatcctgccgatcatcctgatctcctcgctcgtcggcgccatcctcggctcgatctggctggtggccaagggccgcgaccgcgccacccccatcccgttcggcccctacctggccattgctggctgggtggtgttcttttggggcaacgacctggtggacggctacctgcacttcgcaggcctgcgttga

SEQ ID NO: 106377 - protein, 287 aa, Xanthomonas axonopodis pv. citri str. 306
MAFLDQHPGLGFPAAAGLGLLIGSFLNVVILRLPKRMEWQWRRDAREILELPDIYEPPPPGIVVEPSHDPVTGDKLKWWENIPVLSWAMLRGKSRYSGKPISIQYPLVELLTSILCVASVWRFGFGWQGFGAIVLSCFLVAMSGIDLRHKLLPDQLTLPLMWLGLVGSMDNLYMPAKPALLGAAVGYVSLWTVWWLFKQLTGKEGMGHGDFKLLAALGAWCGLKGILPIILISSLVGAILGSIWLVAKGRDRATPIPFGPYLAIAGWVVFFWGNDLVDGYLHFAGLR

SEQ ID NO: 106378 - DNA, 915 bp, Yersinia pestis KIM
  CDS (1)..(915): transl_table=11
atgatgatgatgggtatgttgcaggaaaaattatattctttaaatgaaccactcggtctgatagaggtaaacatgatggatatacaggttttttttgtgagctatttaatttttggggccatggtaggcagctttcttaatgttttaatctatagattgcctattatgctggctaatttatcatcacgatctgagtcacacggtgaagaaattaagatgcgttctcatttgagaaatattaatttatttcaacccggctctttttgccatcattgcaatgagtcaataccaataaaatataatataccgatactcggttggatttttctgcgtggtgccagtcgttgttgtaacaagaagataagcacccgctatctatttattgaagtattagctgtcattcaaacactcttggttcttatgatttttaaagaggacttacttatctgcactagcttggtgctaatttggtcacttacggcattggcatttatagatttcgatacctacctccttcctgattgtatgacaatacctttgctgtggcttggtcttcttatcaatatagatacggtttttgcaccactaacctctgcagtactgggtgctgtcagtggatacctttttctttggctatcatattggttgtttaaaatagtaagaggtgttgatggaatgggctatggtgattttaaattaatggccgcattaggtgcttggtttggtgtgagtgcagtaccttttttaatattgttctcttccttttttggtcttgtcgcatatgctattttttatttttttgataaaaaagataatggaaaagagattaattacatcgcatttggcccttatatttcattggcgggtgttctatacctgtttcttgggagtcatgtgactaatttattttcttaa

SEQ ID NO: 106379 - protein, 304 aa, Yersinia pestis KIM
MMMMGMLQEKLYSLNEPLGLIEVNMMDIQVFFVSYLIFGAMVGSFLNVLIYRLPIMLANLSSRSESHGEEIKMRSHLRNINLFQPGSFCHHCNESIPIKYNIPILGWIFLRGASRCCNKKISTRYLFIEVLAVIQTLLVLMIFKEDLLICTSLVLIWSLTALAFIDFDTYLLPDCMTIPLLWLGLLINIDTVFAPLTSAVLGAVSGYLFLWLSYWLFKIVRGVDGMGYGDFKLMAALGAWFGVSAVPFLILFSSFFGLVAYAIFYFFDKKDNGKEINYIAFGPYISLAGVLYLFLGSHVTNLFS

SEQ ID NO: 106380 - DNA, 747 bp, Thermosynechococcus elongatus BP-1
  CDS (1)..(747): transl_table=11
gtgggaagctttctcaatgttgtgatctaccgtgtgccaagggggcgatcgctcctttatccaccgtctcgctgcccgatctgtttgacaagactcaagccccgggacaatatcccaattttgggctggctattcctccgggggcaatgtcgatattgccatgcgccgatttcgtggcggtaccctgcgattgagctgttgacggcactgctttatgtcctgattgtggctgtcagtggttggcaggggcaaactctggtgctgtggctgctgagtgcgtggctcttggccttggccttgattgatctcgatacgatgacgctgccccatcccctgacgaagtggggattgatcactgggttgctcgcgcgagggctaacaacgggtctagggggaattacagaggggatcattgccgccgtgattggcatttggctctttgatttgatccgctgggggggagcgatcgcttttaatcaagaggtgatgggcggcggagacggtaaactagcggcgatgattggggcttggctaggttggcaggggttgctggttacgttttttttggcctgtgccctgggtggcctcatggggggattcggtattgccctgggttggattcagcgccgccaacccattccctttggcccttttttagcagtggctgccatctttagtggtctctttggccgccaattgattcatctttacctggaaacctttttacccggcgtgtttgttccctag

SEQ ID NO: 106381 - protein, 248 aa, Thermosynechococcus elongatus BP-1
MGSFLNVVIYRVPRGRSLLYPPSRCPICLTRLKPRDNIPILGWLFLRGQCRYCHAPISWRYPAIELLTALLYVLIVAVSGWQGQTLVLWLLSAWLLALALIDLDTMTLPHPLTKWGLITGLLARGLTTGLGGITEGIIAAVIGIWLFDLIRWGGAIAFNQEVMGGGDGKLAAMIGAWLGWQGLLVTFFLACALGGLMGGFGIALGWIQRRQPIPFGPFLAVAAIFSGLFGRQLIHLYLETFLPGVFVP

SEQ ID NO: 106382 - DNA, 756 bp, Oceanobacillus iheyensis HTE831
  CDS (1)..(756): transl_table=11
atgtttaatattcaccctctatttttcttcatcctcggagctattttgggctcattttttatggtcgtgggtttacgactccccaaacagatgccctttgttaatgcccgatcatgttgtgatcattgtcaatatcaacttcgttggttcgataatattcctattgtttcttatatttatctaagggggaagtgcagaaaatgtaaaacaagaatccatccgctccatgttgtagcagaaatcataactgggattttatttacggtaagctattatcacatcggtttacagtgggaaataattatttccttattacttacatctttattagttataatttgcatttcagattttatatacatggtgatcccaaacaaattgttacttttctttctccccatcttcattattttacgacttttacttccattagatccatggtggtctatgtttacaggtgctgcaataggcttcggtattatatttcttatcatattaattagtagaggcgggatgggggctggtgatatgaaattacttggccttgcaggtattgttttaggtgttgaaaaaattattctagcatttttcttagcatgcataatcggttctgtcatcagcattgttttattatctgtccatttaattcaacgtaataaaccatttccatttggtccctttatcgcgattggtattctcatatcctatttttatggagattcattaattaattggtatcttcaatattttatttaa

SEQ ID NO: 106383 - protein, 251 aa, Oceanobacillus iheyensis HTE831
MFNIHPLFFFILGAILGSFFMVVGLRLPKQMPFVNARSCCDHCQYQLRWFDNIPIVSYIYLRGKCRKCKTRIHPLHVVAEIITGILFTVSYYHIGLQWEIIISLLLTSLLVIICISDFIYMVIPNKLLLFFLPIFIILRLLLPLDPWWSMFTGAAIGFGIIFLIILISRGGMGAGDMKLLGLAGIVLGVEKIILAFFLACIIGSVISIVLLSVHLIQRNKPFPFGPFIAIGILISYFYGDSLINWYLQYFI

SEQ ID NO: 106384 - DNA, 927 bp, Shewanella oneidensis MR-1
  CDS (1)..(927): transl_table=11
atgactgaatttttcactttattgggtcacacctttgaccaagcaccatggctttttatctcattaagttttgtgtttgcggccaccattggcagctttttaaatgtggtgattcaccgttttccggtgatgatgaaacgcgaatggcagcaggaatgtaatcagtatttgcaggaatatcatgccgatattgttaagcaagtgggtatcgataagctcagtaaagcgatagatcactatcctccaaaatacaatctcgtggtgccaggctccgcttgccctaaatgtaaaaccgccatcaaaccttggcataatttaccgatgttaggctggttaatgttgcgaggaaaatgcgccgcctgtagcgcgccaatctcagcccgttaccccattattgaattaataaccggtttactggttgcgacattggcttggcattttggcccaagctggcaatttgtgtttgctgcaatcctcacttttgtgttgattgcgctgacgggaatcgatctggatgaaatgctgttacccgatcagatgacccttcccctgctgtggttagggctactcatcaacctaaaccatacctttaccagcccagccgatgcgatgattggtgcggcagctggctatttaagtttgtggtcgattttttggctgtttaagctgttaactggcaaagagggcatgggttatggtgactttaaactactcgccgtatttggtgcttggctaggctggcaaatgttgccgctggtcattttactttcatccttggttggcgccttcgttggcatcacgctgatcgtgaccaagcgtaatcagcttgctaacccgattccctttggtccttacattgccgccgcaggctggatcgccctaatatggggccaacctatagtggattggtatttaagtacgttatag

SEQ ID NO: 106385 - protein, 308 aa, Shewanella oneidensis MR-1
MTEFFTLLGHTFDQAPWLFISLSFVFAATIGSFLNVVIHRFPVMMKREWQQECNQYLQEYHADIVKQVGIDKLSKAIDHYPPKYNLVVPGSACPKCKTAIKPWHNLPMLGWLMLRGKCAACSAPISARYPIIELITGLLVATLAWHFGPSWQFVFAAILTFVLIALTGIDLDEMLLPDQMTLPLLWLGLLINLNHTFTSPADAMIGAAAGYLSLWSIFWLFKLLTGKEGMGYGDFKLLAVFGAWLGWQMLPLVILLSSLVGAFVGITLIVTKRNQLANPIPFGPYIAAAGWIALIWGQPIVDWYLSTL

SEQ ID NO: 106386 - DNA, 663 bp, Corynebacterium efficiens YS-314
  CDS (1)..(663): transl_table=11
ttgtcgacgccttctccggaatgtgatggcgcgtctacgagtctgtggatcgtgctgctcaccgccctgctcacggccgtggccgccgctctgctctccgggcagatcagccccttcgtccccgaaccgtcccggtgggtgcgggcccggttccacgtggtgctcgccgcggcactgggtgcaggcgctgctctgctggccacgaatcccgccgagctgatcggcctggccgccgccgcagtcggatgcaccttgctcatggtcatcgacctggctgtctgccggctccccgaccgactggtcgccgcgaccctgctggcactggtcctggggttcctcgcctccgcagcggtgggaggcacctggaacgactgggtgcgcgccctgctcgccggcctggtcctgctcctgggctatttcgcccttgcattcatcgcccccgcgggtctggggctgggggacgtgaaattcgccgccgtggtgggagtgttcctcgggtggttcagctggcagcatgtggccatcggaacgttgctcgccttcgtactcaatgtagtcgtcgccgtcgcggtcctgctaacaagatgtggcaatcggaagaccgatattcccttcggcccctggatggtggccggtgccgtgctcgccgtcgtcctgctctaa

SEQ ID NO: 106387 - protein, 220 aa, Corynebacterium efficiens YS-314
MSTPSPECDGASTSLWIVLLTALLTAVAAALLSGQISPFVPEPSRWVRARFHVVLAAALGAGAALLATNPAELIGLAAAAVGCTLLMVIDLAVCRLPDRLVAATLLALVLGFLASAAVGGTWNDWVRALLAGLVLLLGYFALAFIAPAGLGLGDVKFAAVVGVFLGWFSWQHVAIGTLLAFVLNVVVAVAVLLTRCGNRKTDIPFGPWMVAGAVLAVVLL

SEQ ID NO: 106388 - DNA, 867 bp, Pseudomonas putida KT2440
  CDS (1)..(867): transl_table=11
atgactttatgggctttgctggctgaacagccagcgtatttcctcacccttgccacggtgctcggcctgctggtgggcagctttatcaacgtgctggtgtatcgcctgccgatcatgctggagcggcaatggcagcgtgaggcgcaagaggtattggggctgccgaccacgcagcacgcgcgtttcgacctgtgcctgcccgcctcccggtgcccacactgcgcgcaccggattcgtgcgtgggagaacattccggtcatcagctacctggccttgggcgggcgctgttcgtcctgcaaaaaccgcatcagcctgcgttacccggtagtggaagtggccagcgcgctgctgtcgctggtagtggcctggcgcttcggcgcttcggtagaggcgttggtggctctgccgctgacctggtgcctgctggcgctgagcctgatcgatgcggaccaccagctgctgccggatgtgctggtgctgccgaccatgtggctagggctgatcgtcaatgcctttggcatccatgtgcccctggccgacgcactgtggggcgcagtggccgggtacctcagcctgtggacggtgtactgggtgttcaggctggtcaccggcaaggaaggcatgggctatggcgatttcaagctgatggcgctgatcggggcgtgggggggttggcaggtgctgccgttgacgctgctgttgtcgtcggtggtgggggcgctgtttggcctgtgcctgctgcgttttcgccgggatgccatgggcacggcaatcccgtttggcccttatctggcaattgcggggtggattgccgtgctctggggtgatgaaatatacgcctcatacatgcaactgcttggatactga

SEQ ID NO: 106389 - protein, 288 aa, Pseudomonas putida KT2440
MTLWALLAEQPAYFLTLATVLGLLVGSFINVLVYRLPIMLERQWQREAQEVLGLPTTQHARFDLCLPASRCPHCAHRIRAWENIPVISYLALGGRCSSCKNRISLRYPVVEVASALLSLVVAWRFGASVEALVALPLTWCLLALSLIDADHQLLPDVLVLPTMWLGLIVNAFGIHVPLADALWGAVAGYLSLWTVYWVFRLVTGKEGMGYGDFKLMALIGAWGGWQVLPLTLLLSSVVGALFGLCLLRFRRDAMGTAIPFGPYLAIAGWIAVLWGDEIYASYMQLLGY

SEQ ID NO: 106390 - DNA, 678 bp, Escherichia coli CFT073
  CDS (1)..(678): transl_table=11
atgacaatgctactgccgctcttcattctggttggttttattgcaggttattttgttaatgtcatggcctatcacctctcgcctttggaggataaaacggcgttaacgtttcgccaggtattggttcatttctggcaaaaaaaatatgcctggcatgatacagtgcccctgatactttgcgttgctgctgctatcgcctgcgccctggcacctttcacgcccattgtgactggcgcactctttctctatttctgtttcgcactcacgctcagtgttattgattttcgcactcagctcctgcccgacaaactcaccttaccgctgctctggcttggcttggtatttaatgcgcagtctggattaattgatttacatgatgcggtttatggcgcggtcgctggctatggggtgctgtggtgtgtttactggggcgtctggttagtttgtcacaaagagggattgggctacggtgatttcaagctactggccgctgcaggcgcgtggtgtggctggcaaacgttaccaatgatactgctgattgcctcgctgggtggcattggttacgccatcgtttcacaacttctgcaacgccggactatacccactatcgcattcggcccgtggcttgcgctcggcagcatgataaacctgggatatctggcctggatctcttattaa

SEQ ID NO: 106391 - protein, 225 aa, Escherichia coli CFT073
MTMLLPLFILVGFIAGYFVNVMAYHLSPLEDKTALTFRQVLVHFWQKKYAWHDTVPLILCVAAAIACALAPFTPIVTGALFLYFCFALTLSVIDFRTQLLPDKLTLPLLWLGLVFNAQSGLIDLHDAVYGAVAGYGVLWCVYWGVWLVCHKEGLGYGDFKLLAAAGAWCGWQTLPMILLIASLGGIGYAIVSQLLQRRTIPTIAFGPWLALGSMINLGYLAWISY

SEQ ID NO: 106392 - DNA, 597 bp, Bradyrhizobium japonicum USDA 110
  CDS (1)..(597): transl_table=11
gtgacgggtcaagcggcgaatgacgggacgggcgctccgctcgcgctcggcatcgccctgctgctgggcgtgttcgcaagcctcgtcaccgcgccgggcgccgaaggcctgtacggcgcgttcctggccgccctgatgctcgcgatcgcgacgcacgatgcccgccactatctcattccgaacgagctgacggggacagctttcgcgctcgccctgctccgcgccggcgcgttcgtgccggatgtcggcctcgaggcgctgatctggccgctggcccgtgcggcggccgtggcgctgccgctgctgctgctgatggtgctctaccggcgctggcgcgggcgcgacgggctcgggctcggcgacgtcaagcttgccgcggtctgcggcgcctggctcgatcttgcgaccgtggccgcggtgatcgagctcgcggcgctgctcgcgatcggcgcatacgccgccaatgctgcgctccaaagaaggccgctgcgcgcgaccgccttcctgccattcggactgttcctggcaccggcgatctggatcggctggcttggcgagacctggtatgcgaactggctcggcggctggccgggctaa

SEQ ID NO: 106393 - protein, 198 aa, Bradyrhizobium japonicum USDA 110
MTGQAANDGTGAPLALGIALLLGVFASLVTAPGAEGLYGAFLAALMLAIATHDARHYLIPNELTGTAFALALLRAGAFVPDVGLEALIWPLARAAAVALPLLLLMVLYRRWRGRDGLGLGDVKLAAVCGAWLDLATVAAVIELAALLAIGAYAANAALQRRPLRATAFLPFGLFLAPAIWIGWLGETWYANWLGGWPG

SEQ ID NO: 106394 - DNA, 864 bp, Xylella fastidiosa Temecula1
  CDS (1)..(864): transl_table=11
atggcatttcttgatcagcaccccggactcggctatccccttgcgtccggtttggggttgttgcttggtagttttctcaatgtggtgatcctgcgtttgccgcgccgtttggaatggcaatggaagcgcgatgcgcgcgaaatcctggaaatgccggacatttatgatccgccaccgccgggaattgtggtcgagccttcccacgatccagtgactggtgatcggttgaagtggtgggaaaacattccggtgcttagctggttgttgctacgtggacgttcgcgttacagcggcaagtcaatctcgttgcagtatccgttggtcgaattgctgacttgcctgctggtgctggccagtgtttggcgttttggattcggttggcatggttttggggcaattgtgttcagttgtttcctggttgcgttggctgggattgatttgcgtactcggctcttacctgaccagttaactttaatgctcatgtggctgggtttgattggatcggcggataacttgtttatggcagccaaacctgcgttattgggggctgcagttggttatttatctctgtggattgtggcggcgttgttcaaactgatctttaacaaggaagggatgggccatggtgacttcaaaatgctgggcgcgcttggggcatggtgtgggttaaagggtattctcccgatcattttgatttcatcactggctggagtggtattgggctctgtttggcttgttgtgcgtggtcataaccgtacgacgatgattccgtttggaccttatctggcagttggtggatggatcgtgttctttttcggcgatcagatcatccatgcttatctggagctattaagtatcgggtga

SEQ ID NO: 106395 - protein, 287 aa, Xylella fastidiosa Temecula1
MAFLDQHPGLGYPLASGLGLLLGSFLNVVILRLPRRLEWQWKRDAREILEMPDIYDPPPPGIVVEPSHDPVTGDRLKWWENIPVLSWLLLRGRSRYSGKSISLQYPLVELLTCLLVLASVWRFGFGWHGFGAIVFSCFLVALAGIDLRTRLLPDQLTLMLMWLGLIGSADNLFMAAKPALLGAAVGYLSLWIVAALFKLIFNKEGMGHGDFKMLGALGAWCGLKGILPIILISSLAGVVLGSVWLVVRGHNRTTMIPFGPYLAVGGWIVFFFGDQIIHAYLELLSIG

SEQ ID NO: 106396 - DNA, 873 bp, Pseudomonas syringae pv. tomato str. DC3000
  CDS (1)..(873): transl_table=11
atgcccctcctcgacctcttggccagctctcccctggccttcgtcaccacctgctgcctacttggcctgatcgtcggaagcttcctcaacgtggtcgtctaccgcctcccaaaaatgatggagcgcgactggaaagtacaatcacgggaaatgctaggcctccctgccgaaccggaccaacccgtcttcaacctgatcctgccgcactcaagctgcccgcactgcgcgcacaagatccgcccgtgggaaaacctgccggtcatcagttacctgttgctgcgcggcaaatgctcgcaatgcaaagcccccatcagcaagcgctacccagtggtggagctgacctgcgcagtgttgtcggcctacgtcgcctggcatttcggcttcggctggcaggcggctgcgatgctggtgttgagctggggtttgctggcgatgagtctgatcgatgccgatcatcagctgttacctgactctttggtgctgccactgctgtggctgggcctgatcgttaacgcctttgggctgttcacctcgctgagcgacgcgctgtggggtgcagtggccggttatctgacgctgtggtcggtgttctggcttttcaagttggtgacgggcaaggaaggcatgggctatggcgacttcaaattgctggccatgcttggcgcgtggggtggctggcagattctgccgttgaccattctgttgtcgtcgctggtgggtgcggtacttggggtgatcatgatgcgcgtgcgcagggtcgaaagtggtacgccgatcccctttggtccttatctggccattgcggggtggatcgctttgctctggggtggtcaaataaccgactcttatatgcagtttgccggtttcagatga

SEQ ID NO: 106397 - protein, 290 aa, Pseudomonas syringae pv. tomato str. DC3000
MPLLDLLASSPLAFVTTCCLLGLIVGSFLNVVVYRLPKMMERDWKVQSREMLGLPAEPDQPVFNLILPHSSCPHCAHKIRPWENLPVISYLLLRGKCSQCKAPISKRYPVVELTCAVLSAYVAWHFGFGWQAAAMLVLSWGLLAMSLIDADHQLLPDSLVLPLLWLGLIVNAFGLFTSLSDALWGAVAGYLTLWSVFWLFKLVTGKEGMGYGDFKLLAMLGAWGGWQILPLTILLSSLVGAVLGVIMMRVRRVESGTPIPFGPYLAIAGWIALLWGGQITDSYMQFAGFR

SEQ ID NO: 106398 - DNA, 870 bp, Vibrio parahaemolyticus RIMD 2210633
  CDS (1)..(870): transl_table=11
atggaagtgttccagtactacccttggctattcgtggtgtttgccagtatcttcggtttaattgtgggtagttttcttaatgtagtcatttatcggctacctaaaatcatggaattagaatggcgccgtgaatgcgccgaatcattccctgaatataagattaagccacctcaagaagttttgacattaagcgtgcctcgctcttcgtgccaaaactgcgcgacgccaattcgtattcgagacaatattcctgtaatcagctggctactgttaaaaggaaaatgccatcattgtcataccgcaattagtcctcgatatccgctgatagaattactcactgcagcgtgcgctggttttgtggcttatcatttcggctttagctactttacggttgcgttaatctttttcacatttttcttaatagccgcgacttttatcgatctcgatactatgctgctaccggaccaattaacattaccattaacttgggctggcattgcgttagcattaacagaaataagccctgttagtctacaagacgccgtaattggtgcgattgccggttatttgtgtctttggtcagtatattgggggttcaaactgcttactggtaaagaaggcatgggttacggtgattttaaattgctggctgcccttggcgcttggctaggatggcaatcattaccaatgatcatcctactttcttccgtcgtcggtgtgatattcgggctcgttcagttacgactacaaaaacaaggtatagagagagctttccctttcggcccatatttagcgattgcaggatgggtaagcttaatctggggcgaccaaattctaagttggtacttcacgtcaattttaggggtgtaa

SEQ ID NO: 106399 - protein, 289 aa, Vibrio parahaemolyticus RIMD 2210633
MEVFQYYPWLFVVFASIFGLIVGSFLNVVIYRLPKIMELEWRRECAESFPEYKIKPPQEVLTLSVPRSSCQNCATPIRIRDNIPVISWLLLKGKCHHCHTAISPRYPLIELLTAACAGFVAYHFGFSYFTVALIFFTFFLIAATFIDLDTMLLPDQLTLPLTWAGIALALTEISPVSLQDAVIGAIAGYLCLWSVYWGFKLLTGKEGMGYGDFKLLAALGAWLGWQSLPMIILLSSVVGVIFGLVQLRLQKQGIERAFPFGPYLAIAGWVSLIWGDQILSWYFTSILGV

SEQ ID NO: 106400 - DNA, 861 bp, Coxiella burnetii RSA 493
  CDS (1)..(861): transl_table=11
atgcagattatttcttttttacaatttcatttttatataacgatcgttgcaatcgccgttatcggattgatcgtgggcagttttcttaacgtggttatcgtccgttatcctaccttgctcgccgcacgttggcgccgagagtgtcaggaataccttaatttacctgtcgaacccaaaccaaaatttaatttagcaaccccgcgctcccagtgcccccgatgcaaaaaaactctaaaaattcgccataacctgccattaataagctacttaaccttgcgcggtcgctgcgcatattgtcatgaaaaaatatcgccgctttatcccatagttgaattactctgcgccattttatcggtggctattgtgattcgttatcagataagctggcaagcgctggctggattactacttacctgggtattaattgtgcttttttttattgatttaaaaacgcaactcttgcccgacgcgatcacacttcctactttatggtttggtctttccctcagcctcttttatatgttcgtatcaccttatcaagcaatatttggcgctatactcggttacggacttctatggattaccgccgcgttttatcaattaattcgtaaaaaagaaggaatgggccgtggcgattttaaaatggtcagtatgttgggcgcttggttcggccctggcattgtattaaatgttttattgctgtcggtttttctcggcctgataacaagcttcatgctactagccctgaaaaaaatatcagtgaaacaacccattccctttggcccttttattgctgtagcgggctggatcagccttttgtcgggtccggttctaatacacaaattgatttcttatttataa

SEQ ID NO: 106401 - protein, 286 aa, Coxiella burnetii RSA 493
MQIISFLQFHFYITIVAIAVIGLIVGSFLNVVIVRYPTLLAARWRRECQEYLNLPVEPKPKFNLATPRSQCPRCKKTLKIRHNLPLISYLTLRGRCAYCHEKISPLYPIVELLCAILSVAIVIRYQISWQALAGLLLTWVLIVLFFIDLKTQLLPDAITLPTLWFGLSLSLFYMFVSPYQAIFGAILGYGLLWITAAFYQLIRKKEGMGRGDFKMVSMLGAWFGPGIVLNVLLLSVFLGLITSFMLLALKKISVKQPIPFGPFIAVAGWISLLSGPVLIHKLISYL

SEQ ID NO: 106402 - DNA, 744 bp, Streptomyces avermitilis MA-4680
  CDS (1)..(744): transl_table=11
gtggacgtggacttcgatgtctggctgaccggccctgccgctctgtggggtgcggcggcgggtctgctcgtgccccgggccgcgtatcgcctctgcgtggaacccgacgagccgtggcgcgaccggtgtccgcgggggcacccgatcaccggtggccccggcggctggctcggacgggcgcggtgcccggacggcacggtgtacgggccctccgccgtcctcgtctgcgccgccaccgccctggtctgcgcggccctcgccctcgccaccggcacccgccccgaactggccgtctggctgctgctcgcgcccctcgccgtgctgctgacgatcgtggacttccgggtgcagcggctgccggacgtgctcacgctcccgctcgcgggtgccgcggccgccctgctgggcgtggccgcgctcgcgcccgagcacgcgggggagtggctgaccgcgctgctcggggcgctcgcgctcggcggcgcgtacttcgtcctcttcctcgtcaacccgaacggcatgggcttcggcgacgtcaaactggcgctggggctcggggcggtgctcggctggtacgggtggagcacggtcgtcctgggcacgttcgccgggttcctgttcggcgggctgtacgggctggggctcgtggcctcgcggcgggccgggcgcaggacgtcgatcccgttcgggccgtttctgatcgcgggggcgttcgtggggctgctgatcggggcttacaccagttag

SEQ ID NO: 106403 - protein, 247 aa, Streptomyces avermitilis MA-4680
MDVDFDVWLTGPAALWGAAAGLLVPRAAYRLCVEPDEPWRDRCPRGHPITGGPGGWLGRARCPDGTVYGPSAVLVCAATALVCAALALATGTRPELAVWLLLAPLAVLLTIVDFRVQRLPDVLTLPLAGAAAALLGVAALAPEHAGEWLTALLGALALGGAYFVLFLVNPNGMGFGDVKLALGLGAVLGWYGWSTVVLGTFAGFLFGGLYGLGLVASRRAGRRTSIPFGPFLIAGAFVGLLIGAYTS

SEQ ID NO: 106404 - DNA, 861 bp, Nitrosomonas europaea ATCC 19718
  CDS (1)..(861): transl_table=11
atgaattttcttgataccctgcaggcttcatctctttttttcgtttcgttcatctcgataatcggcctgctcctgggcagtttcctgaatgtagtgatttatcggctgcccgagatgctgaaacgtgagtggcagcaacagtgtgcagagctgcgcggggaacagataaaagcactgccggtatataacctggctataccgggatccggttgtccgcagtgtgggcataaaatttccattcttgaaaatatcccgatcatcagttacctttttttgcgaggacagtgttccggttgccatacgcgcattccgttcagctatcctctggtcgaagcgctgacggccattctgagcggtctggccgcttggcattttggtttcggtggccttctgtttgctgtcctggtttttgtgtgggcgatgatcgttctgacctttatcgacctgaatactcagcttttaccggacagtatcacccagccgttattgtggacagggttgatcgtcaatctgaacaacggttttaccgatgttcattcggctgtggtcggtgcggttgcaggttatctcacgctctggagtgtttactggctgttcagattgctgaccggcaaggaaggcatgggatacggcgatttcaagctgctggctgcaatcggtgcctggctgggctggcaattgctgccactggtcattctgttttcttctgtggtgggtgccgtcgttggtactgttctgattctatctgccggccattcgaaaaacatgacacttccctttggcccttatctggctggcggcgggctgatcgccctgttctggggtaagcagatcaatcaggcttaccttgccatgttctga

SEQ ID NO: 106405 - protein, 286 aa, Nitrosomonas europaea ATCC 19718
MNFLDTLQASSLFFVSFISIIGLLLGSFLNVVIYRLPEMLKREWQQQCAELRGEQIKALPVYNLAIPGSGCPQCGHKISILENIPIISYLFLRGQCSGCHTRIPFSYPLVEALTAILSGLAAWHFGFGGLLFAVLVFVWAMIVLTFIDLNTQLLPDSITQPLLWTGLIVNLNNGFTDVHSAVVGAVAGYLTLWSVYWLFRLLTGKEGMGYGDFKLLAAIGAWLGWQLLPLVILFSSVVGAVVGTVLILSAGHSKNMTLPFGPYLAGGGLIALFWGKQINQAYLAMF

SEQ ID NO: 106406 - DNA, 981 bp, Bordetella pertussis Tohama I
  CDS (1)..(981): transl_table=11
gtgcaaatcggggcgcgccgcaataatgccgcctgcggcatcgcgctgccgcccggccctggcggaccttccggtccggtacgcgccgggtgtccggcgcttcctcttcttgtcctccctttccgtgtacctcctggcgccatgtggcatgtcttcccgctcgatccggcgttgaatgtggtgctggccgccctgctggggctcgtggccggcagctggctcagcgtggtggcgcatcggctgccgcgcatgatggagcgcgaatggcgcacggccatgcgcgaggaggacggcggcgccgagtcgggctatggcctgtggcggccggcctggcattgcccgtcgtgccaggccgccttgcgtggctggcgcgccgttccgctggccggctggttgctgcagcgcggccgctgcgggcattgcgggcagcccatcgggttgcgctaccccatgctcgagctggccgcggccgtgctgtttgccgcctgcgcctggcgcttcgggcccacgccgatggcgctggccgccatgggcctgaccggcgcgctgctggcgctggcctggatcgatctcgaacacagcctgctgcccgacgcggtgaccctgccgctgatctgggccggcctgctggtcaacctggacggcgcgctggcgccgctgccgctggccgtgctgggcgcggtcgcgggctatctgttcctgtgggtgatctttcatttcttccgcctgctgaccgggcgcgacggcatgggtcatggcgacttcaagctgatggcggcgctgggcgcctggctggggctgggggcattgccgtggttgctgctgggggcctcgctggcgggcgtgctggtgggctggagcctgcggctggccggacgggtcggcagggggcagccgctgcctttcggtccttacctggcgctcggcggtatcctgatgctgctggcggcgggccggcccgcctggctgcagttctattga

SEQ ID NO: 106407 - protein, 326 aa, Bordetella pertussis Tohama I
MQIGARRNNAACGIALPPGPGGPSGPVRAGCPALPLLVLPFRVPPGAMWHVFPLDPALNVVLAALLGLVAGSWLSVVAHRLPRMMEREWRTAMREEDGGAESGYGLWRPAWHCPSCQAALRGWRAVPLAGWLLQRGRCGHCGQPIGLRYPMLELAAAVLFAACAWRFGPTPMALAAMGLTGALLALAWIDLEHSLLPDAVTLPLIWAGLLVNLDGALAPLPLAVLGAVAGYLFLWVIFHFFRLLTGRDGMGHGDFKLMAALGAWLGLGALPWLLLGASLAGVLVGWSLRLAGRVGRGQPLPFGPYLALGGILMLLAAGRPAWLQFY

SEQ ID NO: 106408 - DNA, 993 bp, Bordetella parapertussis 12822
  CDS (1)..(993): transl_table=11
gtgcaaatcggggcgcgccgcaataatgccgcctgcggcatcgcgctgccgcccggccctggcggaccttccggtccggtacgcgccgggtgtccggcgcttcctcttcttgtcctccctttccgtgtacctcctggcgccatgtggcatgtcttcccgctcgatccggcgttgaatgtggtgctggccgctctgctggggctcgtggccggcagctggctcagcgtggtggcgcatcggctgccgcgcatgatggagcgcgaatggcgcacggccatgcgcgaggacgacggcggcgccgagtcggactatggcctgtggcggccggcctggcattgcccgtcgtgccaggccgccttgcgtggctggcgcgccgttccgctggccggctggttgctgcagcgcggccgctgcgggcattgccggcagcccatcggattgcgctaccccatgctcgagctggccgcggccgtgctgtttgccgcctgcgcctggcgcttcgggcccacgccgatggcgctggccgccatgggcctgaccggcgcgctgctggcgctggcctggatcgatctcgaacacagcctgctgcccgacgcggtgaccctgccgctgatctgggccggcctgctggtcaacctggacggcgcgctggcgccgctgccgctggccgtgctgggcgcggtcgcgggctatctgttcctgtgggtgatctttcatttcttccgcctgctgaccgggcgcgacggcatgggtcatggcgacttcaagctgatggcggcgctgggcgcctggctggggctgggggcattgccgtggttgctgctgggggcctcgctggcgggcgtgctggtgggcgtgctggtgggctggagcctgcggctggccggacgggtcggcagggggcagccgctgcctttcggtccttacctggcgctcggcggtatcctgatgctgctggcggcgggccggcccgcctggctgcagttctattga

SEQ ID NO: 106409 - protein, 330 aa, Bordetella parapertussis 12822
MQIGARRNNAACGIALPPGPGGPSGPVRAGCPALPLLVLPFRVPPGAMWHVFPLDPALNVVLAALLGLVAGSWLSVVAHRLPRMMEREWRTAMREDDGGAESDYGLWRPAWHCPSCQAALRGWRAVPLAGWLLQRGRCGHCRQPIGLRYPMLELAAAVLFAACAWRFGPTPMALAAMGLTGALLALAWIDLEHSLLPDAVTLPLIWAGLLVNLDGALAPLPLAVLGAVAGYLFLWVIFHFFRLLTGRDGMGHGDFKLMAALGAWLGLGALPWLLLGASLAGVLVGVLVGWSLRLAGRVGRGQPLPFGPYLALGGILMLLAAGRPAWLQFY

SEQ ID NO: 106410 - DNA, 828 bp, Bordetella bronchiseptica RB50
  CDS (1)..(828): transl_table=11
atggaaatccgcctgcccggcctggacggggcgggctggctggccggcgcggccgtgctcggactggcgctgggcagttttctcaatgtggtgctggcgcgcctgccggccatgctcgaataccgctggcgcctggacgtccagccggacggcgctgccgcgtgcgcgccgccgcccggcctggcgcatccgccgtcgcgctgcccgcattgcgcgaccgcgctgcgctggcgccacaacgtgccggtgctgtcgtggctatggctgcgcgggcgctgcgcattctgcgcggcgcccatcgccgcgcgctatccgctcgtcgaggccgccaccggcgcgctgtgcgccggcatcgccgttctgtacggccccacgctgctggcgctggccctgatggggctggccgccatgctgctggtgctggcctgcttcgacctggagcatctgctgctgcccgattgcctgaccctgcctctgctgtgggccggcctgctggccaacgccgccggcatgggcctggccacgccggcccaggcgatcgccggcgcggccgcgggctatgcgctgctggctggcgtggcctgggcgtttcgccgccgcaccggccgcgacggcctgggcctgggcgatgccaagctgctggcggcgctgggcgcgtggctgggctggcaggcgctgccggccttgctgctggcggccggcctgtggggcgtggcggcggggctgctggcgcgctggcgccggcgcgcggccttgcagccgctggggccggggctggcgttcggcgccgccctgatcgtggccggggccgggctgatggcgcgctga

SEQ ID NO: 106411 - protein, 275 aa, Bordetella bronchiseptica RB50
MEIRLPGLDGAGWLAGAAVLGLALGSFLNVVLARLPAMLEYRWRLDVQPDGAAACAPPPGLAHPPSRCPHCATALRWRHNVPVLSWLWLRGRCAFCAAPIAARYPLVEAATGALCAGIAVLYGPTLLALALMGLAAMLLVLACFDLEHLLLPDCLTLPLLWAGLLANAAGMGLATPAQAIAGAAAGYALLAGVAWAFRRRTGRDGLGLGDAKLLAALGAWLGWQALPALLLAAGLWGVAAGLLARWRRRAALQPLGPGLAFGAALIVAGAGLMAR

SEQ ID NO: 106412 - DNA, 840 bp, Bordetella bronchiseptica RB50
  CDS (1)..(840): transl_table=11
atgtggcatgtcttcccgctcgatccggcgttgaatgtggtgctggccgccctgctggggctcgtggccggcagctggctcagcgtggtggcgcatcggctgccgcgcatgatggagcgcgaatggcgcacggccatgcgcgaggaggacggcggcgccgagtcgggctatggcctgtggcggccggcctggcattgcccgtcgtgccaggccgccttgcgtggctggcgcgccgttccgctggccggctggttgctgcagcgcggccgctgcgggcattgccggcagcccatcggattgcgctaccccatgctcgagctggccgcggccgtgctgtttgccgcctgcgcctggcgcttcgggcccacgccgatggcgctggccgccatgggcctgaccggcgcgctgctggcgctggcctggatcgatctcgaacacagcctgctgcccgatgcggtgaccctgccgctgatctgggccggcctgctggtcaacctggacggcgcgctggcgccgctgccgctggccgtgctgggcgcggtcgcgggctatctgttcctgtgggtgatctttcatttcttccgcctgctgaccgggcgcgacggcatgggtcatggcgacttcaagctgatggcggcgctgggcgcctggctggggctgggggcattgccgtggttgctgctgggggcctcgctggcgggcgtgctggtgggctggagcctgcggctggccggacgggtcggcagggggcagccgctgcctttcggtccttacctggcgctcggcggtatcctgatgctgctggcggcgggccggcccgcctggctgcagttctattga

SEQ ID NO: 106413 - protein, 279 aa, Bordetella bronchiseptica RB50
MWHVFPLDPALNVVLAALLGLVAGSWLSVVAHRLPRMMEREWRTAMREEDGGAESGYGLWRPAWHCPSCQAALRGWRAVPLAGWLLQRGRCGHCRQPIGLRYPMLELAAAVLFAACAWRFGPTPMALAAMGLTGALLALAWIDLEHSLLPDAVTLPLIWAGLLVNLDGALAPLPLAVLGAVAGYLFLWVIFHFFRLLTGRDGMGHGDFKLMAALGAWLGLGALPWLLLGASLAGVLVGWSLRLAGRVGRGQPLPFGPYLALGGILMLLAAGRPAWLQFY

SEQ ID NO: 106414 - DNA, 813 bp, Prochlorococcus marinus str. MIT 9313
  CDS (1)..(813): transl_table=11
atgctctggatctatctagcgatcatcggagcttgtatgggcagcttcatcaatgtgatggcttggcggcttccacgaaaggaatcattgatttggcctggtagccattgcccacgttgtggatgtggtgtgcgttggcacgacaacatcccagtactcgcatggattcaactgggcggtcgctgtcgtgattgcagaaccaccattccagtgcgttatccagcggtggagagtctcagcgccgggctttgggtatcggctgccttggcagctccaaccagcatgggcgagttgtcttccttgttcaatctctttgctggagtcgtgcttgtcagtgtgctgttgccactggtcctcatcgacctcgatcacatgtggttgcctgaaccactttgtcgggctggccttttgttaggcctggcgttcaccgcgacagcggcagtttcactcggctggagtaagggatcaaccctgctactcgaccatttactagcagcagcagcagccttaattgcgatggaagggcttagcttccttgccaaaaagctgattggtcagccggcccttgggcttggtgatgccaaattggcggccatggctggagcatggttaggactgaatggggtggctatggccatgaccctggccatcatcagcggcgcagcggttggtctcatcggtcggcttgctggtcagctacaacctcgccagccttttcccttcgggcctttcattgcctttggggtctggggtgtatggctttgtggatcagattggtggtggcaacattggctcaacctaatgggtctttaa

SEQ ID NO: 106415 - protein, 270 aa, Prochlorococcus marinus str. MIT 9313
MLWIYLAIIGACMGSFINVMAWRLPRKESLIWPGSHCPRCGCGVRWHDNIPVLAWIQLGGRCRDCRTTIPVRYPAVESLSAGLWVSAALAAPTSMGELSSLFNLFAGVVLVSVLLPLVLIDLDHMWLPEPLCRAGLLLGLAFTATAAVSLGWSKGSTLLLDHLLAAAAALIAMEGLSFLAKKLIGQPALGLGDAKLAAMAGAWLGLNGVAMAMTLAIISGAAVGLIGRLAGQLQPRQPFPFGPFIAFGVWGVWLCGSDWWWQHWLNLMGL

SEQ ID NO: 106416 - DNA, 783 bp, Synechococcus sp. WH 8102
  CDS (1)..(783): transl_table=11
atgaccctgctcatcgttgccctgttcggggcctgcgttggcagcttcaccaacgtggtggtgtggcgcctgccccggcaggaatcggtggtggttcccggcagccattgccctcgctgcggccatgccatccgctggcacgacaatctgccggtgatcggctggctgcttctcggggggcgatgccgtgattgtggtgccggcatcagctggcgctacccggcagtcgaattggcaagtgccctgctctggctcagtgccctctcggttcaagccggtggtggtctgtcggaaccctggcggccctgggccggtctggtgctggtcgctctgttgctgcctctggtcttgatcgacatcgaccacctctggctgccggaaccgctgtgccgatgggggatggtgctgggccttctgttcagtgcaggcgctggatggactgttctgggcgatcaccttgttgcggcagcgctggcgttggtgctgctcgaggggctgagcgggatggccgagcggattcttgggcagccggctctcggtttgggggacgccaagctggcggccctgggtggtgcctggctgggagctgcaggaatcgccgtcgcgatggctctgggcaccctggtgggagccgtcgtcggcagcgtgggtcgggtctccgggcggttgcagcctcgtcaggcctttgcctttggtccgttcatcgccttggggatctggctggtctggctcaggggtgctgactggtggtgggagcaatggcagcggctgctgggtttttaa

SEQ ID NO: 106417 - protein, 260 aa, Synechococcus sp. WH 8102
MTLLIVALFGACVGSFTNVVVWRLPRQESVVVPGSHCPRCGHAIRWHDNLPVIGWLLLGGRCRDCGAGISWRYPAVELASALLWLSALSVQAGGGLSEPWRPWAGLVLVALLLPLVLIDIDHLWLPEPLCRWGMVLGLLFSAGAGWTVLGDHLVAAALALVLLEGLSGMAERILGQPALGLGDAKLAALGGAWLGAAGIAVAMALGTLVGAVVGSVGRVSGRLQPRQAFAFGPFIALGIWLVWLRGADWWWEQWQRLLGF

SEQ ID NO: 106418 - DNA, 918 bp, Chromobacterium violaceum ATCC 12472
  CDS (1)..(918): transl_table=11
atgctggatgacatgacatggctgctggccactcaccccgcttggctggcaggcgcggcgcttgtgttcggattgatggtggggagttttctgaacgtggtgatccacaggctgcccaggatgctggagcgggagttcctggccgacagcgtggagtacctggcggaagggggcgcgcctgccgcgctgcgcttggccgcggagcaggccaggcacgagctggacgatggcggctacaatctgtggcggcccgcctcgcattgccccgcttgccgcgcgccggtgcggccctggcacaatgtgcccttgctcagttacctgctgctgcacggccgctgcggcgattgcggcgaagctatcagccggcgatatccgctggtggagctgctgtgcggcgcactgtacggtttcctggcgtggaagctgggctggggctggccgctggccggcgcgctggcgctgacggctgtcctgctggcgctggccttcatcgatttcgacaccaagctgctgccggatggcctgaccctgccgctgctgtggggcggcttgctgttcaacctgatgacggggctggtgccgctgtcggccgcggtgttgggggcggtttatggttacatgacgctatggctggtgtcgcatgcctacaagctggtggcgggacggcatggcatggggggcggtgatttcaagctgctggcggcgctgggcgcctggctgggatggaccatgctgccgctgatcatattgttgtcgtctttggttggagcggtttgcggcatcgccatgatgtccgcctcgcgcgttggccgggggcaggaaatcccgttcggcccctatctttcggccgccggctggatcgcgctggtgtgggggccgcagatcatgaatggatatttgacatggctatcccggtag

SEQ ID NO: 106419 - protein, 305 aa, Chromobacterium violaceum ATCC 12472
MLDDMTWLLATHPAWLAGAALVFGLMVGSFLNVVIHRLPRMLEREFLADSVEYLAEGGAPAALRLAAEQARHELDDGGYNLWRPASHCPACRAPVRPWHNVPLLSYLLLHGRCGDCGEAISRRYPLVELLCGALYGFLAWKLGWGWPLAGALALTAVLLALAFIDFDTKLLPDGLTLPLLWGGLLFNLMTGLVPLSAAVLGAVYGYMTLWLVSHAYKLVAGRHGMGGGDFKLLAALGAWLGWTMLPLIILLSSLVGAVCGIAMMSASRVGRGQEIPFGPYLSAAGWIALVWGPQIMNGYLTWLSR

SEQ ID NO: 106420 - DNA, 675 bp, Wolinella succinogenes DSM 1740
  CDS (1)..(675): transl_table=11
gtggcgattgtccgcatccccgaggatagaagtgtctgctttcccgcctcgcactgtccgcactgccaaaagcccttgcgattttggcacaacatcccccttctttcctacctctttttgggggggcgttgtgccttttgtcaagccaaaatctcccctctctatcctcttgttgagcttctttcggcgtttttgggattggcggtagtgatgagggagggctttgtttggccggcgctggctttaggggtgagctttggccttcttttggctctctcagtgattgacatcaagactcaaaaagtccccgattctctcaatttcatcgctcttttggccgcgcttgcttatggggcttctcttgagagcttagaggcggcattcatcatcgcaggagcgctcacgctcctgcgctttgggctctcttggattctccatcaagaagccatgggcgagggggatattatcttggctgcgactatgggggcgattttgggggtgaagctcgccttggtggcggtatttgtggcggcgctactggcattgcctgtgatgcttcttctctccaaaaaagattctaaaatcgcctttattccctttctctccttggggctttggatcgtctatggggggcaggattggattttgagctatttggagtcgtggtatgggtaa

SEQ ID NO: 106421 - protein, 224 aa, Wolinella succinogenes DSM 1740
MAIVRIPEDRSVCFPASHCPHCQKPLRFWHNIPLLSYLFLGGRCAFCQAKISPLYPLVELLSAFLGLAVVMREGFVWPALALGVSFGLLLALSVIDIKTQKVPDSLNFIALLAALAYGASLESLEAAFIIAGALTLLRFGLSWILHQEAMGEGDIILAATMGAILGVKLALVAVFVAALLALPVMLLLSKKDSKIAFIPFLSLGLWIVYGGQDWILSYLESWYG

SEQ ID NO: 106422 - DNA, 810 bp, Gloeobacter violaceus PCC 7421
  CDS (1)..(810): transl_table=11
gtgttcgccatcgggttttgggcaatcgtcggggcggcggtgggcagttgcatcaacgtcgtcgcccaccgtttgccccagggcatttcgctgtggtggccaccttcgcgctgccccggctgcctgaccccgctcgggccgctggagaacgtaccggtactgggttggttgtggttggggggtaaatgtcgtcactgccggatggcaattccggtgcgctatgcgctggtggaactggggacggcggggttatccggtgtgctcgcctggcattttcaggcggcctttacctccacaagcctggtggaggtggcctgctggggattttttgtggcggtgctgttggcgctgagcctgatcgatctcgacacgctcgaactgccgggggaactgaccgccgccgggatcgtcggggggttggtgttccgtacgttttttccagtctgggcaagcggcgcctgggcgagcggcccgcccggtctggtggacgcgctgtacggactgctggtaggtatcgggctattcgatgtgattagctacgtcggcgagaaggcgatgggcaaagaggcgatggggggcggcgatgcgaccctggcggggctcatcggcgtctggctggggtggaagttgcttctggtttcgctcgcttttggctttggtctaggagcggttttcggtctggcgggcatcgccgccggacggctcaagcgcgaagagccgctgccctttggcccgtttctggccctcggtgcgctgggcgggctattgtttggggaaagctggataacgagttacatgacgctgttttaa

SEQ ID NO: 106423 - protein, 269 aa, Gloeobacter violaceus PCC 7421
MFAIGFWAIVGAAVGSCINVVAHRLPQGISLWWPPSRCPGCLTPLGPLENVPVLGWLWLGGKCRHCRMAIPVRYALVELGTAGLSGVLAWHFQAAFTSTSLVEVACWGFFVAVLLALSLIDLDTLELPGELTAAGIVGGLVFRTFFPVWASGAWASGPPGLVDALYGLLVGIGLFDVISYVGEKAMGKEAMGGGDATLAGLIGVWLGWKLLLVSLAFGFGLGAVFGLAGIAAGRLKREEPLPFGPFLALGALGGLLFGESWITSYMTLF

SEQ ID NO: 106424 - DNA, 612 bp, Photorhabdus luminescens subsp. laumondii TTO1
  CDS (1)..(612): transl_table=11
ttgaataaagtgatagccgtatttattaaaattatttatggctatgaaaaaatagtttttggttattttcaggttgaattagtgacactgtttataacagctttctttatgatttatttttcattaaatttccatttatatgttgttttgatatttgtttgggtgttaattatattgtcttttattgatataaaaattaagttattgccagacataataaattatccactgttatggttaggattattattgaatttgaatcaaacttttgtgcctattgaacaagctgtgacaggtgcgattgtgggttatttgattttatggtcgctctattggttatttagaataatttgtcataaagaagggttaggatatggtgattttaagttaatggcggcggttagtgcttggttggggattggtgcaattcctttattaatgctcttatcctcactgtttggtcttattgggtgcttatggatgtggagaatacgagaaaattgccaagagcctgttgcttttggcccatatatagccatttctgcggtcataatgatctatttgaatttattgggaatggatgggatatcgtggatggtgcccgatagctga

SEQ ID NO: 106425 - protein, 203 aa, Photorhabdus luminescens subsp. laumondii TTO1
MNKVIAVFIKIIYGYEKIVFGYFQVELVTLFITAFFMIYFSLNFHLYVVLIFVWVLIILSFIDIKIKLLPDIINYPLLWLGLLLNLNQTFVPIEQAVTGAIVGYLILWSLYWLFRIICHKEGLGYGDFKLMAAVSAWLGIGAIPLLMLLSSLFGLIGCLWMWRIRENCQEPVAFGPYIAISAVIMIYLNLLGMDGISWMVPDS

SEQ ID NO: 106426 - DNA, 795 bp, Photorhabdus luminescens subsp. laumondii TTO1
  CDS (1)..(795): transl_table=11
atgatgatagggtggttgcaatcttctactgggtgtttggtgctggcatcagggttgctagggttgtgcgtcggaagttttcttaatgtggtgatctgtcgcctgccgatgatgattttctctgaaatcaataatgaggttgccagctttaatctctgttttccccgttcccattgtccacgttgcagccacgtgttagcggcccgcgatattattcccctgttgagctatttgcaccaaaaagggctctgtcgatactgtaaaggtgtgatttctatacgttatccactggttgaaggcgcagtagcggtgctcttttccttactggctttggagttggggtggagttattcgttgttggggtttttagtgctcagttcgatgttggtcgtactggcagtagtcgatttcgaatatctgctgctgcccgatcaactgacactttctttgttatggctagggttgctgtttaatttgccatccgccggttttgtcgcgctgcctttggctgtcgttggcgcagtttgtgggtatctgtttttccggctggttgagtggatcgcccggcgattgactcggcgcgatgcattaggcatgggagatgccaagtttctggcggcgctcggtgcctggctggggttggaagcgcttccagttgtgattttgctggcggtggagttcacgctggtaagttatctggcaatgcggtggttacgcagaattaaaacaccacagatacctttcgggccgggtctggcagtggctggattaattgtcgcgctttgtcatcggtag

SEQ ID NO: 106427 - protein, 264 aa, Photorhabdus luminescens subsp. laumondii TTO1
MMIGWLQSSTGCLVLASGLLGLCVGSFLNVVICRLPMMIFSEINNEVASFNLCFPRSHCPRCSHVLAARDIIPLLSYLHQKGLCRYCKGVISIRYPLVEGAVAVLFSLLALELGWSYSLLGFLVLSSMLVVLAVVDFEYLLLPDQLTLSLLWLGLLFNLPSAGFVALPLAVVGAVCGYLFFRLVEWIARRLTRRDALGMGDAKFLAALGAWLGLEALPVVILLAVEFTLVSYLAMRWLRRIKTPQIPFGPGLAVAGLIVALCHR

SEQ ID NO: 106428 - DNA, 921 bp, Vibrio vulnificus YJ016
  CDS (1)..(921): transl_table=11
ttggcttgcttgagctatttttgcccacaccacaaagagaacgacgattatatggacgcgttacaatactacccttggctttatattggtttagcttccctgtttggcttactggtaggcagctttcttaacgtcgtcatctaccgtctgccgaaaataatggaactggaatggcgccaagagtgtgcagagtcctttcctgaatacaacatcacaccaccgacagaaaccctaacattaagcacgccgcgctcaagttgcccttcgtgccataccccaatacgagttcgagataatattcctgtctttagttggttagcactaagaggaaaatgtcaccattgccagacgaaaatcagtgctcgctatccttttgttgaagcactgagcgcctttttgtgcggcctagtcgcttggaagttcggttatgcaccgattaccgtagcactgattggttttactttggtgttgatcgccgccaccttcatcgacttagataccatgctactgcctgatcagctgacactgccgctgacgtgggcaggcatcgcgctagcgttactagagataagcccagtatctctgcaagattcagtgatcggtgcgatggcaggctatctctgcctttggagcgtttatcaccttttccgattgctgacagggaaagaaggcatgggttacggagactttaaattgcttgcggcacttggagcttggctcggctggcaatatctaccgatgatcatcttactttcttcggttgtcgggctgatctttggtctcattcaactccgattgcaaaagcaaggcattgagatggcttttccatttgggccttatctggccattgctggttgggtcgccttaatgtggggagatagcttgatgtcttggtatctcaactatcttataggggcataa

SEQ ID NO: 106429 - protein, 306 aa, Vibrio vulnificus YJ016
MACLSYFCPHHKENDDYMDALQYYPWLYIGLASLFGLLVGSFLNVVIYRLPKIMELEWRQECAESFPEYNITPPTETLTLSTPRSSCPSCHTPIRVRDNIPVFSWLALRGKCHHCQTKISARYPFVEALSAFLCGLVAWKFGYAPITVALIGFTLVLIAATFIDLDTMLLPDQLTLPLTWAGIALALLEISPVSLQDSVIGAMAGYLCLWSVYHLFRLLTGKEGMGYGDFKLLAALGAWLGWQYLPMIILLSSVVGLIFGLIQLRLQKQGIEMAFPFGPYLAIAGWVALMWGDSLMSWYLNYLIGA

SEQ ID NO: 106430 - DNA, 780 bp, Geobacter sulfurreducens PCA
  CDS (1)..(780): transl_table=11
atgacgctaccgatagtgttctatcttttttcctttgtcctcggggcagtggtcggctcattcctgaacgtctgcatttataggctgccaacgggtgagtcggtcgtgtttcctccttcccgctgcacctcctgcgggacgcggattcgtccctgggacaacatccctattctgagctggctcatcctgcgcggagcatgccgcgcctgcagggcaaagatctcggctcgctatcccctggttgaacttatcaacggcttgctctgcctcgccctgttcctcaagttcgggccgaccctgacctttgcggccctcttcgtattctgctccgccctggtggcgatctccttcattgacctcgaccatcagatcatccccgatgtcatcagcctcccgggaatcgttcttggatttgtcctgtcgttctttctgccctggctcggctggctcaattccctcatcggcatcgcggcggggggagggagcctcctgctggttgcctggctctacgagcggctgacgggcaaggagggaatgggcggaggtgacatcaagcttcttgccatgatgggggcctttctcggctggcgggcggtgccgttcatcatctttgccagctctctggtgggctcggtcatcgggctcacactcatgatgctccagaaaaaagatagcaagcttgccatcccgttcggcccgttcctggcgctgggggcacttctctacatctttttcggcaaggcgatcattctctggtacctgagcatcggcgcccggtag

SEQ ID NO: 106431 - protein, 259 aa, Geobacter sulfurreducens PCA
MTLPIVFYLFSFVLGAVVGSFLNVCIYRLPTGESVVFPPSRCTSCGTRIRPWDNIPILSWLILRGACRACRAKISARYPLVELINGLLCLALFLKFGPTLTFAALFVFCSALVAISFIDLDHQIIPDVISLPGIVLGFVLSFFLPWLGWLNSLIGIAAGGGSLLLVAWLYERLTGKEGMGGGDIKLLAMMGAFLGWRAVPFIIFASSLVGSVIGLTLMMLQKKDSKLAIPFGPFLALGALLYIFFGKAIILWYLSIGAR

SEQ ID NO: 106432 - DNA, 780 bp, Bdellovibrio bacteriovorus HD100
  CDS (1)..(780): transl_table=11
ctggatacgggcttttacgtccttttctttgttttgggtgcgatttttggaagtttcggcaatgtcgtgatctatcgcctgccgcgcgaggaaagtgtcgtcaagcctcgcagctactgttacggctgcaaaacccagatcaaatggtatgacaatatccctatcctgagctggttcattcttcgtggcaaatgccgcaagtgtcaggccaagttctctttccgctaccctctggtggaaatcatcatggcggtgctgtttgcgctttcttaccactatgcgggtctgacttggacgctgcttgaatacttgatctttatttttggacttgttgtctgcacgttcatcgatctggatcacatgatcctgccggacgaatttaccctgtcagggattgtcattggacttgtcggtgcagccttgaatccccagcgtgagttcctggatgcgctgtttggcgtgttgatgggcgggggcttcctttgggggatggcttacgtctattatatgttcaccaaaaatgaaggcatgggtgggggcgatatcaagcttctggcctggatcggtgccatcgtcggctggaaagccattccgtttgtgatcatgacctcggcgattgtgggcagtgtgatcggtttgatcgctgccagaaagcagaaagctggactaaagacggtgattccgttcggtccgtacctggctttgggagctgtggtttatctttttggcggtgaagccatcgccctttggtacctcggtttgttccttcccgctgtctaa

SEQ ID NO: 106433 - protein, 259 aa, Bdellovibrio bacteriovorus HD100
MDTGFYVLFFVLGAIFGSFGNVVIYRLPREESVVKPRSYCYGCKTQIKWYDNIPILSWFILRGKCRKCQAKFSFRYPLVEIIMAVLFALSYHYAGLTWTLLEYLIFIFGLVVCTFIDLDHMILPDEFTLSGIVIGLVGAALNPQREFLDALFGVLMGGGFLWGMAYVYYMFTKNEGMGGGDIKLLAWIGAIVGWKAIPFVIMTSAIVGSVIGLIAARKQKAGLKTVIPFGPYLALGAVVYLFGGEAIALWYLGLFLPAV

SEQ ID NO: 106434 - DNA, 723 bp, Bacillus cereus ATCC 10987
  CDS (1)..(723): transl_table=11
atgttcacttatgtatatgcattgttagcggggatggtgtttggttctttttttatggtaattgcgatgagagttccgctaggggagtctatcataaccccgcgttcatattgtcattattgtaagtatgtgctaaagccaaaagaattgattccaatcatttctttttgtatgcaaagagggcgttgtacgaattgtaagaggaaaatttcaattttgtacgtagtatttgaacttgtaactggaatgatatgtcttcttactgtatatatgattggggtggaacgagagcttattatcgttttatcacttttttcgttacttcttattatttcagttacagattacatatatatgttaattccaaatcgtattttagcttggtttgcttgtttactcattttagaatgtgtttttataccgttagtcacttggatagatagtatagttggtagttgcgttatattcattttgttatactgcatgcaaaagatatatccagaagggcttgggggaggggatataaaattactttcgttacttggatttatagtgggactgaaagggatttttatcgttttatttttagcatcttgctttagtctttgtttctttggagctggtctcgtattaaaacgtatgaaaatgaggactcaaataccgtttggtccttttattagtcttggggcaatatgttacatgttggtcacgtatgcaaaatag

SEQ ID NO: 106435 - protein, 240 aa, Bacillus cereus ATCC 10987
MFTYVYALLAGMVFGSFFMVIAMRVPLGESIITPRSYCHYCKYVLKPKELIPIISFCMQRGRCTNCKRKISILYVVFELVTGMICLLTVYMIGVERELIIVLSLFSLLLIISVTDYIYMLIPNRILAWFACLLILECVFIPLVTWIDSIVGSCVIFILLYCMQKIYPEGLGGGDIKLLSLLGFIVGLKGIFIVLFLASCFSLCFFGAGLVLKRMKMRTQIPFGPFISLGAICYMLVTYAK

SEQ ID NO: 106436 - DNA, 1065 bp, Thermus thermophilus HB27
  CDS (1)..(1065): transl_table=11
atgtggcccctcttcgccctgctcctcggcctcgcggtgggttcctttctcaacgtggtggtccaccgcctgccccggggggagtccgtcgcctaccccccgtcccgctgcccccagtgcggccaccgcctggggccttgggacctggtccccgtcctctcctacctcgccctaaaggggcggtgccgctactgcgcccgtcccatctccccccgctaccccctggtggaggccctcacgggggggctttttctcctcgcaagcctcttctacccccctggggtggaggccctcttggtcttcctcttcctcgcctttctcgtggccctcgccttcattgacgtggacacctttgagcttcccgatcccctcacctacggcctcctcttccttgggcttttggcctcctgggcgctggccttccccctcccctttagggagagcctggacggaagcctcatggccgccggggggctcgccctggtggcggggtacgggaacctctttctgcggcgctttagggaggccagggccgaggtccccgtggggccccaccaggtccacatggcggccctctttggggcgctcttgggcccaggggtggggatggccctcgccttcctcgcttgggccctctccgcccgcacggggcggcccgtggtcctccccgaccggctcaccctgccccttttgcccctcgccttcctccttgcccccgccctgggcctggacttcctggaaagccttaagggaagcctcctcgccgccgggggcctggccctcgccggggggctctactgggccttccggccccttcccgaggaggaagaggagcccgtggccatgggctacggggacgtgaagctcttgggggccctcggggcctggcttggcccttacgccttcctcgccctcttcctcggggtcttcgccggggcgcttttgggccttctccttaggcaaaggaagctccccttcggcccctacctcgccctcgggggggtggtggccttcttcttcggggaggccctctggggggcgtacctgcgccttctgggcgtttga

SEQ ID NO: 106437 - protein, 354 aa, Thermus thermophilus HB27
MWPLFALLLGLAVGSFLNVVVHRLPRGESVAYPPSRCPQCGHRLGPWDLVPVLSYLALKGRCRYCARPISPRYPLVEALTGGLFLLASLFYPPGVEALLVFLFLAFLVALAFIDVDTFELPDPLTYGLLFLGLLASWALAFPLPFRESLDGSLMAAGGLALVAGYGNLFLRRFREARAEVPVGPHQVHMAALFGALLGPGVGMALAFLAWALSARTGRPVVLPDRLTLPLLPLAFLLAPALGLDFLESLKGSLLAAGGLALAGGLYWAFRPLPEEEEEPVAMGYGDVKLLGALGAWLGPYAFLALFLGVFAGALLGLLLRQRKLPFGPYLALGGVVAFFFGEALWGAYLRLLGV

SEQ ID NO: 106438 - DNA, 804 bp, Desulfovibrio vulgaris subsp. vulgaris str. Hildenborough
  CDS (1)..(804): transl_table=11
atgcaccagctaccccctgaactattgccgtggttcgctcttgtgttcggtctcgtgttcggcagcttctataatgtctgcatccatcggtatatcgcgggcgaatccatagtatggcctccttcacggtgtcccaagtgcgagacgcgtcttggcataccagacctcgtgcctgtattcagttatcttttcctgcgcggaaagtgccgtcattgcggcagtcacatcagtgtgcgctaccccgttgtcgaacttgcatcgggtctgctggcctttcttctgatgcaccgctacggtctcacatggccttttgccgtgtactatgtctttggcagtgcactgctggtggcttcgttcatcgacttcgaactcttcatcctgcccgaccccatcacgctgggcggtgccgttctcgccccgcccgccgccatcctgctactcgacctgccgtggcaggcgagccttgccggggctgtcgtaggcggcggcggcttctggctggtggcttggctgttccgcaaactgcgcggtgtcgaaggcatgggcctcggggacgtgaagctcatgctgctcatcggcgggctgtgcggcgcgtcggcgttacctctcgttaccatcatcgcgggctgtgccgcgctgggggcgagtctgtggtttctcgcccgacgcgagaagggaacggacgcgcgagaggtgcagattccgttcgggcccttcctcagtcttggtgcggtgatgcacatgctctatggcccggacatcatccactggtggatagcccttgtcaccggacggcccttctag

SEQ ID NO: 106439 - protein, 267 aa, Desulfovibrio vulgaris subsp. vulgaris str. Hildenborough
MHQLPPELLPWFALVFGLVFGSFYNVCIHRYIAGESIVWPPSRCPKCETRLGIPDLVPVFSYLFLRGKCRHCGSHISVRYPVVELASGLLAFLLMHRYGLTWPFAVYYVFGSALLVASFIDFELFILPDPITLGGAVLAPPAAILLLDLPWQASLAGAVVGGGGFWLVAWLFRKLRGVEGMGLGDVKLMLLIGGLCGASALPLVTIIAGCAALGASLWFLARREKGTDAREVQIPFGPFLSLGAVMHMLYGPDIIHWWIALVTGRPF

SEQ ID NO: 106440 - DNA, 723 bp, Bacillus anthracis str. Sterne
  CDS (1)..(723): transl_table=11
atgttcacttatgtatatgcattgttagttgggatggtgtttggttccttttttatgttaattgcgatgagaattccgctaggtgagtctatcattatcccgcgttcacattgtcattattgtaagtatgtactcaagccaaaagaattaattccaatcatttctttttgtatacaaaggggacgttgtacgaattgtaagaggaaaatttcaattttgtacgtaatatttgaacttgtaaccggaataatatgtcttcttactgtatatatgattggggtggaacgagagcttatcatcattttatcacttttctcgttacttctcattatttcagttacagattacatatatatgttaatccctaatcgtattttagcttggttctcttgtttacttattttagaatgtgtttttgtaccgttagtcacttggacagagagtatagttgggagtggcgttatattcattttgttatactgcatgcaaaagatatatccagaagggcttggtggaggggatataaaactactttcgttacttggatttattgcgggactgaaaggggtttttatgattttatttttatcatctttctttagtctttgtttctttggagctggtctcgtattaaaacgtatgaaaatgaggactcaaataccgtttggcccttttattagccttggggcaatttgttacatgttggtcacgtatgcaaaatag

SEQ ID NO: 106441 - protein, 240 aa, Bacillus anthracis str. Sterne
MFTYVYALLVGMVFGSFFMLIAMRIPLGESIIIPRSHCHYCKYVLKPKELIPIISFCIQRGRCTNCKRKISILYVIFELVTGIICLLTVYMIGVERELIIILSLFSLLLIISVTDYIYMLIPNRILAWFSCLLILECVFVPLVTWTESIVGSGVIFILLYCMQKIYPEGLGGGDIKLLSLLGFIAGLKGVFMILFLSSFFSLCFFGAGLVLKRMKMRTQIPFGPFISLGAICYMLVTYAK

SEQ ID NO: 106442 - DNA, 723 bp, Bacillus thuringiensis serovar konkukian str. 97-27
  CDS (1)..(723): transl_table=11
atgttcacttatgtatatgcattgttagttgggatggtgtttggttcctttttcatgttaattgcgatgagaattccgctaggtgagtctatcattatcccgcgttcacattgtcattattgtaagtatgtactaaagccaaaagaattaattccaatcatttctttttgtatacaaaggggacgttgtacgaattgtaagaggaaaatttcaattttgtacgtaatatttgaacttgtaaccggaataatatgtcttcttactgtatatatgattggggtggaacgagagcttatcatcattttatcacttttttcgttacttcttattatttcagttacagattacatatatatgttaatccctaatcgtattttagcttggttctcttgtttacttattttagaatgtgtttttgtaccgttagtcacttggacagagagtatagttgggagtggcgttatattcattttgttatactgcatgcaaaagatatatccagaagggcttggtggaggggatataaaactactttcattacttggatttattgcgggactgaaaggggtttttatgattttatttttatcatctttctttagtctttgtttctttggagctggtttagcattaaaaagaattaaaatgaggacccaaatcccgtttggcccttttattagccttggggcaatttgttacatgttggtcacgtatgcaaaatag

SEQ ID NO: 106443 - protein, 240 aa, Bacillus thuringiensis serovar konkukian str. 97-27
MFTYVYALLVGMVFGSFFMLIAMRIPLGESIIIPRSHCHYCKYVLKPKELIPIISFCIQRGRCTNCKRKISILYVIFELVTGIICLLTVYMIGVERELIIILSLFSLLLIISVTDYIYMLIPNRILAWFSCLLILECVFVPLVTWTESIVGSGVIFILLYCMQKIYPEGLGGGDIKLLSLLGFIAGLKGVFMILFLSSFFSLCFFGAGLALKRIKMRTQIPFGPFISLGAICYMLVTYAK

SEQ ID NO: 106444 - DNA, 861 bp, Acinetobacter sp. ADP1
  CDS (1)..(861): transl_table=11
atgtctgacttcattcgttatttttctgaaaatttaactgctttatattgtcttgtaggtattttaagtctatgtataggaagctttctcaatgttgtgatttttcgcacacccaaaatgatggaacaagaatggaaacaagaatgtcagatgatattacatccagatcagccactcatcgaaagtgaaaagttaacgctcagttaccctgcttcaacttgtccacactgtcatactcctatccgctggtatcaaaatattccattaatcagttggttatttctacgtggtaaatgtcagtcatgcaaagcttccatcagtagtcgttatccgctggttgagttactgaccatgctttgttcgctgctggtggttgtggtatttggtgcgacactacacatgcttttcggtttagtgctgacctggatattgattgcgctgacctttattgactttgatacccagcttctacctgatcgttttaccctgacacttgcaggattagggttagctgtaaatagcttcacaatctatgtttcccccactcaagcgatttggggttatattgtgggcttcctttgcctctggattgtgtattacatttttaagctgattaccaaaaaagaaggcatgggctatggcgattttaaattactcgcggctctaggagcatggatgggacccatgatgctgccattgatcgtgctcttgtcatcctgcgtcggcgccattattggtatcattttgctacgtaagcgtcaggaaaatcagccttttgcatttggtccctatatcgcgattgcaggttggattgcatttttgtggggcgatcagattatgaaagtctacctgggaggctaa

SEQ ID NO: 106445 - protein, 286 aa, Acinetobacter sp. ADP1
MSDFIRYFSENLTALYCLVGILSLCIGSFLNVVIFRTPKMMEQEWKQECQMILHPDQPLIESEKLTLSYPASTCPHCHTPIRWYQNIPLISWLFLRGKCQSCKASISSRYPLVELLTMLCSLLVVVVFGATLHMLFGLVLTWILIALTFIDFDTQLLPDRFTLTLAGLGLAVNSFTIYVSPTQAIWGYIVGFLCLWIVYYIFKLITKKEGMGYGDFKLLAALGAWMGPMMLPLIVLLSSCVGAIIGIILLRKRQENQPFAFGPYIAIAGWIAFLWGDQIMKVYLGG

SEQ ID NO: 106446 - DNA, 849 bp, Erwinia carotovora subsp. atroseptica SCRI1043
  CDS (1)..(849): transl_table=11
gtggacgatttaagggaattcgcacaagtgtttccggcatggtggttgggtgcgctgggcgtgttggggctgattgttggtagttttctaaacgtcgtgatttaccgtctgccgattatgctggaacgaagctggcagcaggacctcgatcttcaggccggaatgaccgattccagccctgacagtacacgctacaacctgtggtggccgccgtcgtcttgcccgcactgccagcaggttattgcggtgaaagataacatcccgctgttcagctggttgtggctacgcggtcgctcccgctgctgtcatcagtcagtgtctgtgcaatatccgctggtggaagttatcaccatgctggctttcctgacggcgggtttgctatggcagcccagtatggcgttgtgtggggcgttgattctactgtctttcctgttggtactgaccgtcattgatatcaaaacgctgttgctgccggatgtgcttacgctgtcgcttctgtgggtagggctgctgtttaatctctctgagacgtttgtcccagtgggggatgccgtggtgggcgcgatggcgggttatttatctctgtggctactctattgggtattcaaatacgcgaccggtaaagaggcgctggggtatggtgattttaagttgctggccgcgctaggtgcctggctgggctggcaggcgttaccgaatttggttttggttgcagcgctgagtggattggtcgttactcttgtctggcgcgggttgcgtaaagaagatacggctaaaccgctggcctttggcccgtggctggcaatcggcggcgtgttcggtgtgataatgaacgggctaagtctgtag

SEQ ID NO: 106447 - protein, 282 aa, Erwinia carotovora subsp. atroseptica SCRI1043
MDDLREFAQVFPAWWLGALGVLGLIVGSFLNVVIYRLPIMLERSWQQDLDLQAGMTDSSPDSTRYNLWWPPSSCPHCQQVIAVKDNIPLFSWLWLRGRSRCCHQSVSVQYPLVEVITMLAFLTAGLLWQPSMALCGALILLSFLLVLTVIDIKTLLLPDVLTLSLLWVGLLFNLSETFVPVGDAVVGAMAGYLSLWLLYWVFKYATGKEALGYGDFKLLAALGAWLGWQALPNLVLVAALSGLVVTLVWRGLRKEDTAKPLAFGPWLAIGGVFGVIMNGLSL

SEQ ID NO: 106448 - DNA, 792 bp, Desulfotalea psychrophila LSv54
  CDS (1)..(792): transl_table=11
atggaatacggtatcctccctcttatcatcgtcgccctgctgggtgctattataggaagctttcttaacgttgtcatcctcagacttccggaagaaaacagctccattgcctatccggcatcacactgccctaaatgcaaccacccactctcttggtatgaaaatatccccctgctcagctttctcatcctgggggggaaatgccgctcctgcaaagagcatatctcttggcagtatccgctgatagaggcgtccatggccctgctcggcctgggcctttttcttcacttcgggctaaccctcacattcctcgcttatttttgtttcagcgccgccctgctggtcattatcgtcattgatttctatcaccagatcatccccgacctgatcagcctgcccggcatagcccttggttttctcttctcctttatcaatccggaaataagctggttaagctcgcttatcggactactggtgggaggcggagctctttacgccattgcctggggctattttaccctgagaaaacaggagggaatgggaggaggtgacatcaagcttctggccatgctcggggcctggctcggctggcagtcccttgtcttcatcgtctttaccagctcactctttggcgccatcattggactcattgccctgcgtatccaaaacaaaggcaaccagacaaaaatcccctttggtcccttcctctgccttgcagcccttgtctacctcttttacagcgtggaaattcaatactttttccagctctacctgaacggacagtggccatag

SEQ ID NO: 106449 - protein, 263 aa, Desulfotalea psychrophila LSv54
MEYGILPLIIVALLGAIIGSFLNVVILRLPEENSSIAYPASHCPKCNHPLSWYENIPLLSFLILGGKCRSCKEHISWQYPLIEASMALLGLGLFLHFGLTLTFLAYFCFSAALLVIIVIDFYHQIIPDLISLPGIALGFLFSFINPEISWLSSLIGLLVGGGALYAIAWGYFTLRKQEGMGGGDIKLLAMLGAWLGWQSLVFIVFTSSLFGAIIGLIALRIQNKGNQTKIPFGPFLCLAALVYLFYSVEIQYFFQLYLNGQWP

SEQ ID NO: 106450 - DNA, 843 bp, Yersinia pseudotuberculosis IP 32953
  CDS (1)..(843): transl_table=11
atgatggatatacaggttttttttgtgagctatttaatttttggggccatggtaggcagttttcttaatgttttaatctatagattgcctattatgctgactaatttgtcatcacgatctgagtcacacggtgaagaaattaagatgcgttctcatttgagaaacattaatttatttcaacccggctctttttgccatcattgcaatgagtcaataccaataaaatataatataccgatactcggttggatttttctgcgtggtgccagtcgttgttgtaacaagaagataagcactcgctatctatttattgaagtattagctgtcattcaaacactcttggttcttatgatttttaaagaggacttacttatctgcactagcttggtgctaatttggtcacttacggcattggcatttatagatttcgatacctacctccttcctgattgtatgacaatacctttgctgtggcttggtcttcttatcaatatagatacggtttttgcaccactaacctctgcagtactgggtgctgtcagtggatacctttttctttggctatcatattggttgtttaaaatagtaagaggtgttgatggaatgggctatggtgattttaaattaatggccgcattaggtgcttggtttggtgtgagtgcagtaccttttttaatattgttctcttccttttttggtcttgtcgcatatgctattttttatttttttgataaaaaagataatggaaaagagattaattacatcgcatttggcccttatatttcattggcgggtgttctatacctgtttcttgggagtcatgtgactaatttattttcttaa

SEQ ID NO: 106451 - protein, 280 aa, Yersinia pseudotuberculosis IP 32953
MMDIQVFFVSYLIFGAMVGSFLNVLIYRLPIMLTNLSSRSESHGEEIKMRSHLRNINLFQPGSFCHHCNESIPIKYNIPILGWIFLRGASRCCNKKISTRYLFIEVLAVIQTLLVLMIFKEDLLICTSLVLIWSLTALAFIDFDTYLLPDCMTIPLLWLGLLINIDTVFAPLTSAVLGAVSGYLFLWLSYWLFKIVRGVDGMGYGDFKLMAALGAWFGVSAVPFLILFSSFFGLVAYAIFYFFDKKDNGKEINYIAFGPYISLAGVLYLFLGSHVTNLFS

SEQ ID NO: 106452 - DNA, 723 bp, Bacillus cereus E33L
  CDS (1)..(723): transl_table=11
atgttcacttatgtatatgcattgttgattgggatggtgtttggttccttttttatgttaattgcgatgagaattccgctaggtgagtctatcattatcccgcgttcacattgtcattattgtaagtatgtactaaagtcaaaagaattaattccaatcatttctttttgtatacaaaggggacgttgtacgaattgtaagagaaaaatttcaattttatacgtaatatttgaacttgtaaccggaataatatgtcttcttactgtatatatgattggggtggaacgagagcttatcatcattttatcacttttttcgttacttcttattatttcggttacagattacatatatatgttaatccctaatcgtattttagcttggttctcttgtttacttattttagaatgtgtttttgtaccgttagtcacttggacagagagtatagttgggagtggcgttatattcattttgttatactgcatgcaaaagatatatccagaagggcttggtggaggggatataaaactattttcgttacttggatttatagtgggactgaaagggatttttatgattttatttttatcatctttctttagtctttgtttctttggagttggtctcgtattaaaacgtatgaaaatgaggactcaaataccgtttggcccttttattagccttggggcaatttgttacatgttggtcatgtatgcaaaatag

SEQ ID NO: 106453 - protein, 240 aa, Bacillus cereus E33L
MFTYVYALLIGMVFGSFFMLIAMRIPLGESIIIPRSHCHYCKYVLKSKELIPIISFCIQRGRCTNCKRKISILYVIFELVTGIICLLTVYMIGVERELIIILSLFSLLLIISVTDYIYMLIPNRILAWFSCLLILECVFVPLVTWTESIVGSGVIFILLYCMQKIYPEGLGGGDIKLFSLLGFIVGLKGIFMILFLSSFFSLCFFGVGLVLKRMKMRTQIPFGPFISLGAICYMLVMYAK

SEQ ID NO: 106454 - DNA, 717 bp, Mannheimia succiniciproducens MBEL55E
  CDS (1)..(717): transl_table=11
gtgagtaatttatatcttgtgtttttcgcttgtttgcttggttacttaacctattactatttaagcaattttcgaacaaaactgcataaggatatttattacgccttttaccaaatatttccgcaaaaacaaccgcactttaccattgaacaagccgaccaagcaggtcaattaagtccgctttcccttgccaatcaatggatttatatcggggtctcaattgtactttgttctatcatacaaaccttgacaaaagacttaacgctcacctgtttttacatgagctatcttgttttattgtttattatcggcaaactcgattggcattatcagctcattgaacctgctttatgccagttgttgctgttaattctgtcaggcgcaagttatttccgcctaatttccaattctttggaagatgttgttgaaagtgcggtaatttcttttgttattttttatcttgtataccacataagcaaactttgctacaaaaaagaagtattcgggcagggcgattattggctaatcagcgcattatccgcaggtttatcctggcgggatattccgctgatgataagccttgcctgccttttagccttattttatgctttaatttataaccgcctcctagcccacacaaaaatcagccttgttcctttcgcgccttttctctgtaccgctaaccttgtgactctttttataaagatgttaatatga

SEQ ID NO: 106455 - protein, 238 aa, Mannheimia succiniciproducens MBEL55E
MSNLYLVFFACLLGYLTYYYLSNFRTKLHKDIYYAFYQIFPQKQPHFTIEQADQAGQLSPLSLANQWIYIGVSIVLCSIIQTLTKDLTLTCFYMSYLVLLFIIGKLDWHYQLIEPALCQLLLLILSGASYFRLISNSLEDVVESAVISFVIFYLVYHISKLCYKKEVFGQGDYWLISALSAGLSWRDIPLMISLACLLALFYALIYNRLLAHTKISLVPFAPFLCTANLVTLFIKMLI

SEQ ID NO: 106456 - DNA, 870 bp, Legionella pneumophila subsp. pneumophila str. Philadelphia 1
  CDS (1)..(870): transl_table=11
gtgtcaatgataaatgcactaataatcaattatccatggtttatgtatttagtcgttggactcttttctctagccgttggaagtttgcttaatgtgataatctatcgcttaccaattattttgcaggaagagtggaaagagcaatgctgtgagctattccatcttgaacagcgaaaagaaaaaataaaacttaatttatttttaccacgttctttttgtcctcattgtaaagcgatggttaaagcgtggcagaatattcctctgttaagctatattttgttaagaggacgctgttaccaatgtgatagtccaatttcaatccgctacccttttgttgagacgttgaccacagttttatccttatacgccagttggcattttgggtttacaatacaattattatttgctttattagctatctggatattaatatcacttgtttttattgatcttgatcatcaattactccctgatagcctcactttagggctcttatggattggccttattgctaatacccagaatgtatttgttagtcttgacgttgctgtattaagctgcgctggcgcttatttagccttatggctattcattaatctgttttatctgatgacaggtaaagtaggtatgggacatggagatttcaaattatttgcagcatttggtgcctggcttggatggatgtatttaccattaattctactaatatcttcaataacgggggctatcattggtttgatttatttaaagataaatggtaaatcaagagatactgcaataccatttggcccttttctttgcatttctggattaatagctatgttttggggagactcaatcatcaattggtatataggttattggatgtaa

SEQ ID NO: 106457 - protein, 289 aa, Legionella pneumophila subsp. pneumophila str. Philadelphia 1
MSMINALIINYPWFMYLVVGLFSLAVGSLLNVIIYRLPIILQEEWKEQCCELFHLEQRKEKIKLNLFLPRSFCPHCKAMVKAWQNIPLLSYILLRGRCYQCDSPISIRYPFVETLTTVLSLYASWHFGFTIQLLFALLAIWILISLVFIDLDHQLLPDSLTLGLLWIGLIANTQNVFVSLDVAVLSCAGAYLALWLFINLFYLMTGKVGMGHGDFKLFAAFGAWLGWMYLPLILLISSITGAIIGLIYLKINGKSRDTAIPFGPFLCISGLIAMFWGDSIINWYIGYWM

SEQ ID NO: 106458 - DNA, 930 bp, Burkholderia pseudomallei K96243
  CDS (1)..(930): transl_table=11
atgccaaccgcctcgatgacgcccaatccgttcctttccggctcgcccgaacatgcggcggcggccgggccgctcgccgcattcgcggcgctccccacgggcatgcagcttgcgttcgcgatcgtgctcggcctcgtcgtcggcagcttcatcaacgtcgtcgtccatcggctgccgatcatgatgaagcgcgcgtggctcgccgaaatcgccgaagcgacgggcgcgccgtgcgccgacgacggcctgccggcgcgctacaacctctgcgtgccgcgcagcgcgtgcccgcactgcggccatgcgctgcgcgcgtgggaaaacgtgccggtcctcagctatatcgcattgcggggccggtgccggcactgccgtacgccgatcggcgcgcgctatccgctcatcgaactcgcgagcggcgcgctcgccgccggcgcgctcgcgctgttcgggccgagcggcgccgcactcgccgcgttcggcctgtgcgcggcgctcctcgcgatgagcgcgatcgacatgcagaccggcttcctgcccgattcgctcacgttgccgctcctgtgggccgggctgtgcgtcaatctctggggcacgtttgcgagcctgcgcgccgcggtgatcggcgcgatcgccggctatctgttcctctggtgcattctgtggctcttcaaactgctgcgcggcatcgaaggaatcggctacggcgacctgaagctcctcgccgcgctcggcgcatggctcggctgggaagcattgccgcaggtcgtgctgatcgcagcggtcgccggcgccgcggtcggtctcgtcgcaacctggcgcggccgcatgcgcttcgaggaaccgttgccattcggcccgttcctcgcggcgggcggcgccgcgaccctctttttcggcacgccgttctacctgctgctcggaggctga

SEQ ID NO: 106459 - protein, 309 aa, Burkholderia pseudomallei K96243
MPTASMTPNPFLSGSPEHAAAAGPLAAFAALPTGMQLAFAIVLGLVVGSFINVVVHRLPIMMKRAWLAEIAEATGAPCADDGLPARYNLCVPRSACPHCGHALRAWENVPVLSYIALRGRCRHCRTPIGARYPLIELASGALAAGALALFGPSGAALAAFGLCAALLAMSAIDMQTGFLPDSLTLPLLWAGLCVNLWGTFASLRAAVIGAIAGYLFLWCILWLFKLLRGIEGIGYGDLKLLAALGAWLGWEALPQVVLIAAVAGAAVGLVATWRGRMRFEEPLPFGPFLAAGGAATLFFGTPFYLLLGG

SEQ ID NO: 106460 - DNA, 870 bp, Methylococcus capsulatus str. Bath
  CDS (1)..(870): transl_table=11
atgatgttgttgccgaccgggccggcgggggttgccctctgcggatcgttcggactgatcatcgggagttttctcaacgtggtcatccaccgcctgccgctcatgatggagcaggcctggcgcagggagtgcggggagttgctcgagcccggcaccggacggccggtggggaaagccgaatacaacctgtggagacccggatcgcagtgtccgcattgccaggcgccggtccggttctggcagaatgtccccgtgttcagctatctttggctgcgtggccgttgtgccgcttgcggcacggcgatttcctggcgttatcctttggtcgaaacgctcacgggggtgctgttcgcaatggtggcttggcatttcggcgcgtcctggcaggcgctggcggcgtgcgccctaacggctggcctgatcgccctggctttcatcgacctggatcacttggtactgccggacgacatcacgcttcccctgttgtggctggggctgctgctgaacgcccaaggcctcttctgcagtctggagacggcgctgtacggtgccgttgcaggctatctcctgctatggacggtgcatcgcggctttctgctcctgaccggccgggagggcatggggttcggcgacttcaagctactcgccatgctcggtgcctggatgggttggccgatgctgccggtcatcatcctgttctcatccatctcgggtgcggtgatcggttcggttgcgctggcagtcggcggcaaggggagggacacgccgattcccttcgggccgtttctggcggcgggtggctggatcgccctgctgtggggaaatgcgctcaacgacgcctattggcgctgggccgctcctggaggctag

SEQ ID NO: 106461 - protein, 289 aa, Methylococcus capsulatus str. Bath
MMLLPTGPAGVALCGSFGLIIGSFLNVVIHRLPLMMEQAWRRECGELLEPGTGRPVGKAEYNLWRPGSQCPHCQAPVRFWQNVPVFSYLWLRGRCAACGTAISWRYPLVETLTGVLFAMVAWHFGASWQALAACALTAGLIALAFIDLDHLVLPDDITLPLLWLGLLLNAQGLFCSLETALYGAVAGYLLLWTVHRGFLLLTGREGMGFGDFKLLAMLGAWMGWPMLPVIILFSSISGAVIGSVALAVGGKGRDTPIPFGPFLAAGGWIALLWGNALNDAYWRWAAPGG

SEQ ID NO: 106462 - DNA, 864 bp, Legionella pneumophila str. Paris
  CDS (1)..(864): transl_table=11
atgataaatgcactaataatcaattatccatggtttatgtatttagtcgttggactcttttctctagctgttggaagtttgcttaatgtgataatctaccgcttaccaattattttgcaggaagagtggaaagagcaatgctgtgagctattccatcttgaacagcgaaaagaaaaaataaaacttaatttatttttaccacgttctttttgccctcattgtaaagcgatggttaaagcgtggcagaatattcctctgttaagctatatttttttaagaggacgctgttaccaatgcgatagtccaatttcaattcgctacccttttgttgagactctgaccacagttttatccttatacgccagttggcattttgggtttacaatacaactattatttgctttattagctatctggatattaatatcacttgtttttattgatcttgatcatcaattactccctgatagcctcactttagggctcttatggattggccttattgctaatacccagaatatatttgttagtcttgacgttgctgtattaagctgcgctggcgcctatttagctttatggctattcattaatctgttttatctgatgacaggtaaggtaggtatgggacatggagatttcaaattatttgcagcatttggtgcctggcttggatggatgtatttaccattaattctactaatatcttcaataacgggggctattattggtttgatttatttaaagataaatggtaaatcaagagatactgcaataccatttggcccttttctttgcatttctggattaatagctatgttttggggagactcaattatcaattggtatataggttattggatgtaa

SEQ ID NO: 106463 - protein, 287 aa, Legionella pneumophila str. Paris
MINALIINYPWFMYLVVGLFSLAVGSLLNVIIYRLPIILQEEWKEQCCELFHLEQRKEKIKLNLFLPRSFCPHCKAMVKAWQNIPLLSYIFLRGRCYQCDSPISIRYPFVETLTTVLSLYASWHFGFTIQLLFALLAIWILISLVFIDLDHQLLPDSLTLGLLWIGLIANTQNIFVSLDVAVLSCAGAYLALWLFINLFYLMTGKVGMGHGDFKLFAAFGAWLGWMYLPLILLISSITGAIIGLIYLKINGKSRDTAIPFGPFLCISGLIAMFWGDSIINWYIGYWM

SEQ ID NO: 106464 - DNA, 864 bp, Legionella pneumophila str. Lens
  CDS (1)..(864): transl_table=11
atgataaacgcactaataatcaattatccatggtttatgtatttactcgttggcctcttttctctagccgttggaagtttgcttaatgtgataatctatcgcttaccaattattttgcaggaagagtggaaagagcaatgctgtgagctattccattttgaacagcgaaaagaaaaaataaaacttaatttatttttaccacgttctttttgtcctcattgtaaagcgatggttaaagcgtggcagaatattcctctgttaagctatattttgttaagaggacgctgttaccaatgtggtagtccaatttcaatccgctacccttttgttgagacgttgactacagttttatccttatacgccagttggcactttgggtttacaatacaattattatttgctttattagctatctggatattaatatcacttgtttttattgatcttgatcatcaattactccctgatagcctcactttagggctcttatggattggccttattgctaatacccagaatgtatttgttagtcttgacgttgctgtattaagctgcgctggcgcctatttagccttatggttattcattaatctgttttatctgatgacaggtaaagtaggtatgggacatggagatttcaaattatttgcagcatttggtgcctggcttggatggatgtatttaccattaattctgctaatatcttcaataacgggggctatcattggtttgatttatttaaagataaatggtaaatcaagagatactgcaataccatttggtccttttctttgtatttctggattaatagctatgttttggggagactcaattatcaattggtatataggttattggatgtaa

SEQ ID NO: 106465 - protein, 287 aa, Legionella pneumophila str. Lens
MINALIINYPWFMYLLVGLFSLAVGSLLNVIIYRLPIILQEEWKEQCCELFHFEQRKEKIKLNLFLPRSFCPHCKAMVKAWQNIPLLSYILLRGRCYQCGSPISIRYPFVETLTTVLSLYASWHFGFTIQLLFALLAIWILISLVFIDLDHQLLPDSLTLGLLWIGLIANTQNVFVSLDVAVLSCAGAYLALWLFINLFYLMTGKVGMGHGDFKLFAAFGAWLGWMYLPLILLISSITGAIIGLIYLKINGKSRDTAIPFGPFLCISGLIAMFWGDSIINWYIGYWM

SEQ ID NO: 106466 - DNA, 900 bp, Photobacterium profundum SS9
  CDS (1)..(900): transl_table=11
atggaattgtttacatactacccttggttatttccggttttcgccgctatttttggtttgctcattggtagttttttgaatgtggtgatccaccgcttaccgatcatgatggaacgtcaatggaaagccgattgcattgaatgctttcctgaatttgataaagaaaataaacaagagaaagataataattccgtcgcaacaacgcctgtttttaatcttagtgtgccgcgctcacgctgccctcattgccaacacgccatcaccatgtgggaaaacatccctgtcattagttggttagtgttaaaagggaaatgcagtgcctgcggtgcaaaaatcagtgctcgctaccctaccattgaattgctgactgcggtcatgaccaccattatctcgctcatgttaccgtcatcattgtgggctgttgcggttatctttttcagcttcgccctgattgccctgacttttattgatatcgataccatgttactgccggatcaaattaccctccctttaatgtgggctggtattgcagcggccctcgtgggcttgagccctgtatcactgcaagatgccattattggtgcgatggtgggctatctgtcactttggagcctattctggagctttaaactgatcacaggcaaggaaggcatgggatacggtgattttaagctgttagcggctttgggcgcttggctgggctggcaaagtttaccttttgtggtattactttcttccttggttggcgcagtttgtggcattatcttattaagagtgcaacgttctgattcacaaacacctttttcatttggtccttaccttgctatggcgggctggattagcattctatggggcgatcaagttattagctggtatctccattcatatataggcatgtaa

SEQ ID NO: 106467 - protein, 299 aa, Photobacterium profundum SS9
MELFTYYPWLFPVFAAIFGLLIGSFLNVVIHRLPIMMERQWKADCIECFPEFDKENKQEKDNNSVATTPVFNLSVPRSRCPHCQHAITMWENIPVISWLVLKGKCSACGAKISARYPTIELLTAVMTTIISLMLPSSLWAVAVIFFSFALIALTFIDIDTMLLPDQITLPLMWAGIAAALVGLSPVSLQDAIIGAMVGYLSLWSLFWSFKLITGKEGMGYGDFKLLAALGAWLGWQSLPFVVLLSSLVGAVCGIILLRVQRSDSQTPFSFGPYLAMAGWISILWGDQVISWYLHSYIGM

SEQ ID NO: 106468 - DNA, 1068 bp, Thermus thermophilus HB8
  CDS (1)..(1068): transl_table=11
atgtggcccctcttcgccctgctcctcggcctcgcggtgggttcctttctcaacgtggtggtccaccgcctgccccggggggagtccgtcgcctaccccccgtcccgctgcccccagtgcggccaccgcctggggccttgggacctggtccccgtcctctcctacctcgccctaaaggggcggtgccgctactgcgcccgtcccatctccccccgctaccccctggtggaggccctcacgggggggcttttcctcctcgcaagcctcttctacccccctggggtggaggccctcttggtcttcctcttcctcgcctttctcgtggccctcgccttcattgacgtggacacctttgagcttcccgatcccctcacctacggcctcctcttccttgggcttttggcctcctgggcgctggccttccccctcccctttagggagagcctggacggaagcctcatggccgccggggggctcgccctggtggcggggtacgggaacctctttctgcggcgctttagggaggccagggccgaggtccccgtggggccccaccaggtccacatggcggccctctttggggcgctcttgggcccaggggtggggatggccctcgccttcctcgcttgggccctctccgcccgcacggggcgggcggtggccctccccgaccggctcaccctgccccttttgcccctcgccttcctccttgcccccgccctaggcctggacttcctggaaagccttaagggaagcctcctcgctgccggggggctcgccctcgccggggggctttactgggccttccggccccttcccgaggagggcgaggaggagcccgtggccatgggctacggggacgtgaagcttctgggggccctcggggcctggctcggcccttacgccttcctcgccctcttcctcggggtcttcgccggggcgcttttgggccttctccttaggcaaaggaagctccccttcggcccctacctcgccctcgggggggtggtggccttcttcttcggggaggccctctggggggcgtacctgcgccttctgggcgtttga

SEQ ID NO: 106469 - protein, 355 aa, Thermus thermophilus HB8
MWPLFALLLGLAVGSFLNVVVHRLPRGESVAYPPSRCPQCGHRLGPWDLVPVLSYLALKGRCRYCARPISPRYPLVEALTGGLFLLASLFYPPGVEALLVFLFLAFLVALAFIDVDTFELPDPLTYGLLFLGLLASWALAFPLPFRESLDGSLMAAGGLALVAGYGNLFLRRFREARAEVPVGPHQVHMAALFGALLGPGVGMALAFLAWALSARTGRAVALPDRLTLPLLPLAFLLAPALGLDFLESLKGSLLAAGGLALAGGLYWAFRPLPEEGEEEPVAMGYGDVKLLGALGAWLGPYAFLALFLGVFAGALLGLLLRQRKLPFGPYLALGGVVAFFFGEALWGAYLRLLGV

SEQ ID NO: 106470 - DNA, 861 bp, Idiomarina loihiensis L2TR
  CDS (1)..(861): transl_table=11
atggaatacttgcttgctgccggatcaataccgacattgatggtcgcgctggtgctgggagctgttattgggagcttcctgaatgtagtgatcacccggctaccaatacagctggaacgccaatggcagcgcgaatgtgccgaaatgaacggaacgccggtaaccaaacaggaccgcttttccatcgcgtttccgggttcccattgccctgaatgcaaggcctctattgcctggtacgataatattccgctgttgagttatctggttttgcgcgcacgctgccgccattgtcaaactcgcattccggttacctactggctggttgaaattatcagttgcctggcgtttggcataataggctggtatttcggcttcactctgccagcgctggtatatgctacggtcttttcgttattaatttgcctgttcgtcattgactggcgtcatcagttactgcccgatcagctcacttaccctttactctgggtggctttgctctggtctatctctgacttaagtgacatgactccaacctccgcaattattggtgccgcagcgggttatcttagcctttggagcgtgttctgggcctataagcttatcaccggcaaagaaggtatgggctatggtgactttaaactgctggcagctatcaccgcttttaccggcgcgactctgttgccggtcacaattcttgccagctcggtttgcggagccgtaataggcctgattatgttacgccggcaaagccgctctcaacccataccttttgggccttttctaatcggcggaggcctgctgagttatttctatggtatggagctgttgttcagctactggcattggttagggggaacttga

SEQ ID NO: 106471 - protein, 286 aa, Idiomarina loihiensis L2TR
MEYLLAAGSIPTLMVALVLGAVIGSFLNVVITRLPIQLERQWQRECAEMNGTPVTKQDRFSIAFPGSHCPECKASIAWYDNIPLLSYLVLRARCRHCQTRIPVTYWLVEIISCLAFGIIGWYFGFTLPALVYATVFSLLICLFVIDWRHQLLPDQLTYPLLWVALLWSISDLSDMTPTSAIIGAAAGYLSLWSVFWAYKLITGKEGMGYGDFKLLAAITAFTGATLLPVTILASSVCGAVIGLIMLRRQSRSQPIPFGPFLIGGGLLSYFYGMELLFSYWHWLGGT

SEQ ID NO: 106472 - DNA, 852 bp, Azoarcus sp. EbN1
  CDS (1)..(852): transl_table=11
atgcccgacctctttcacgaccttctcctgttcaccgcgctcgcgacgttcgtcggccttttcgtcggcagcttcctgaacgtcgtcatccaccggttgccgcgcatgatggagcgcgaatggcacgcccaggctgccgagctgcgcggcgaatcgctccccgagcaggaaacctacaatctggcggtgccgcgctcgcgctgcccgcactgcggccacatgatcaccgcgttcgagaacatcccggtcatcagctatcttgtcctgcgcgggcgatgccgtcactgcagcgcgcccattggccgccgctacccgaccgtcgaaatgctcaccgctgtgctctcgggctacgctgcgtggcacttcggcttcggcctcgcggccgccggcgcaatgcttttcctgtggacaatggtcgcgctcgcgttcatcgatctcgacacccagctgctgcccgacagccttaccctcccgctgctgtggctcggcctgcttttcaatctcgatggcacgtacagcgagctcccgcaggccgtcgtcggcgcgatcgccggttacctcgcgctgtgggcagtgtactggctgttcaagctcgccaccggcaaggaaggcatgggctacggcgatttcaagctgctcgccgcgatcggggcgtggctcggatggcagatgctgcccttgacgatcctgttctcgtcgctcgtcggcgcggtcaccggcctcggcctgatcgttttcgcccggcacggccgggacgtgccgattccgttcggcccctatctcgccgctgccggcgtgctggcgctgttctggggcgagccgctcacgcagttgtacctcggcagcctgtga

SEQ ID NO: 106473 - protein, 283 aa, Azoarcus sp. EbN1
MPDLFHDLLLFTALATFVGLFVGSFLNVVIHRLPRMMEREWHAQAAELRGESLPEQETYNLAVPRSRCPHCGHMITAFENIPVISYLVLRGRCRHCSAPIGRRYPTVEMLTAVLSGYAAWHFGFGLAAAGAMLFLWTMVALAFIDLDTQLLPDSLTLPLLWLGLLFNLDGTYSELPQAVVGAIAGYLALWAVYWLFKLATGKEGMGYGDFKLLAAIGAWLGWQMLPLTILFSSLVGAVTGLGLIVFARHGRDVPIPFGPYLAAAGVLALFWGEPLTQLYLGSL

SEQ ID NO: 106474 - DNA, 819 bp, Francisella tularensis subsp. tularensis SCHU S4
  CDS (1)..(819): transl_table=11
atgtactacgatatctatataatttacttgtttatatttctatttggtgctgctattggcagttttttgaatgttgttatatatcgagtgccaaataaactatttgctgatgagcaagctattgcacgagaaatactggggattgataagcaacaatctccacagaattttagtttattgacaccatcaaaatgcccaaaatgtcataataaactaaagtatcgtcataatattccgataatcggatggtttttgcttaaaggcaaatgctttttctgtaaagaaaaaatatcttttgaatacccattaatagagtttatcacagctagtttatttataactattttttactgttttggttttacatttcagagtttagctctagtaactttggctagcttttttataccattattctttattgatgccaaacatcaaatccttcctgattcgttaacactaccattactatggcttgggataatacttaattactaccatacgtttactaccctagagcaatctgtctggggagctataattggctatctttcactttggttggttttttggatatacaaaatccttacaggtaaagaaggctttggttatggtgattttaaactcttagctgcagtgggggcttggtttggctatccaatgttactgtatacaattttcgctagttgtatatttgggattataatcgctattgctataaatcttgttgctaagcgtactaatgtaatagcttttgggcccgcgataattctagcaacatttttttatctactgactaaagataatatctatgtatag

SEQ ID NO: 106475 - protein, 272 aa, Francisella tularensis subsp. tularensis SCHU S4
MYYDIYIIYLFIFLFGAAIGSFLNVVIYRVPNKLFADEQAIAREILGIDKQQSPQNFSLLTPSKCPKCHNKLKYRHNIPIIGWFLLKGKCFFCKEKISFEYPLIEFITASLFITIFYCFGFTFQSLALVTLASFFIPLFFIDAKHQILPDSLTLPLLWLGIILNYYHTFTTLEQSVWGAIIGYLSLWLVFWIYKILTGKEGFGYGDFKLLAAVGAWFGYPMLLYTIFASCIFGIIIAIAINLVAKRTNVIAFGPAIILATFFYLLTKDNIYV

SEQ ID NO: 106476 - DNA, 789 bp, Synechococcus elongatus PCC 6301
  CDS (1)..(789): transl_table=11
atgtttgaagccgttgcgctgctgtttgtcgcagttttgggagccgcgatcgggagctttttaaatgtggtgatctaccgattgcccctcggtctgtcactgctgcatcccccctcccgctgtccctactgccggcgatcgctgcggccgcaagataatctgccggttgttggctggctaaagctgcgggggcgttgccatttctgccagcatcggattcccgctcgctacccaattgttgaagccctaactgctgctctgttcgtcctgctggcggtgcagtttggctggtctgcggccacgctcggcggctggatttttttctcgtggttgcttgcgctcagtgtcatagacctcgatacgatgaccctacccaatgtcttgacggcgtcggggctggcggtgggtgtggcttttcagttggcgatcgcacccgcaacctggcccgtgaccctgttctggtccttgtttgtggcgatcgcggcgctatggctgagtgatctatttcgctggctgggagaattcgctctgcggcagccggtgctcgggggcggtgacagcaagttgttggcgctgttgggtgtttggctgggcgggcccaaactccttttggcactgttccttgcttgcctgagtggtgcaatcgcgggggggattgggcgttggcgcggcaccctcaaacccatgcaagcaatgccttttggcccattcctggccttgggtggggcgatcgcttggatctggggagccgagtggattgatctctatatgcgagttttgctcttttaa

SEQ ID NO: 106477 - protein, 262 aa, Synechococcus elongatus PCC 6301
MFEAVALLFVAVLGAAIGSFLNVVIYRLPLGLSLLHPPSRCPYCRRSLRPQDNLPVVGWLKLRGRCHFCQHRIPARYPIVEALTAALFVLLAVQFGWSAATLGGWIFFSWLLALSVIDLDTMTLPNVLTASGLAVGVAFQLAIAPATWPVTLFWSLFVAIAALWLSDLFRWLGEFALRQPVLGGGDSKLLALLGVWLGGPKLLLALFLACLSGAIAGGIGRWRGTLKPMQAMPFGPFLALGGAIAWIWGAEWIDLYMRVLLF

SEQ ID NO: 106478 - DNA, 888 bp, Vibrio fischeri ES114
  CDS (1)..(888): transl_table=11
atggctgtttttgattattacccttggcttttccctctatttgccaccctatttgggttgcttgttggtagttttttaaatgtcgtaatttatcgtttacccatcatgatggaaaaggaatggaaaaaagactgcattgattgctttccagatcttgcccctaaaaaaacaagtgaagaaaaagaagaaacctttaacttaagtgttcctcgctctcgctgcccaaagtgtcaaactcaaattaaattctatgacaacattcctgtcattagctggcttttattaaaaggaaaatgtcgtcaatgcagtaaccctatcagttttcgatatcctgcaattgaactactatcaggcgcaatgtgttttgccgtttcatacttattacccttctcatattttgctgttgctgccgttctatttactctagttttgatcgcattaacctttatcgatattgataccatgttactgccagatcaaatcaccctacctctactatggagtggtctatacttagctctagtgggttggagttcagtgagcttagttgattctgttgttggtgcaatggctggctatttgattttatggtctatttactggggctttaagctgcttacaggcaaagaaggcatgggttatggtgatttcaaattactggcggctcttggagcatggcttggttggcagcagctaccattgatcattctattatcttctgttgtcggagcaatcattggcgtcatcatgctaaccgctcaaaagaaagggtttgacaaagcaattccctttggtccttatttagctattgctggctgggtttgcctattatggggacaaaacattagccaatggtattttaatcacattctaggtttgccactatga

SEQ ID NO: 106479 - protein, 295 aa, Vibrio fischeri ES114
MAVFDYYPWLFPLFATLFGLLVGSFLNVVIYRLPIMMEKEWKKDCIDCFPDLAPKKTSEEKEETFNLSVPRSRCPKCQTQIKFYDNIPVISWLLLKGKCRQCSNPISFRYPAIELLSGAMCFAVSYLLPFSYFAVAAVLFTLVLIALTFIDIDTMLLPDQITLPLLWSGLYLALVGWSSVSLVDSVVGAMAGYLILWSIYWGFKLLTGKEGMGYGDFKLLAALGAWLGWQQLPLIILLSSVVGAIIGVIMLTAQKKGFDKAIPFGPYLAIAGWVCLLWGQNISQWYFNHILGLPL

SEQ ID NO: 106480 - DNA, 873 bp, Pseudomonas syringae pv. syringae B728a
  CDS (1)..(873): transl_table=11
atgcccctcctcgacctcctggccagctcacccctggccttcgtcaccacctgctgcattctcggcctgatcatcggaagcttcctcaacgtgatcgtctatcgcctgccaataatgatggagcgcgactggaaagcccaatcccgagaactgctcggcctgcctgctgaacccgatcaacccgtcttcaatctgaaccgcccccgttccagctgcccgcattgcgcacacaaaatccgcccttgggagaacctgccggtgatcagctatctgctgctgcgtggtaaatgctcgcagtgcaaagcgccgatcagcaaacgttacccactggtcgagctgacctgcgcagtgttatcggcatacgtggcctggcatttcgggttcggctggcaggcgacggcgatgctggtattgggctgggggctgctggcgatgagtctgatcgatgccgatcaccaactgttacctgattctctggtgctgccactgctgtggctgggcctgatcgtcaacgctttcgggctgttcacctcgctgaatgatgcgctgtggggtgcagtggccgggtatctggcactgtggtcggtgttctggctgttcaagctggtgaccggcaaggaaggcatgggttatggcgacttcaagttgctggccatgctgggcgcgtggggcggctggcaggttttgccgttgaccatcctgttatcgtcgctggtgggcgcggtgctcggggtgatcatgatgcgcgtgcgcagggtcgaaagcggtacgccgatcccctttggtccttatctggccattgcggggtggatcgctttgctctggggtggtcaaataaccgactcttacatgcagtttgccggtttcagatga

SEQ ID NO: 106481 - protein, 290 aa, Pseudomonas syringae pv. syringae B728a
MPLLDLLASSPLAFVTTCCILGLIIGSFLNVIVYRLPIMMERDWKAQSRELLGLPAEPDQPVFNLNRPRSSCPHCAHKIRPWENLPVISYLLLRGKCSQCKAPISKRYPLVELTCAVLSAYVAWHFGFGWQATAMLVLGWGLLAMSLIDADHQLLPDSLVLPLLWLGLIVNAFGLFTSLNDALWGAVAGYLALWSVFWLFKLVTGKEGMGYGDFKLLAMLGAWGGWQVLPLTILLSSLVGAVLGVIMMRVRRVESGTPIPFGPYLAIAGWIALLWGGQITDSYMQFAGFR

SEQ ID NO: 106482 - DNA, 693 bp, Haemophilus influenzae 86-028NP
  CDS (1)..(693): transl_table=11
atgatttacttcacaatgtttttattaggcggcatcttagggatcgcattgtggttctacctatctggttttattacgcatttgcagcaagagatttatgcgacttacgttgaattatttccacaaaacagttctccatttcaaccgcactttgcctctattcaacaaaaaaagtgcggtcatattttgaggtatttttttagtattggggttggatttatatttttacaaattgccttcaaagattctatttttactgtatggatcggactcacacttattattctttggacaatcagttatcttgattggcactatcaacttatttctacgacaccctgtttatggttacttactctcggtttatttggcgcagacaataacttttcattgctaacgttatctgaaagcataaaaagtgcggctagtttttttattgttttctacgcaatctattggattgcaaaatgttattatagaaaagaagcctttggacggggagattattggctagcaatggcattaggaagttttattcatttagaaaccttaccgcactttttattattagcctcagtgcttggaatatgtttttcgcttattcataaaaagaaaaaagaatttataccttttgccccttttatgaacttatcggctatcattatttatctcgtcaaatattacggatattaa

SEQ ID NO: 106483 - protein, 230 aa, Haemophilus influenzae 86-028NP
MIYFTMFLLGGILGIALWFYLSGFITHLQQEIYATYVELFPQNSSPFQPHFASIQQKKCGHILRYFFSIGVGFIFLQIAFKDSIFTVWIGLTLIILWTISYLDWHYQLISTTPCLWLLTLGLFGADNNFSLLTLSESIKSAASFFIVFYAIYWIAKCYYRKEAFGRGDYWLAMALGSFIHLETLPHFLLLASVLGICFSLIHKKKKEFIPFAPFMNLSAIIIYLVKYYGY

SEQ ID NO: 106484 - DNA, 873 bp, Pseudomonas fluorescens Pf-5
  CDS (1)..(873): transl_table=11
atgcccctgactgacgccctcactctctaccccatggccttcgtggctgcggccctggtattgggcctgatcgtcggcagctttctcaacgtgctggtgtggcgcctgccgaaaatgctcgaacgcgactggcgagcccaggcccgcgacgtgctggggctggggccggaacctgtggctgcgccctataacctgatgctgccgcactcccagtgcccgcactgtgcgcaggcgatccgcccctgggaaaacattccgctgctcagttacctgtggctgcgtggctgctgcgcccactgcaatagctccatcagcccgcgctacccgttgaccgaactggcctgcgggctgatctcgggttttatcgcctggcacttcggcttcggctgggcggccgggctgatgctgatcctcagttgggggctgctggcaatgagcctgatcgacgccgatcaccagctgctgccggatgtgctggtgctgccactgttgtggctggggctgatcgccaacagcttcggcctgctgatcagcctggaggatgcgctgtgggggacggtgatcggctacctgttcctgtggtcggtgttctggctgttcaagctgctgaccggcaaggagggcatgggccacggtgatttcaagctgctggccctgttcggggcctggggcggctggcagatcctgcctctgaccctgctgctgtcatccctgttgggagcgattctcggcacgatcctgctgcgcctgcgccgggaaaagacctcgacgccaatcccctttggaccctttctggccattgccggctggattgccttgctctggggtggtcaaataaccgacttctatctgcagtttgtcggtttccaatga

SEQ ID NO: 106485 - protein, 290 aa, Pseudomonas fluorescens Pf-5
MPLTDALTLYPMAFVAAALVLGLIVGSFLNVLVWRLPKMLERDWRAQARDVLGLGPEPVAAPYNLMLPHSQCPHCAQAIRPWENIPLLSYLWLRGCCAHCNSSISPRYPLTELACGLISGFIAWHFGFGWAAGLMLILSWGLLAMSLIDADHQLLPDVLVLPLLWLGLIANSFGLLISLEDALWGTVIGYLFLWSVFWLFKLLTGKEGMGHGDFKLLALFGAWGGWQILPLTLLLSSLLGAILGTILLRLRREKTSTPIPFGPFLAIAGWIALLWGGQITDFYLQFVGFQ

SEQ ID NO: 106486 - DNA, 900 bp, Psychrobacter arcticum 273-4
  CDS (1)..(900)
atgcaatttatacagttattacaagaaaatatgagtatcgctttggtcgtatttggtctactaggactttgtgtaggtagctttttaaatgtggtgattcatcgtataccactgatgatggtatcggtttggcgacaagaatgtagccagtttatgtatgagcaagcagacataccacgtgagcatacgacgccactggtcaatattattgccaccgatatacctattaccttaagccgccctgcttcacgctgcccgcattgtgcccataaaatcaaatggtatgaaaacatccctttaatcagctggatagtactacgtggtcgttgctcagaatgtaaaacgactattggactgcgttatcctgtcgttgagctggtcactgcgctgctatctgtattggtcatttatcagtttggtgtcagtacggctgggctatcagcattgattttggtatggacactagtcgttttaaccggtatcgattttgatacgcagctattacctgaccgcttaacttttccattggcagggttgggactggcggtaaactcacaaggctggtttgtctcccctactcagtcgatatggggcttactgttggggtttttatctctatggatagtggtcaagatattttatttgatcaccaaaaaacatggcatgggacaaggtgactttaaattattggcagtactgggcgcgtggcttggtcctgtgatgttgccattggttattctattgtcatctttacttggctccatcgttggtcttatccttataaaaaaacaaggcgagagcaagccctttgcttttggtccttatattgccattgcgggtatcgtggcgttgttatatggttcagatatcgttaattggtatttaggcatgtataattaa

SEQ ID NO: 106487 - protein, 299 aa, Psychrobacter arcticum 273-4
MQFIQLLQENMSIALVVFGLLGLCVGSFLNVVIHRIPLMMVSVWRQECSQFMYEQADIPREHTTPLVNIIATDIPITLSRPASRCPHCAHKIKWYENIPLISWIVLRGRCSECKTTIGLRYPVVELVTALLSVLVIYQFGVSTAGLSALILVWTLVVLTGIDFDTQLLPDRLTFPLAGLGLAVNSQGWFVSPTQSIWGLLLGFLSLWIVVKIFYLITKKHGMGQGDFKLLAVLGAWLGPVMLPLVILLSSLLGSIVGLILIKKQGESKPFAFGPYIAIAGIVALLYGSDIVNWYLGMYN

SEQ ID NO: 106488 - DNA, 906 bp, Colwellia psychrerythraea 34H
  CDS (1)..(906): transl_table=11
ttgttagataaattttattctctctttaatcacataaacatgttatttcaagaactccctaccttcttctatattacggttgccctaatttcattggccataggtagctttcttaatgttgtcatttatcgtacccctaaaatgatggaatatacttggtatcatgactgccgagagtttctagccgatgaggttgctaatgttaaggcaaaaagacttactaaaatcaccctatctaaacctgactctacctgccctaactgtgatcataaaattcgattttatgaaaacatccctgtattaagttggttattactaaaggggaagtgtagccagtgcactaataatatttcagctcgttatcctataatcgaactttctaccatggtgctaagtcttattgttgctcaacattttggtgcaacaatatctacattgtgggttttgttactcacttggtgtttgattacacttaccatgatagattttgatcacatgttattacctgatcaaattacactgccacttttatggttaggtttactaataaacataaatggaacttttatcccattacccgatgctgtcattggagcagccgttggttacatgagcctattctctgtcttttggctctttaaagtaataacaggtaaagagggcatgggttatggcgactttaaattgttcgctgtttttggtgcttggatcggttggcaattacttcctattctaattttaatggcatcagttgttggcgcaattgttggtattactttaatgttattcaaaaaccatcaaagagagcaaggcatcccttttggcccatatttagcagtagctggttggataactttattatggggtgatggtatttggtcatggtatttacaaaaaattctttaa

SEQ ID NO: 106489 - protein, 301 aa, Colwellia psychrerythraea 34H
MLDKFYSLFNHINMLFQELPTFFYITVALISLAIGSFLNVVIYRTPKMMEYTWYHDCREFLADEVANVKAKRLTKITLSKPDSTCPNCDHKIRFYENIPVLSWLLLKGKCSQCTNNISARYPIIELSTMVLSLIVAQHFGATISTLWVLLLTWCLITLTMIDFDHMLLPDQITLPLLWLGLLININGTFIPLPDAVIGAAVGYMSLFSVFWLFKVITGKEGMGYGDFKLFAVFGAWIGWQLLPILILMASVVGAIVGITLMLFKNHQREQGIPFGPYLAVAGWITLLWGDGIWSWYLQKIL

SEQ ID NO: 106490 - DNA, 873 bp, Pseudomonas syringae pv. phaseolicola 1448A
  CDS (1)..(873): transl_table=11
atgcccctcctcgacctcttggccagctcaccgctggccttcgtcattacctgctgcattctcggcctgatcatcggaagcttcctcaacgtagtcgtctaccgcctccccaaaatgatggagcgcgactggaaagcccaatcccgtgaaatgctcggcctgcccgcggaacccgatcagcccgccttcaacctgaaccgccctcgctccagctgcccgcgctgcgcgcacaaaatccgcccgtgggaaaacctgccggtcatcagctatctgctgctgcgcggtaaatgctcacaatgcaaagccccgatcagcaaacgctacccattggtagagctgacctgcgcagtgttgtcggcctacatcgcctggcatttcggcttcggctggcaggcagcggcgatgctggtgttgagctggggcctgctggcgatgagtctgatcgacgccgatcaccagctgttacctgactctctggtgctgccactgctgtggctgggcctgatcgtaaacgctttcgggctgttcacctcgctgaacgatgcgctgtggggcgcggtggccggctatctggcgctgtggtcggtgttctggctattcaaactggtgaccggcaaggaaggcatgggttatggcgacttcaagttgctggccatgcttggcgcatggggcggctggcagattctgccgttgaccatcctgctgtcatcgctggtgggtgcggtgcttggggtgatcatgatgcgcgtgcgcagggttgaaagtggtacgccgatcccctttggtccttatctggccattgcggggtggatcgctttgctctggggtggtcaaataaccgactcttacatgcagtttgccggtttcagatga

SEQ ID NO: 106491 - protein, 290 aa, Pseudomonas syringae pv. phaseolicola 1448A
MPLLDLLASSPLAFVITCCILGLIIGSFLNVVVYRLPKMMERDWKAQSREMLGLPAEPDQPAFNLNRPRSSCPRCAHKIRPWENLPVISYLLLRGKCSQCKAPISKRYPLVELTCAVLSAYIAWHFGFGWQAAAMLVLSWGLLAMSLIDADHQLLPDSLVLPLLWLGLIVNAFGLFTSLNDALWGAVAGYLALWSVFWLFKLVTGKEGMGYGDFKLLAMLGAWGGWQILPLTILLSSLVGAVLGVIMMRVRRVESGTPIPFGPYLAIAGWIALLWGGQITDSYMQFAGFR

SEQ ID NO: 106492 - DNA, 855 bp, Dechloromonas aromatica RCB
  CDS (1)..(855): transl_table=11
atgcttcctgaaacgcagggcggcctggctgccatagctgggctacttggtttgtgcgtcggtagtttcctcaacgtcgtgatccaccgactacccaagatgatggagcgggagtggctcggacaatgcgcggaattgcggggcgaaaccgcacctgcctcccttgaagcattgtcgttggcaaaaccacgctcccgctgccctgactgtggccaccaaataacagcactggaaaacattccgctgctaagttatctatttatcctgaagggaaaatgctccgggtgcggatgccggatatctccgcgttacccgatcgtcgaggcgattaccggactactgtctgcttacgttgcctggcactttggcccgactacgcagacaatcggcgctctgctgctgctctgggcgctgatctcactttctgccattgacctggacacccagctccttcctgactcaatcaccctgcctttgctctggctgggactactcttcaacctctggaacacttataccgacctcccgtcggccgtcatcggcgccgtcgccggctacctaaccctttggagcgtcttttggctattcaagctagccacgggcaaggaaggcatgggctatggcgacttcaagctccttgctgcactgggggcatggctaggctggcaaatgttgccggcgatcatcctgctctcgtctgttgttggtgccgttgtcggtgtcacgctgatcgttgtcgcccgtcacggccgcaacattcctattcctttcggcccttatctggcggcagccggaggaattgcccttttctggggcgcgcagatcacgaacacttaccttggcatgatcgcttga

SEQ ID NO: 106493 - protein, 284 aa, Dechloromonas aromatica RCB
MLPETQGGLAAIAGLLGLCVGSFLNVVIHRLPKMMEREWLGQCAELRGETAPASLEALSLAKPRSRCPDCGHQITALENIPLLSYLFILKGKCSGCGCRISPRYPIVEAITGLLSAYVAWHFGPTTQTIGALLLLWALISLSAIDLDTQLLPDSITLPLLWLGLLFNLWNTYTDLPSAVIGAVAGYLTLWSVFWLFKLATGKEGMGYGDFKLLAALGAWLGWQMLPAIILLSSVVGAVVGVTLIVVARHGRNIPIPFGPYLAAAGGIALFWGAQITNTYLGMIA

SEQ ID NO: 106494 - DNA, 573 bp, Ralstonia eutropha JMP134
  CDS (1)..(573): transl_table=11
atgaatctgctgccgcccaaattaccagcaccacgcgccatgtcatccgccaccttcgccaccttcattggccccatcaccatcgctatcgtgtcaactgcggcggccatcgacctggaccgacgtcgcattccgaactggctgaccctcggatcctggattgcagccctgccaatgcaggtcgccatccatggaatcgccgcgggatcgctggcgtggctttacgggtggatagcgggcctgattatcttcctgcccttttacctgctgcgaggcatggctgccggcgacgtcaagctgatggcagccgtcggcgcgtggctcggcgcaagcatggtgccgtcgatcgcggttgctacctggttgatcggtggcgcgtgggctctggcaatgcttctcgtcaccggacaaaccggcgcgacgttgtcgagagtcggcaacatgttgctgagcgcggccattcatcgtggccacgggctggctaaatccgggagcaagtcatccgctggctccataccctatggtgtcgccatcgccggcggcaccctggccatgctctttttcggtacgtga

SEQ ID NO: 106495 - protein, 190 aa, Ralstonia eutropha JMP134
MNLLPPKLPAPRAMSSATFATFIGPITIAIVSTAAAIDLDRRRIPNWLTLGSWIAALPMQVAIHGIAAGSLAWLYGWIAGLIIFLPFYLLRGMAAGDVKLMAAVGAWLGASMVPSIAVATWLIGGAWALAMLLVTGQTGATLSRVGNMLLSAAIHRGHGLAKSGSKSSAGSIPYGVAIAGGTLAMLFFGT

SEQ ID NO: 106496 - DNA, 888 bp, Ralstonia eutropha JMP134
  CDS (1)..(888): transl_table=11
atgaatccggcattccccgccggcggcgcctttgcgctgccggcgctggcggcactgccgccgtcgttcctggtggcggcagccgccgtgctcggcctgctggtcggcagcttcctgaacgtggtgatccaccggctgccgcgcatgatggaacacgacgaggccaactacatcgccgaagtgcgcagcgacccgctgccctaccccgaccgctacaacctgatggtgccgcgctcggcctgcccccactgcggccatgcgatcgcggcctgggagaatattccggttatcagctacctgttcctgcgcggacgctgctcgtcatgcaaggcaccgatcggcatgcgctatccgctagtggagctggcgaccggcgtgctcagcgcgctggccgcttggcacttcggcgcgacctggcagggcgtggccgcgctggtgctgctgtgggcgctgatggcactgacgatgatcgacgccgatacgcagttgctgcccgaccagatcacgctgccgctggtgtggctgggcctgctgctgaacctggccgggctgttcgtgccgatcgccgatgccgtgatcggcgccgtggccggctacctgctgctgtggagcgcctactggctgttcaagctcgtgcgcggcaaggaaggcatgggctacggcgatttcaagctgatggccgcgctgggcgcctggttcggctggcaggccttgccgtcgctggtgctgctgtcgtcggtggtcggcgtggtgttcggcgtcgccaatatcgcgctgcgccgccagggacgggacacgccgttcccgttcggcccattcattgcgggcgccggcgggctggtgctgttcttcggcccgggtgtgctgccgctgctattcatgccgtaa

SEQ ID NO: 106497 - protein, 295 aa, Ralstonia eutropha JMP134
MNPAFPAGGAFALPALAALPPSFLVAAAAVLGLLVGSFLNVVIHRLPRMMEHDEANYIAEVRSDPLPYPDRYNLMVPRSACPHCGHAIAAWENIPVISYLFLRGRCSSCKAPIGMRYPLVELATGVLSALAAWHFGATWQGVAALVLLWALMALTMIDADTQLLPDQITLPLVWLGLLLNLAGLFVPIADAVIGAVAGYLLLWSAYWLFKLVRGKEGMGYGDFKLMAALGAWFGWQALPSLVLLSSVVGVVFGVANIALRRQGRDTPFPFGPFIAGAGGLVLFFGPGVLPLLFMP

SEQ ID NO: 106498 - DNA, 768 bp, Dehalococcoides sp. CBDB1
  CDS (1)..(768): transl_table=11
atgcttatcagttggattattttctttttcatcttgggggctatactgggcagttttataaacatgctgtctgaccgcctgccggctaaaaaatccattattacccccggctccgggtgtgatgtctgcggcaaaaggctgggcattgctgacctgatacccattttcagttatatttttctaaaggggcgttgccgttactgcggggcgggcatacctcaaagagctttgtgggtagagatagccacagcctgcctgtttggcctgttctgggtgatgctggggccaagtgtggaactgggtataagccttttatacctttgcgtatttatcaccctttttgtaatagatctggaaaaagggcttattttaaacgtaattatttatccctttatggtgctggcactgctgctttcgcccctctaccttcagggagacggtctgctggcaaacctgtcatcttcgttttttggcgggctgaccggtttcgggctgtttctgctgatatatattgcctcacgcgggggcatgggggagggggatataaaaatggccggctttatcgggctggtctgcggtttcccgaatatttttgtggccatttttgcaggcatagtgctaggcgggctggcagcagccgggctgatgctttcaggcaaacgccgcaagggtcagactatccccttcggaccttttttggctgtgggggcggtaactgccatgctgtttggcagccagattatggagtggtatctggctctggcctaa

SEQ ID NO: 106499 - protein, 255 aa, Dehalococcoides sp. CBDB1
MLISWIIFFFILGAILGSFINMLSDRLPAKKSIITPGSGCDVCGKRLGIADLIPIFSYIFLKGRCRYCGAGIPQRALWVEIATACLFGLFWVMLGPSVELGISLLYLCVFITLFVIDLEKGLILNVIIYPFMVLALLLSPLYLQGDGLLANLSSSFFGGLTGFGLFLLIYIASRGGMGEGDIKMAGFIGLVCGFPNIFVAIFAGIVLGGLAAAGLMLSGKRRKGQTIPFGPFLAVGAVTAMLFGSQIMEWYLALA

SEQ ID NO: 106500 - DNA, 852 bp, Thiobacillus denitrificans ATCC 25259
  CDS (1)..(852): transl_table=11
atgacgctattcgtcgccgaaccggccctcttcacagggctggttttcctgctcggcctgctcgtcggcagctttctcaacgtcgtcgtccaccgcctgccgaaaatgatggacgccgaatggcaggcgcagtgcgcggagctgcgcggcgagccgtcgccggcggggccgcgtttcaacctgtgggcgccgcgctcggcgtgcccggcctgcggccacgcgatcacggcgctcgagaacgtaccgctgctttcgtggctatggcttcgcggacggtgcgcgtcttgcaggacgccgatcagcgcgcgctatccgctggtcgaactgctcgcggcgctgctctccgcggcggtggcctggaagtgggggccgacggtccaggccgccggtgcattgctgctcgtctggatgctcatcgcgctcgccttcatcgatcttgacacgacgttgttgccggacagcctgacgcttccactgctctgggccggcttgctgatcaatctcggcggacatttcgcttcccttcctgacgcggtcgccggcgcggccgcgggctacctcgtgctatggtcggtctactggatgttcaagctggtgacgggcaaggaggggatgggctatggtgatttcaagctgctggcggcgatcggggcgtggctcggctggcagttgctgcccgtcacgcttctgctcgcgtcggtcgtcggggcggtggtcggcatcacgatgatcgtcgccgtcaagcacgaccgccgtgtgccgatcccgttcggcccctacctcgcgggcgggggactcgttgccctgttcttcggtgcggacctgacgcaggcctatctcgcgcagttctga

SEQ ID NO: 106501 - protein, 283 aa, Thiobacillus denitrificans ATCC 25259
MTLFVAEPALFTGLVFLLGLLVGSFLNVVVHRLPKMMDAEWQAQCAELRGEPSPAGPRFNLWAPRSACPACGHAITALENVPLLSWLWLRGRCASCRTPISARYPLVELLAALLSAAVAWKWGPTVQAAGALLLVWMLIALAFIDLDTTLLPDSLTLPLLWAGLLINLGGHFASLPDAVAGAAAGYLVLWSVYWMFKLVTGKEGMGYGDFKLLAAIGAWLGWQLLPVTLLLASVVGAVVGITMIVAVKHDRRVPIPFGPYLAGGGLVALFFGADLTQAYLAQF

SEQ ID NO: 106502 - DNA, 891 bp, Nostoc punctiforme PCC 73102
  CDS (1)..(891)
atggacattttgttcgctattccagcgagtgtaatggtctttgctttgggtgcatctattggcagttttctcaatgttattgtttatcggctacctgctgggttgtcaatcctttggccgccttctcgttgtcctaaatgcttaaaccagctaaaagcttacgacaatgtaccagtattcggctggatttcattaagagggcggtgtcgatattgcaaaagcaaaatttctgtccgttatcctgtggtagaaggggtgacgggcataatttttttgctgatttttttagtatttcaagtttcgattttaacaataggctattgggctttttgtagttggttattagcactatcgctgattgacctggatacaatgaccttacctaatccacttactcagtcgggtttagtggcaggaattttattccaaatggtggttggttatctatcagaaggaagttctgtcgcattggtaaatcaccttatgatagccatactaggtgcagtcttgggcttatggctatttgatgcgatcgccctattgggttcaattgcctttgggaaaactgcaatgggcgcaggtgatgctaagttagcagccatgatgggagcctggttaggctggaaatatttgcttttagctacttttattgcctgtgcgctgggagccttaattggcagtgctattattatgcataaacggatactcctaggtcgaagcaagctacgcacagcgtctggtagagaagccactaatgaacagacatcgacacacaggttaggacaaaaaatgccttttggcccttttctcgctttaggatctctgattaccctgtttagcggcgaagcaattttgtctatctatctgcggttattttttccagcgtcttga

SEQ ID NO: 106503 - protein, 296 aa, Nostoc punctiforme PCC 73102
MDILFAIPASVMVFALGASIGSFLNVIVYRLPAGLSILWPPSRCPKCLNQLKAYDNVPVFGWISLRGRCRYCKSKISVRYPVVEGVTGIIFLLIFLVFQVSILTIGYWAFCSWLLALSLIDLDTMTLPNPLTQSGLVAGILFQMVVGYLSEGSSVALVNHLMIAILGAVLGLWLFDAIALLGSIAFGKTAMGAGDAKLAAMMGAWLGWKYLLLATFIACALGALIGSAIIMHKRILLGRSKLRTASGREATNEQTSTHRLGQKMPFGPFLALGSLITLFSGEAILSIYLRLFFPAS

SEQ ID NO: 106504 - DNA, 708 bp, Haemophilus somnus 129PT
  CDS (1)..(708)
atgatttatctagcttatatgttgtttggtggactttgtgggttatgggtttacctttatgtcaggcaattttctgctcagattaataaacaagtttactcgactttttgcgaaattttccccgaaaatgcaccgcacttgatgcctatgtctatcttacgacggaaaaagtgcggtcatttttctatgtattttttgtgtggtggcctttggtgtaatatatgtttaaatttcccacaaaatatttatgttggtttatggttagcatgttgcggttatttaattttttgccttgttttagtggattggctataccaactcgtttcacaaaccttatgccaagccctatttattttagggttattgggtgcttatcaaggtattagcccattgactttggagcagtctttaattggtagcttatcaggcttttcggttttttatcttatttacattgttgcaaaattattctatcgttatgaagctttaggacgtggtgattactggttaatgttagggttagggagctttatatcttggacaaaattaccgttgctcatttttcttgcctgcctcacaggattaatatatgtcgtttttaatgcaagagacaaaaaaacaatatttattccttttgccccgttcttatgtctctcaaccattatcgtatacttgcttaattttctaagggaggatattcttccttaa

SEQ ID NO: 106505 - protein, 235 aa, Haemophilus somnus 129PT
MIYLAYMLFGGLCGLWVYLYVRQFSAQINKQVYSTFCEIFPENAPHLMPMSILRRKKCGHFSMYFLCGGLWCNICLNFPQNIYVGLWLACCGYLIFCLVLVDWLYQLVSQTLCQALFILGLLGAYQGISPLTLEQSLIGSLSGFSVFYLIYIVAKLFYRYEALGRGDYWLMLGLGSFISWTKLPLLIFLACLTGLIYVVFNARDKKTIFIPFAPFLCLSTIIVYLLNFLREDILP

SEQ ID NO: 106506 - DNA, 873 bp, Pseudomonas aeruginosa UCBPP-PA14
  CDS (1)..(873)
atggaactcctcgactacctggccagccatccgctggcctttgtcttgtgcgccatcctccttggcctgctggtcggcagcttcctcaacgtcgtcgtgcatcgcctgccgaagatgatggagcgcaactggaaggccgaggcccgcgaagcgctcgggctggagccggaacccaagcaggcgacctacaacctggtgctgccgaattcggcgtgcccgcgctgcggccacgagatccgcccctgggaaaacatcccgctggtcagctacctggcgctgggcggcaaatgctcgtcctgcaaggccgccatcggcaaacgctaccccctggtggaactggccaccgcgctgctttctggctacgtcgcctggcatttcggcttcacctggcaggcgggcgcgatgctcctgctgacctggggtctgctggcgatgagcctgatcgatgccgatcaccaactgctgccggacgtgctggtgctgccgctgctctggctgggcctgatcgccaaccatttcggcctcttcgccagcctcggcgatgcgctgttcggcgcggtgttcggctacctgagcctgtggtcggtgttctggctgttcaagctggtgaccggcaaggagggcatgggctacggcgacttcaagctgctggccatgctcggtgcctggggcggctggcagatcctgccgctgaccatcctgctgtcgtcgctggtcggggcgatcctcggggtgatcatgctgcgcctgcgcaacgccgaaagcggcacgccgatccccttcggtccctatctggcgattgccgggtggattgctttgctctggggtgatcaaataacccggacctatctgcaattcgccggattcaaatga

SEQ ID NO: 106507 - protein, 290 aa, Pseudomonas aeruginosa UCBPP-PA14
MELLDYLASHPLAFVLCAILLGLLVGSFLNVVVHRLPKMMERNWKAEAREALGLEPEPKQATYNLVLPNSACPRCGHEIRPWENIPLVSYLALGGKCSSCKAAIGKRYPLVELATALLSGYVAWHFGFTWQAGAMLLLTWGLLAMSLIDADHQLLPDVLVLPLLWLGLIANHFGLFASLGDALFGAVFGYLSLWSVFWLFKLVTGKEGMGYGDFKLLAMLGAWGGWQILPLTILLSSLVGAILGVIMLRLRNAESGTPIPFGPYLAIAGWIALLWGDQITRTYLQFAGFK

SEQ ID NO: 106508 - DNA, 810 bp, Anabaena variabilis ATCC 29413
  CDS (1)..(810)
atggaaactttgatagtaaccctggcgagtgtgttcgttttcgccttgggtgcatctattggcagctttattaatgttgtagtttatcgattaccggcaggattatccatcctgtggccgccctcccgttgtcctcattgcctaaaccaactgaaagcctatgataatgtgcctgtgctgggctggatatggttaaaagggcgttgtcgttattgtaaaagtcaaatttctctgagataccctgtagtggaagcagtgacagggatcatttttctttgcgtatttttgatatttcacgtttcaattctgaccttaggatactggacgttttgcagctggctattagcattgtccttaattgatttagatactatgaccctacctaatcccctcaccaaatcaggattagtcttgggtttggtctttcaaatggttgttggctatgcctctgaccctagtttgccaggattaattagacacttaatgatgggcattgttggcgctgtcttgggtttatggttatttgaggcgatcgctcttttaggagttttcttacaaaaagaggcgatgggtgcaggagatgccaagcttgctgccatgatgggtgcttggttgggttggcgatatttacttctggctggattgattgcctgtactttaggcacattggtaggtattggggctatcatgctctcgaaacgcaaatgggggcaaaaaattccctttggccctttcctcgcctcaggagcttttatcactctctttggtggacaaccaattttgtcagcttatttacagttgtttttttaa

SEQ ID NO: 106509 - protein, 269 aa, Anabaena variabilis ATCC 29413
METLIVTLASVFVFALGASIGSFINVVVYRLPAGLSILWPPSRCPHCLNQLKAYDNVPVLGWIWLKGRCRYCKSQISLRYPVVEAVTGIIFLCVFLIFHVSILTLGYWTFCSWLLALSLIDLDTMTLPNPLTKSGLVLGLVFQMVVGYASDPSLPGLIRHLMMGIVGAVLGLWLFEAIALLGVFLQKEAMGAGDAKLAAMMGAWLGWRYLLLAGLIACTLGTLVGIGAIMLSKRKWGQKIPFGPFLASGAFITLFGGQPILSAYLQLFF

SEQ ID NO: 106510 - DNA, 912 bp, Burkholderia cepacia R18194
  CDS (1)..(912)
atgacgccagcgcccctgtccgccgttcccgattcgcccgagagcacgctgctcgcgctggcgatgctgccgcccgcgctgcagtatgcgttcgcggtcgtcatcggcctttgcatcggcagcttcctgaatgtggtcgtgcaccggctgcccgtgatgatgcagcgcgcgtggcaggccgagatcgacgaagcgaccggcaacgcgagcgccccgcccgacgacggctacccgccgcgctacgatctgtggcgcccgcgcagcgcctgcccgcattgcggccacgtgctgcgcgcatgggaaaacatcccgctcgtcagctacctgatgctgcgcgggcgctgccggcgctgcggccacgcgatcggcatccgctatccgctcgtcgaactcgcgtgcgcgctgctcgccgccggctcgctcgcggcatttggcccgaccgtcgccgcgcttgccgcgttcgcgctgtgcgccgcgctactcgcgatgagcgcgatcgatatccggaccggctacctgcccgactcgatgacgctgccgctcctctgggccgggctcgtgttgaacctcggtggcacgttcacatcgctgcgctcggccgtgatcggggccatggccggctacctgttcctgtggtcgatctactggctgttcaaatggctgcgcggcatcgagggcattggtttcggcgacctgaagctgctcgccgcgctcggcgcatggatgggctgggccgcattgccgcaagtggtgctgttcgccgcggtgacgggtgcgatcgtcgggctcattgcgacctggcgcggccgcatgcgcttcgaggagccgattccgttcggcccgttcctcgcggcaggcggcgtcgcgacgctgtttttcggcacccctttctattcggcgctcggaggctga

SEQ ID NO: 106511 - protein, 303 aa, Burkholderia cepacia R18194
MTPAPLSAVPDSPESTLLALAMLPPALQYAFAVVIGLCIGSFLNVVVHRLPVMMQRAWQAEIDEATGNASAPPDDGYPPRYDLWRPRSACPHCGHVLRAWENIPLVSYLMLRGRCRRCGHAIGIRYPLVELACALLAAGSLAAFGPTVAALAAFALCAALLAMSAIDIRTGYLPDSMTLPLLWAGLVLNLGGTFTSLRSAVIGAMAGYLFLWSIYWLFKWLRGIEGIGFGDLKLLAALGAWMGWAALPQVVLFAAVTGAIVGLIATWRGRMRFEEPIPFGPFLAAGGVATLFFGTPFYSALGG

SEQ ID NO: 106512 - DNA, 723 bp, Bacillus cereus G9241
  CDS (1)..(723): transl_table=11
atgttcacttatgtatatgcattgttagcggggatggtgtttggttctttttttatggtaattgcgatgagagttccgctaggtgagtctatcataaccccgcgttcatattgtcattattgtaagtatgtgctaaagccaaaagaattgattccaatcatttctttttgtatacaaagaggacgttgtacgaattgtaagaggaaaatttcaattttgtacgtagtatttgaacttataactggaatgatatgccttcttactgtatatatgattggattggaacgagagcttattatcgttttatcacttttttcgttacttcttattatttcagttacagattacatatatatgttaatcccaaatcgtattttagcttggtttgcctgtttactcattttagaatgtgcttttgtaccgttagtcacttggacagatagtatagttgggagttgcgttatattcattttgttatactgcatgcaaaagatatatccagaaggacttggcggaggagatgtaaaattactttcgttacttggatttattatgggactgaaagggatttttatgattatatttttagcatctttctttagtctttgtttctttggagctggtctcgtattaaaacgtatgaaaatgaggactcaaataccgtttggcccttttattagcctcggggcaatatgttacatgttggtcacgtatgcaaaatag

SEQ ID NO: 106513 - protein, 240 aa, Bacillus cereus G9241
MFTYVYALLAGMVFGSFFMVIAMRVPLGESIITPRSYCHYCKYVLKPKELIPIISFCIQRGRCTNCKRKISILYVVFELITGMICLLTVYMIGLERELIIVLSLFSLLLIISVTDYIYMLIPNRILAWFACLLILECAFVPLVTWTDSIVGSCVIFILLYCMQKIYPEGLGGGDVKLLSLLGFIMGLKGIFMIIFLASFFSLCFFGAGLVLKRMKMRTQIPFGPFISLGAICYMLVTYAK

SEQ ID NO: 106514 - DNA, 927 bp, Rubrivivax gelatinosus PM1
  CDS (1)..(927)
ttgttccacctgatcgacagccgctggctgctttcgccctgggcgctcggcgcagccggcctgctggtcggcatggccctttccgtgatggcgcgcctgctgccgcgcgtgctcgaaatgcggtggcttggcgaggcggcagtgcaactctccgaccccgacgcgctgcgcgcgcatgcaggccttgaccccgcggccgcagctcggttgtcgcagtccgccgacggggtgcgccaggccatcgagagccaggacatcagcgtcagcgcttcgtgtgcgacgtgcggccaccgcttcagctggctcgagcgcgctcctgtggtcggctggcttctgcatcgcggacgctgcggccggtgcgccgcatcccgcccggttcgcggcccgatcctggaggccgccaccggcatgctgttcgcggcgcttgcgtggcgccttggcgcgcagccggcgacccttctgtggtgcgcattcgcggcggcgctcgtcgtgctcgcggcgatcgacttggaaacccagctcctgccggatgcgatcacgctgcccttgctctgggccgggcttgcggcctccgcgctcggcgccaccatcccgcctgccgacgccttgctcggcgcggtcgcgggctacctttcgctctggtccgtctactgggcgttccgccttgccaccggccaggagggcatcggctacggcgacttcaagctgcttgccgcgctgggcgtctggctaggctggcagatgatcctgccgatcatcgtgatcgccgcgctcttcggggcgctcgccgcgctcgcgatcaggctggccggccgcagcgttggtggattgcgcattccattcggccccttcctcgtcgcaggcgcgttgctcgtcctcttcgccgggcccggccagatcatcatcgcggtggtcggccgggcctga

SEQ ID NO: 106515 - protein, 308 aa, Rubrivivax gelatinosus PM1
MFHLIDSRWLLSPWALGAAGLLVGMALSVMARLLPRVLEMRWLGEAAVQLSDPDALRAHAGLDPAAAARLSQSADGVRQAIESQDISVSASCATCGHRFSWLERAPVVGWLLHRGRCGRCAASRPVRGPILEAATGMLFAALAWRLGAQPATLLWCAFAAALVVLAAIDLETQLLPDAITLPLLWAGLAASALGATIPPADALLGAVAGYLSLWSVYWAFRLATGQEGIGYGDFKLLAALGVWLGWQMILPIIVIAALFGALAALAIRLAGRSVGGLRIPFGPFLVAGALLVLFAGPGQIIIAVVGRA

SEQ ID NO: 106516 - DNA, 852 bp, Rubrivivax gelatinosus PM1
  CDS (1)..(852)
atgtcgtccgacctgcagggcgtgctgctgtcgccctgggctctggggctgctcgggctgtgcatcggcagctttctcaacgtcgtcatccaccgcctgccacagatgatggagcgggcctggcgactcgaaagcgccgagctgctcggggtcacggccccagaatctcccgcgctcacgctggcgaaacccgcctcgcgctgcccgcaatgcggtcatcgcatccgctggttcgagaatgtcccggtgctgagctggctgctgttgcgcggacgctgctcagcctgcaagacgccgatctctccgcgctatcctctcttcgagatcgcgacagggctgttgttcgcctcgctggcctggcgtttcggcgcgcaaccgacggtgctggcctggtgcgccttcgtcgccgtcctgctggcactgtccggcatcgactgggacacgacgctcctgcccgacagcctcaccttgccactgctctgggccgggctggtggctgccgcgctcggctggacgctgccgctctcgacgtccgtctggggcgcggtgttcggttatttgtcgctgtggtcggtgtactggctgttcaagctcacgactggcaaggaaggcatgggcgcgggcgacttcaagctgctggccgccctcggtgcctggctcggatggcagatgctgcttcccatcgtgctcggagcttcgttgatcggtgccatcgtcggcatcgccatgaagctggctggcgctctgcacgaaggtcgctacgtgcccttcggccccttcctggccggtgccggactggtcgtcctgtacgcaggcgccgagcgcgtgatgggctggctcggctgggcctga

SEQ ID NO: 106517 - protein, 283 aa, Rubrivivax gelatinosus PM1
MSSDLQGVLLSPWALGLLGLCIGSFLNVVIHRLPQMMERAWRLESAELLGVTAPESPALTLAKPASRCPQCGHRIRWFENVPVLSWLLLRGRCSACKTPISPRYPLFEIATGLLFASLAWRFGAQPTVLAWCAFVAVLLALSGIDWDTTLLPDSLTLPLLWAGLVAAALGWTLPLSTSVWGAVFGYLSLWSVYWLFKLTTGKEGMGAGDFKLLAALGAWLGWQMLLPIVLGASLIGAIVGIAMKLAGALHEGRYVPFGPFLAGAGLVVLYAGAERVMGWLGWA

SEQ ID NO: 106518 - DNA, 873 bp, Pseudomonas fluorescens PfO-1
  CDS (1)..(873)
atgcctatcgacgaactcttcagcctgtatccgctggcctttgtcttcaccgccctgctgctggggctggtggtcggcagtttcctcaacgtgttgatctggcgcctgccgaaaatgctcgagcgtgaatggcgccagcaggctcacgatgttttggggctgcccggtgaagcaccgttacccacttacaacctgatgctgccgcactcccaatgcccgcactgtggccaccggatccgggcctgggaaaacattcccgtgttgagttacgtgtttctgcgcgggcgctgttcaagttgcagcgcaccgatcagcaagcgttacccgctgaccgaactggcctgcggcctgctctcggcgttcatcgcctggcacctgggtttcggctggccggcgtgcctgctgatcgtgctgacctggggcctgttggccatgagcctgatcgacaccgaacatcaattgttgcccgacgtgctggtgctgccgctgctgtggctggggctgatcgtcaacagcttcgagctgttcgtgccgctgcacgatgccctgtggggcgcggtgcttgggtacatggcgctgtggtcggtgttctggctgttcaaactgatcaccggcaaggacggcatcggtcacggcgatttcaagctgctggcgctgctcggggcctggggcggctggcagattctgccgctgaccatcctgctgtcttcgctggtgggcgccgtgctcggggtgattttgctcaagctgcgcgaccagaaaacctcgacgccgattcccttcggcccgtatctggcaattgccggctggattgccttgctctggggtggtcaaataaccggcttctattggcagtttgtcggtttgaaatga

SEQ ID NO: 106519 - protein, 290 aa, Pseudomonas fluorescens PfO-1
MPIDELFSLYPLAFVFTALLLGLVVGSFLNVLIWRLPKMLEREWRQQAHDVLGLPGEAPLPTYNLMLPHSQCPHCGHRIRAWENIPVLSYVFLRGRCSSCSAPISKRYPLTELACGLLSAFIAWHLGFGWPACLLIVLTWGLLAMSLIDTEHQLLPDVLVLPLLWLGLIVNSFELFVPLHDALWGAVLGYMALWSVFWLFKLITGKDGIGHGDFKLLALLGAWGGWQILPLTILLSSLVGAVLGVILLKLRDQKTSTPIPFGPYLAIAGWIALLWGGQITGFYWQFVGLK

SEQ ID NO: 106520 - DNA, 957 bp, Burkholderia fungorum LB400
  CDS (1)..(957)
atgcgggcaacaacttttctcgtgccagacacttcttccagcctgctgtcgggcttactgcccggccgcatcgatcacttcgcaaccgggctcggtttcgcgttcggcagcttgcccaccggtctgcagatgacgttcgccgtcgtgttcggcctcgtgatcggcagcttcctgaacgtggtcgtgcatcggctgccgatcatgctcgaacgtgcatggcaagcggaattcaacgaggccgccggtgaaccgccgcaaccggaacaagatggcctgccggcgcgctacaacctgtgggtgccgcgcagcgcgtgtccccattgcggccacgtgttgagcgcgtgggagaatctgccggtgctcagttatgtgttgttgcgcgggcgttgttccgcatgcaaggctcatgtgagcctgcgttatccgctgctcgaaatcgccagtgccgcgctcgcggccggctcgcttgcgctgttcggcccgactctcacggcgctcgccgccttcggactgtgcgccgcgttgctcgcaatgagcgcgatcgacatcgacacccacctgctgcccgactcgctgacattgccgttgctgtgggcgggcatcatcgtcaacttcaacggcatgtttgcgaatctgcacgacgcggtgctcggggcgatcttcggctatctggtgctgtgggtcgtgcattggctgtttcgcctcgtacgcggcgtcgaaggcatgggttacggcgatttcaaactgctcgcggcgctcggcgcgtggctcggctgggcagcgctgccgcagatcgtgctgatcgcggcggtggcgggcgctgtcatcggcctgctggcaacatggcgcggccgcatgcgtttcgaagagccattgccgttcgggccgtttctcgcggcaggcggcgcactcacactgtttctcggcacaccgctttatctggctctggggggctga

SEQ ID NO: 106521 - protein, 318 aa, Burkholderia fungorum LB400
MRATTFLVPDTSSSLLSGLLPGRIDHFATGLGFAFGSLPTGLQMTFAVVFGLVIGSFLNVVVHRLPIMLERAWQAEFNEAAGEPPQPEQDGLPARYNLWVPRSACPHCGHVLSAWENLPVLSYVLLRGRCSACKAHVSLRYPLLEIASAALAAGSLALFGPTLTALAAFGLCAALLAMSAIDIDTHLLPDSLTLPLLWAGIIVNFNGMFANLHDAVLGAIFGYLVLWVVHWLFRLVRGVEGMGYGDFKLLAALGAWLGWAALPQIVLIAAVAGAVIGLLATWRGRMRFEEPLPFGPFLAAGGALTLFLGTPLYLALGG

SEQ ID NO: 106522 - DNA, 789 bp, Novosphingobium aromaticivorans DSM 12444
  CDS (1)..(789)
atgcttggtgcggcttatctatccgctttcccgctcggacttctcgtctccggggcggcagttctcggcgcggtgatcggcagtttcctgggcgcgtcgctggtgcgccttcccgaagggcgctcggtcgtgagcgggcgttcggcctgcgacgggtgcggcaaggcgttgacaatcgccgagctggttccggtgctgtcgtggctcgtgcagcggggcaaatgccgcgcctgcggcgtccggatcggcggatggcaactggcctgcgagctgggtgggggcgccgtcggcgtcggatcggtcctgctggcgagggaaggccttgtgctggccggaatgttgtttggctggcaactgctactgctcgcactgctcgatctcaggcacctgtggctgccgcgcgttcttgtcggattgctggcagggacggggcttgcagtcgtgttcgcccgcgcatggagcatccaggggatggacccggtgctggtttcgctgggaggaggagcgctgggttacctcatgctgtgggccatcgcacgtttctatctgaaggcgcgggggcgggaaggcatgggcgcgggcgaccctccgctgcttggcgccataggcatctgggtcgggccgctgggcgtggtggaggtcatgctgggggccagcattctcgggatcgcggtggctattgtcatgcttgtaagcaggcgtaacattgccgccgacacggccttgccgctgggaacctgccttgccgctacggcatggccgatcttcctgttgcagggcctcggatag

SEQ ID NO: 106523 - protein, 262 aa, Novosphingobium aromaticivorans DSM 12444
MLGAAYLSAFPLGLLVSGAAVLGAVIGSFLGASLVRLPEGRSVVSGRSACDGCGKALTIAELVPVLSWLVQRGKCRACGVRIGGWQLACELGGGAVGVGSVLLAREGLVLAGMLFGWQLLLLALLDLRHLWLPRVLVGLLAGTGLAVVFARAWSIQGMDPVLVSLGGGALGYLMLWAIARFYLKARGREGMGAGDPPLLGAIGIWVGPLGVVEVMLGASILGIAVAIVMLVSRRNIAADTALPLGTCLAATAWPIFLLQGLG

SEQ ID NO: 106524 - DNA, 777 bp, Microbulbifer degradans 2-40
  CDS (1)..(777)
atgaaaggctgggagcaggagtgcaaagagtttctggcttctaaaggcgaagccgagactccagcacaaaacgagcaagagtcagaacccttcaatattgcctttcctgcgtcacactgccctaactgcaaggctcctgttaaggcctggcaaaacattcccattattagttacttactgctaaaaggtaagtgcgctgcgtgtaatgtaaaaatatcgctgcgctaccctatagttgaattcgttacttcggtattaagtatttgggttgtttacagcttggggctaacggtagaagcaggcttggtactgctattaacatggagcctgctggttttaacgttaattgatgtagaccaccaactactgccagacaacattaccctaccgcttttgtggctggggctacttgcgaatactcaagggcattttaccgacctgcaaagtgcagtcattggtgctgttgcaggctacctagtgctttggagcgtgttctggttgtttaagcttgtaaccggcaaagagggcatgggctttggggatttcaagttactggcggcacttggcgcttggatgggctggcaagctctgccggtaatcattattttgtcgtctgcggtgggcgctattattggtattggcggcatacttattttcggcaaagataaaaacaagcctattcctttcggcccatatttagccatagcgggttggatagccttcttctggggcgacgccattaccggcgcttacctttcctacgccaccggccaataa

SEQ ID NO: 106525 - protein, 258 aa, Microbulbifer degradans 2-40
MKGWEQECKEFLASKGEAETPAQNEQESEPFNIAFPASHCPNCKAPVKAWQNIPIISYLLLKGKCAACNVKISLRYPIVEFVTSVLSIWVVYSLGLTVEAGLVLLLTWSLLVLTLIDVDHQLLPDNITLPLLWLGLLANTQGHFTDLQSAVIGAVAGYLVLWSVFWLFKLVTGKEGMGFGDFKLLAALGAWMGWQALPVIIILSSAVGAIIGIGGILIFGKDKNKPIPFGPYLAIAGWIAFFWGDAITGAYLSYATGQ

SEQ ID NO: 106526 - DNA, 693 bp, Haemophilus influenzae R2866
  CDS (1)..(693)
atgatttacttcgcaatgtttttattaggcggcatcttcgggatcgcattgtggttctacctatctggttttattacccgtttacagcaagagatttatgcgacttatattgaattattcccacaaaactttctgtcatttcagcctagcgtttcctctattcaacaaaaaaagtgcggtcatattttgaggtattttttaagtgttggggtaggatttatatttttacaaattgccttcaaagattctatttttactgtatggttcggactcacacttcttatcctttgggcaatcagttatcttgattggcactatcaacttatttctactacactctgtttatggctacttacaatcggtttatttggggcagacaataatttttcattgcttacgttatctgaaagcataaaaagtgcggcaagtttttttattgttttctacgcaatctattggattgcaaaattctattacggaaaagaagcctttgggcggggagattattggctagcaatggcattaggaagttttattcatttagaaaccttaccgcactttttgttattagcttcagttcttggaatatgtttttcgcttattcataaaaagaaaaaagaatttataccttttgccccttttatgaacttatcagcagtcatcatttatttcgtcaaatattactggtattaa

SEQ ID NO: 106527 - protein, 230 aa, Haemophilus influenzae R2866
MIYFAMFLLGGIFGIALWFYLSGFITRLQQEIYATYIELFPQNFLSFQPSVSSIQQKKCGHILRYFLSVGVGFIFLQIAFKDSIFTVWFGLTLLILWAISYLDWHYQLISTTLCLWLLTIGLFGADNNFSLLTLSESIKSAASFFIVFYAIYWIAKFYYGKEAFGRGDYWLAMALGSFIHLETLPHFLLLASVLGICFSLIHKKKKEFIPFAPFMNLSAVIIYFVKYYWY

SEQ ID NO: 106528 - DNA, 534 bp, Ralstonia eutropha JMP134
  CDS (1)..(534)
atgtcatccgccaccttcgccaccttcattggccccatcaccatcgctatcgtgtcaactgcggcggccatcgacctggaccgacgtcgcattccgaactggctgaccctcggatcctggattgcagccctgccaatgcaggtcgccatccatggaatcgccgcgggatcgctggcgtggctttacgggtggatagcgggcctgattatcttcctgcccttttacctgctgcgaggcatggctgccggcgacgtcaagctgatggcagccgtcggcgcgtggctcggcgcaagcatggtgccgtcgatcgcggttgctacctggttgatcggtggcgcgtgggctctggcaatgcttctcgtcaccggacaaaccggcgcgacgttgtcgagagtcggcaacatgttgctgagcgcggccattcatcgtggccacgggctggctaaatccgggagcaagtcatccgctggctccataccctatggtgtcgccatcgccggcggcaccctggccatgctctttttcggtacgtga

SEQ ID NO: 106529 - protein, 177 aa, Ralstonia eutropha JMP134
MSSATFATFIGPITIAIVSTAAAIDLDRRRIPNWLTLGSWIAALPMQVAIHGIAAGSLAWLYGWIAGLIIFLPFYLLRGMAAGDVKLMAAVGAWLGASMVPSIAVATWLIGGAWALAMLLVTGQTGATLSRVGNMLLSAAIHRGHGLAKSGSKSSAGSIPYGVAIAGGTLAMLFFGT

SEQ ID NO: 106530 - DNA, 1143 bp, Deinococcus geothermalis DSM 11300
  CDS (1)..(1143): transl_table=11
gtgagccttgacgttctgctcgtggtcttcgccggcgtgtttgggttgctggtggggtcgttttcgaacgtgctgatccatcgcctgccccggggggaaaacattgcttttccgcccagccactgcccgcagtgtaaccatcgcctcgcgccgcgcgatctggtgccggtgggctcgtggctgagcctggggggcagatgccggtactgccgggcgccgatccgagtgcgctatccggtggtcgaagggctgactggcttgggctacgcgctcatcgctgcgctgtttcccctcaccacattcggggcaggcaccctgggcctgatgctgctgttcacactgctgctggtggcgagtgtgatcgatctggacaccttcaccattcccgacgaattgacgctgccgggggtggccctggggttggccttcgcagggtggaacacccgcgcgggggccgtggcggcggggctccccaccctggccggcgctctgcagggcgcattgctgggcgcggggctgctggtgaccatcgatctgctgggctcctgggtgctgcggcgctttcgggagcggcagtatccagaacgacccatcggctaccagcagatcagtctcggcctgctggtgggggcgtggctggggccgtggtgggggctgggggcggccttgctgtcggctgctgtgaatgtggctgcccgccgggtggttcgtattcccgagttgctcaccctgggtggctttctcgtcagcgtggcgctcggcagcgcgggcttcggccccggcctgattctgatggtgcagggggcgctggccgcagcaggcgcagcggcgctgagcgcaggggtctactggtggctgcgccgcgaacccctggcggaagaagacgcgcccttcgacccttctgcgatgggttttggggatgtgaagctggccgccgtgatcggggccttcctgggctgggaacggctgctggtcgccgttgtggtggcggtgtttgcgggcgcgctgctcggcctcttacaggttgccctcagacgcgagaaccgggtgaagtttggaccatacttggcgctgggcgcggttgtggcattgttctggggcggggagatcgtggcaacctaccggggcatattgggcctctaa

SEQ ID NO: 106531 - protein, 380 aa, Deinococcus geothermalis DSM 11300
MSLDVLLVVFAGVFGLLVGSFSNVLIHRLPRGENIAFPPSHCPQCNHRLAPRDLVPVGSWLSLGGRCRYCRAPIRVRYPVVEGLTGLGYALIAALFPLTTFGAGTLGLMLLFTLLLVASVIDLDTFTIPDELTLPGVALGLAFAGWNTRAGAVAAGLPTLAGALQGALLGAGLLVTIDLLGSWVLRRFRERQYPERPIGYQQISLGLLVGAWLGPWWGLGAALLSAAVNVAARRVVRIPELLTLGGFLVSVALGSAGFGPGLILMVQGALAAAGAAALSAGVYWWLRREPLAEEDAPFDPSAMGFGDVKLAAVIGAFLGWERLLVAVVVAVFAGALLGLLQVALRRENRVKFGPYLALGAVVALFWGGEIVATYRGILGL

SEQ ID NO: 106532 - DNA, 900 bp, Anaeromyxobacter dehalogenans 2CP-C
  CDS (1)..(900): transl_table=11
atggacccggcgatgcccggcgtccccgcgggcctgatcgcggcctgggtggcgctggtcggcggcgtggtgggcagctttctcaacgtcgtgatcgcccgggtgccggccggcgagtcgatcgtctccccggggtcgcgctgcccgcgctgcaggacgcccatcgcctggtacgacaacgtgccggtggtgtcctggctcgtgctgcgcgcccgctgccgcagctgccgcgcgcccatctccgcccgctacccgctggtcgaggcgctcgtcgcgggcgtggcgctgctggcgtgggcgcgccacggcctcgccgtcgccgcgctgggcgagctggtgctcgtctcgctcctggtggcgcttgcgttcatcgatctcgacacctggctgcttccccacgcgctcacctggcccctcatcgccaccggcctcgccgccgccgctgccgggctcggaccggcgacgctccagggctcggcgatcggcgcggcggtcggtttcctcgccttcgcgctcgtctcggtcgtcggcgagaaggtgctgcacaaggaggcgctcgggttcggggacgtgtggctcctctcggggatcggcgcgtggctgggggtggcggcgttgctcccggtggtgctgctcgcctcggtgcaggggagcgtggtgggcctcgtgctgctcgcgctcgggaaggggcagcccggcccgcagccgccggccgaggcggctgcgccgccagccccgtcggtgcccggcgatccggccgtgctcgccgacgccgacgactgggtcccgccccggaacgcggtcccgttcggcccgttcctggccgccggtgccctggagtggctgtatctcgcggacctcatcgtgcgcggtgtcccgtcgctagagctgttccggtga

SEQ ID NO: 106533 - protein, 299 aa, Anaeromyxobacter dehalogenans 2CP-C
MDPAMPGVPAGLIAAWVALVGGVVGSFLNVVIARVPAGESIVSPGSRCPRCRTPIAWYDNVPVVSWLVLRARCRSCRAPISARYPLVEALVAGVALLAWARHGLAVAALGELVLVSLLVALAFIDLDTWLLPHALTWPLIATGLAAAAAGLGPATLQGSAIGAAVGFLAFALVSVVGEKVLHKEALGFGDVWLLSGIGAWLGVAALLPVVLLASVQGSVVGLVLLALGKGQPGPQPPAEAAAPPAPSVPGDPAVLADADDWVPPRNAVPFGPFLAAGALEWLYLADLIVRGVPSLELFR

SEQ ID NO: 106534 - DNA, 690 bp, Arthrobacter sp. FB24
  CDS (1)..(690): transl_table=11
ttgactgaactgccgattgctttgttggttaccgcctgcgcccttttgggcctggccgcagcacccgccgcccttgcagtcacgcggcggttgctgcccggcaccgagctggggcgcgtgcgctggcatgctgttgccggctctgtcgccacagcagcgctgtttggggcgatggcttggcgcttcggctcgacctgggtgctgccggccttcctatttctctgtgcagctggtcttgtgctctcgcggattgacctccaacacaaactattgcccaacaggattattgttcccatgctcggaatcggcctcctgctgctgcttttggacgccagcatgaaccagcgatggggaaatctgctcgtggcagcaatcggatgtgccgtaacgttcgtgatctacctacttttggcgctaatttctccccgcggaatggggatgggcgacgtaaagctctcagcaccacttggtttgtacttgggctacctctccgtggggcacttgatactgggtgttgctcttggctttgttgtgggcgctgtgaccagtgtgctccttgttacaggcggattcgcggggcggaagacctcagtgccgttcgggccgtcgatgttcgcgggctgcgtcctgacagtgctgtggggcaccgagatagggcgggttctcttaccgacggtcttcccccgctag

SEQ ID NO: 106535 - protein, 229 aa, Arthrobacter sp. FB24
MTELPIALLVTACALLGLAAAPAALAVTRRLLPGTELGRVRWHAVAGSVATAALFGAMAWRFGSTWVLPAFLFLCAAGLVLSRIDLQHKLLPNRIIVPMLGIGLLLLLLDASMNQRWGNLLVAAIGCAVTFVIYLLLALISPRGMGMGDVKLSAPLGLYLGYLSVGHLILGVALGFVVGAVTSVLLVTGGFAGRKTSVPFGPSMFAGCVLTVLWGTEIGRVLLPTVFPR

SEQ ID NO: 106536 - DNA, 870 bp, Azotobacter vinelandii AvOP
  CDS (1)..(870): transl_table=11
atgtccatcgtcgatcttctggccggccccggactggccttcgccgttttcgcggggctgctgggcctgctggtcggcagctttctcaacgtggtcgtccaccgcctgccgaagatgatgctgcacgactggcaggcacaggcgcgggaagtgctggaactgcccaacgagcctcccggcgagcctttcaatctgctgctgccccactcccattgcccacattgcgggcacgcgatcaggccctgggagaacatccccctgctcagctggctgctcctgggtggccgctgctcggcctgcaaggcccggatcggcgcgcgctaccccctggtggagctgacctgcgggctgctttcggcccatgtcgcctggcattacggcttcggctggcaagccggcgccatgttgttgctcggctgggctctgctggccatgagcctgatcgactacgatcatcaactgctgccggattcgctggtgctgccgctgctctggctgggcctgatcctcaacagcttcagtctgttcgtttccctggaggacgccctctggggcgcggtgaccggctacctcagcctgtggtcggtgtactggctgttcaagctgttcaccggcaaggaaggcatgggctacggcgacttcaagctgctggcgatgctcggcgcctggggtggctggcagatcctgccgctgaccgtactgctctcctcgctggtcggcgccatgctggggatcgtcatcctgcgcctgcgcaaggccgaaagcggcacgccgatccccttcggtccctttctcgccttcgccggctggatcgccctgctctggggcgagcagatcaccgccggctacctgcgcttcgccggtctgtaa

SEQ ID NO: 106537 - protein, 289 aa, Azotobacter vinelandii AvOP
MSIVDLLAGPGLAFAVFAGLLGLLVGSFLNVVVHRLPKMMLHDWQAQAREVLELPNEPPGEPFNLLLPHSHCPHCGHAIRPWENIPLLSWLLLGGRCSACKARIGARYPLVELTCGLLSAHVAWHYGFGWQAGAMLLLGWALLAMSLIDYDHQLLPDSLVLPLLWLGLILNSFSLFVSLEDALWGAVTGYLSLWSVYWLFKLFTGKEGMGYGDFKLLAMLGAWGGWQILPLTVLLSSLVGAMLGIVILRLRKAESGTPIPFGPFLAFAGWIALLWGEQITAGYLRFAGL

SEQ ID NO: 106538 - DNA, 744 bp, Burkholderia vietnamiensis G4
  CDS (1)..(744): transl_table=11
ttgcaggacggcggaggcttgatgctattgcagtcgaacttgctcgcggtattgctcgtcgccggggttgcgtgtggctggatgctcaatcgcgtggcggtggccgcaccacgtgcgcttgcccacgcatggcagattccagtcgagctgattttttgctcgagcggaccgcagtccgccgttcgacaacggatccgtgctctggccgtgcagctggttgccggtgtgctcgccgtgatgatcgcgtggcgtgtcggcctgtcggttcgggcgttatcagtggcgatgttctgcggctggatcacgctgcttgctctgatagatctcgatacccaattgctcccggacttactaacgttgccgtttatgggatgcggattcgcctgcgcgatcgccggcgtgtttgtgcccgtttcggccgcgctggtgggcgcggtaacaggctgggcaatattgatggcggcgcattgggcggctcgattgagagggcgcagtcaggacgcgattgggcagggtgacgcaaagctgctggctgcggtcggtgcgtggctcggatggaacgcagtggtcgacaccctgcttgtggcctgccttacctgtctgctagttgtgcctgtcgcgagatggatgaaagtcatgaaggctggctcggtattttcgtttggtccctacttggcggttggtgggatcgtctcgatccttgcgtggccatatggggtcgttgatttcggtttcaggccttga

SEQ ID NO: 106539 - protein, 247 aa, Burkholderia vietnamiensis G4
MQDGGGLMLLQSNLLAVLLVAGVACGWMLNRVAVAAPRALAHAWQIPVELIFCSSGPQSAVRQRIRALAVQLVAGVLAVMIAWRVGLSVRALSVAMFCGWITLLALIDLDTQLLPDLLTLPFMGCGFACAIAGVFVPVSAALVGAVTGWAILMAAHWAARLRGRSQDAIGQGDAKLLAAVGAWLGWNAVVDTLLVACLTCLLVVPVARWMKVMKAGSVFSFGPYLAVGGIVSILAWPYGVVDFGFRP

SEQ ID NO: 106540 - DNA, 912 bp, Burkholderia vietnamiensis G4
  CDS (1)..(912): transl_table=11
atgacgcgcgcgcccatgttccccgttcccgattcgcccgccggcacgttgctcgcgctggcgctgctgccgcccgcggtgcagtatgcgttcgccgtcgtgatcggtctgtgcgtcggcagcttcatcaacgtcgtcgcgcaccgggttccggtgatgatgcagcgcgcgtggcgcgccgaaatcgccgaagcgaccggcaacgcagacgcggcgcccgacgacggctatccgcagcgctacgatctgtggcgcccgcgcagcgcatgcccgcactgcggccacgtattgcgcgcatgggaaaatgtcccgctcctcagctacgtgatgttgcgcgggcgctgtcgtcagtgcggtcacgccatcggcatccgctatccgctcgtcgaactcgccggcgccctgctcgccgccggttcgctcgcagcgttcggcccgaccggcgcagcaatcgccgcgttcggcctatgcgccgcgctgctcgcgatgagcgcgatcgacatccggaccggctacctgcccgactcgatgacgctgccgctgctgtgggcaggcctcgcgttgaacctcgcgggcatgttcacgtcgctgcagtcggccgtgatcggcgcgatgtccggatacctgttcctgtggtcgatctactggctgttcagatggctgcgcggcatcgaaggcatcggcttcggcgatctgaagctgctcgccgcgctcggtgcatggatgggctgggccgcgctgccgcaggtcgtgctgttcgccgccgtgaccggcgcgatcgtcgggctggtcgcgacgtggcgcggccgcatgcgtttcgaggagccgattccgttcggtccgttcctcgcggccggcggcgtcgcgacgctgtttttcggtacccctttctattcggcgctcggcggctga

SEQ ID NO: 106541 - protein, 303 aa, Burkholderia vietnamiensis G4
MTRAPMFPVPDSPAGTLLALALLPPAVQYAFAVVIGLCVGSFINVVAHRVPVMMQRAWRAEIAEATGNADAAPDDGYPQRYDLWRPRSACPHCGHVLRAWENVPLLSYVMLRGRCRQCGHAIGIRYPLVELAGALLAAGSLAAFGPTGAAIAAFGLCAALLAMSAIDIRTGYLPDSMTLPLLWAGLALNLAGMFTSLQSAVIGAMSGYLFLWSIYWLFRWLRGIEGIGFGDLKLLAALGAWMGWAALPQVVLFAAVTGAIVGLVATWRGRMRFEEPIPFGPFLAAGGVATLFFGTPFYSALGG

SEQ ID NO: 106542 - DNA, 912 bp, Burkholderia cenocepacia AU 1054
  CDS (1)..(912): transl_table=11
atgacgccagtgcccctgtccaccgtttccgattcgcccgagggcacgctgctcgcgctggcgatgctgccgcccgcgctgcagtatgcgttcgcggtcgtcatcggcctttgcatcggcagcttcctgaacgtggtcgtgcaccggttgcccgtgatgatgcagcgcgcgtggcaggccgagatcgccgaagcgaccggcgccgcgggcgccccgcccgacgacggttatccgccgcgctacgatctgtggcgcccgcgcagcgcctgcccgcactgcggccacgtgttgcgcgcctgggaaaacattccgctccttagctacctgatgctgcgcggccgctgccggcgctgcggccatgcaatcggcatccgctatccgctcgtcgaactcgcgtgcgcactgctcgcggccggctcgctcgcggcgttcggcccgaccgtcgccgcgttcgccgcgttcgcgctgtgcgcggcgctgctcgcgatgagtgcgatcgatatccggaccggctacctgcccgactcgatgacgctgccattgctgtgggccgggctcgtgctgaacctcggcggcactttcacgtcgctgcgctcggccgtgatcggcgcgatggccggctacctgttcctgtggtcgatctactggctgttcaaatggctgcgcggcatcgagggcatcggtttcggcgacctgaagctgcttgccgcgctcggcgcatggatgggctgggccgcactgccgcaggtcgtgctgttcgcggcggtgaccggcgcggtcgtcgggctcgtcgcgacctggcgcggccgcatgcgcttcgaggagccgattccattcggcccgttcctcgcggccggcggcgtcgccacgctgtttttcggcacccctttctatgcggcgctcggaggctga

SEQ ID NO: 106543 - protein, 303 aa, Burkholderia cenocepacia AU 1054
MTPVPLSTVSDSPEGTLLALAMLPPALQYAFAVVIGLCIGSFLNVVVHRLPVMMQRAWQAEIAEATGAAGAPPDDGYPPRYDLWRPRSACPHCGHVLRAWENIPLLSYLMLRGRCRRCGHAIGIRYPLVELACALLAAGSLAAFGPTVAAFAAFALCAALLAMSAIDIRTGYLPDSMTLPLLWAGLVLNLGGTFTSLRSAVIGAMAGYLFLWSIYWLFKWLRGIEGIGFGDLKLLAALGAWMGWAALPQVVLFAAVTGAVVGLVATWRGRMRFEEPIPFGPFLAAGGVATLFFGTPFYAALGG

SEQ ID NO: 106544 - DNA, 843 bp, Chromohalobacter salexigens DSM 3043
  CDS (1)..(843): transl_table=11
ttgttggccgatatccccctgccctggctggccgtgatggctttcgtcgtgggtacgctgctgggcagctttctcaatgtcgtcatcgtgcgcctgccggtcatgctgatgcagcaatggcgtcaggaggcgcgcgaatcgctggccctcgagacggaggacgtgccggcctacaacctgtgcacgccacgctcgcaatgtccgcgttgccgagcgccgatcgcctggcacgacaatctgcccttgatcggctggctcaagcgacgcggtcgctgtgcgcattgccaggggcggatcagcgcacaatatcctctggtcgagctggccgctgggctgttgctgttcagcgtggtgatggtgcatggcgcgacctggtccgccctcgcctggggcgggctgtgcctgacgctgctggtggtcgccgtcatcgacctgcgcacgcagctgctgcccgatatcatcacgctccccctgctctgggcggggcttatctaccagctcgtctttcagccctattggctgagcaacgccgtcatcggcgcgctcgccggctatctgctgctctgggggttctactggctcttcaagtggatcaccggcaaggagggcatggggtacggcgacttcaagctgctggcggcgctgggggcctggttcggctggacgatgctgccgattctgctgatcctttccgccggcctgggagccgtcatcggtgggctattgcaactcacgcacccccggctacgcggcatgccgctgcccttcggccccttcctcgccctcgccggctgggtggcggtcctcttcggcgcaccgctgcgcgccttgaccggtctatga

SEQ ID NO: 106545 - protein, 280 aa, Chromohalobacter salexigens DSM 3043
MLADIPLPWLAVMAFVVGTLLGSFLNVVIVRLPVMLMQQWRQEARESLALETEDVPAYNLCTPRSQCPRCRAPIAWHDNLPLIGWLKRRGRCAHCQGRISAQYPLVELAAGLLLFSVVMVHGATWSALAWGGLCLTLLVVAVIDLRTQLLPDIITLPLLWAGLIYQLVFQPYWLSNAVIGALAGYLLLWGFYWLFKWITGKEGMGYGDFKLLAALGAWFGWTMLPILLILSAGLGAVIGGLLQLTHPRLRGMPLPFGPFLALAGWVAVLFGAPLRALTGL

SEQ ID NO: 106546 - DNA, 915 bp, Burkholderia pseudomallei 1710a
  CDS (1)..(915)
atgacgcccaatccgttcctttccggctcgcccgaacatgcggcggcggccgggccgctcgccgcattcgcggcgctccccacgggcatgcagcttgcgttcgcgatcgtgctcggcctcgtcgtcggcagcttcatcaacgtcgtcgtccatcggctgccaatcatgatgaagcgcgcgtggctcgccgaaatcgccgaagcgacggacgcgccgtgcgtcgacgacggcctgccggcgcgctacaacctctgcgtgccgcgcagcgcgtgcccgcactgcggccatgcgctgcgcgcgtgggaaaacgtgccggtcctcagctatatcgcattgcggggccggtgccggcactgccgtacgccgatcggcgcgcgctatccgctcatcgaactcgcgagcggcgcgctcgccgccggcgcgctcgcgctgttcgggccgagcggcgccgcactcgccgcgttcggcctgtgcgcggcgctcctcgcgatgagcgcgatcgacatgcagaccggcttcctgcccgattcgctcacgttgccgctcctgtgggccgggctgtgcgtcaatctctggggcacgtttgcgagcctgcgcgccgcggtgatcggcgcgatcgccggctatctgttcctctggtgcattctgtggctcttcaaactgctgcgcggcatcgaaggaatcggctacggcgacctgaagctcctcgccgcgctcggcgcatggctcggctgggaagcattgccgcaggtcgtgctgatcgcagcggtcgccggcgccgcggtcggtctcgtcgcaacctggcgcggccgcatgcgcttcgaggaaccgttgccattcggcccgttcctcgcggcgggcggcgccgcgaccctctttttcggcacgccgttctacctgctgctcggaggctga

SEQ ID NO: 106547 - protein, 304 aa, Burkholderia pseudomallei 1710a
MTPNPFLSGSPEHAAAAGPLAAFAALPTGMQLAFAIVLGLVVGSFINVVVHRLPIMMKRAWLAEIAEATDAPCVDDGLPARYNLCVPRSACPHCGHALRAWENVPVLSYIALRGRCRHCRTPIGARYPLIELASGALAAGALALFGPSGAALAAFGLCAALLAMSAIDMQTGFLPDSLTLPLLWAGLCVNLWGTFASLRAAVIGAIAGYLFLWCILWLFKLLRGIEGIGYGDLKLLAALGAWLGWEALPQVVLIAAVAGAAVGLVATWRGRMRFEEPLPFGPFLAAGGAATLFFGTPFYLLLGG

SEQ ID NO: 106548 - DNA, 858 bp, Polaromonas sp. JS666
  CDS (1)..(858): transl_table=11
atgccgacgggattgggtttggggccggagtttgaggcgctgctggccggattttttggcctgctgatcggcagcttcctgaacgtcgtcatctaccgcctgcccaaaatgatggagcggcagtgggcgcaggagtgcgccgacctggccggaaaatccgtggagcccggagaaaaattcaatttggtggcaccgcggtcgcgctgctccaattgcggccatgtcattcgctggtacgagaacatcccggtggcgagctacctgttcctccgcgggaaatgctccatgtgcagcgccccctacggcgtgcgctatcccatcgtggaggcgatcaccggcgccctatttttcttttgcgcatggcgttggggctggtcgctcgctgcgctggtctggtgcggattttcggcagcgctgctggtgctggcactgattgattgggacacgaccttgctgccggacgacatcaccttgcccttgctgtgggctggattgatcgtggcggcgctgcagtggaatccggccgtgaatctgtacagtgccctgtggggtgcgattgccggttatctctcgctctggctggtgtactgggccttcaaactggtgaccggaaaagaaggcatgggttacggcgacttcaaactgtttgccgcactgggtgcctggtttggctggcaggcgctgattccgatgatcctgatggcatccatcattggcgccatcattggcattgcgctgaagttttccagcggactgcgcgagggcggttacgtgccgtttggccctttcctggcgggtgcgggatttaccgccatggtgttcgggcctcaatcgattctgcagtttgtgggtttgtga

SEQ ID NO: 106549 - protein, 285 aa, Polaromonas sp. JS666
MPTGLGLGPEFEALLAGFFGLLIGSFLNVVIYRLPKMMERQWAQECADLAGKSVEPGEKFNLVAPRSRCSNCGHVIRWYENIPVASYLFLRGKCSMCSAPYGVRYPIVEAITGALFFFCAWRWGWSLAALVWCGFSAALLVLALIDWDTTLLPDDITLPLLWAGLIVAALQWNPAVNLYSALWGAIAGYLSLWLVYWAFKLVTGKEGMGYGDFKLFAALGAWFGWQALIPMILMASIIGAIIGIALKFSSGLREGGYVPFGPFLAGAGFTAMVFGPQSILQFVGL

SEQ ID NO: 106550 - DNA, 810 bp, Crocosphaera watsonii WH 8501
  CDS (1)..(810): transl_table=11
atggatttattaatcgcctctattacccttccatttgtctttgtctttggtgcttgtatcggtagctttctcaacgttgttatttatcgcttaccagaaggaatatctttaattcatcctccttcccgttgtccccattgtgaacatcctttgggcaaaacagagaatgtcccagtgttaggttggttatggttacggggacgctgtcgttggtgtcatactccgatctcggtgcgttatcctttaatagaagctatcacaggtttattattttgtgctgtattctggcaatatcaatttacccttacaaccatcggttattgggtgttagttagttggttagtctcccttgctatgattgattttgataccatgaccttaccaggagaattaaccaagtcagggttaatattagggttaatctttcaagggatcataggttggcaatttgctcaaacccctgaatatttaatgacagcgatcaccagtgctgttttgggaatctggttattttgtattattcgctggggtggtacctgggtttttgggaaagaagcgttaggaggaggagactctaagttagctgcaatgttaggtgcttggttaggatggaaatatctcttagtcaccagttttttagcttgtttattgggttctttatttggtgttagcggaatggttttaggatttatgggtcgtcttcaatactttccttttggtccatttttagcattgggtgcaattttgagtttattttggggagaaattataatttctacttatattcaagcttttttccctttgagttaa

SEQ ID NO: 106551 - protein, 269 aa, Crocosphaera watsonii WH 8501
MDLLIASITLPFVFVFGACIGSFLNVVIYRLPEGISLIHPPSRCPHCEHPLGKTENVPVLGWLWLRGRCRWCHTPISVRYPLIEAITGLLFCAVFWQYQFTLTTIGYWVLVSWLVSLAMIDFDTMTLPGELTKSGLILGLIFQGIIGWQFAQTPEYLMTAITSAVLGIWLFCIIRWGGTWVFGKEALGGGDSKLAAMLGAWLGWKYLLVTSFLACLLGSLFGVSGMVLGFMGRLQYFPFGPFLALGAILSLFWGEIIISTYIQAFFPLS

SEQ ID NO: 106552 - DNA, 810 bp, Solibacter usitatus Ellin6076
  CDS (1)..(810): transl_table=11
atgattgaagccatcctcgccctcatcttcggcctcttgatcggcagcttcctcaatgtctgcattcaccgctggccgcgcaatcgcagcgtggtgaagccgcgctcgcattgcgtgcgctgccgcaagaccatcgcctggtacgacaacattccgctgctcagctacctcgtactcggcggcaagtgccggcactgcggcgccaggatctcgtggcgctacccgctggtcgaattcctcaccggcctgttcttcttctatttcgtccgagtcaatggattaaccccgctcgccgccaagatgtgcgtcttcagcgccatcgtgatcgcgctcatcttcagcgacctcgaaaaacgcatcctgcccgatgaattcacgaaagggggcatcgtgctcgggctaatcttttcgctcttcgtccccgtgcccgacatcaccgcgcaggccatgttctggatggccggcggcgaactgaccggctggaaacaatccttggccgaatccgccgtcggcgcgttcctgcccgcgtttttcctgtggttcggcggctggctctacttcaaggtgcgccatcgcgaagggctcggcttcggcgacgtaaagctgatcgcgatggtcggaagtttcctgggactgcgcggcgcgctcctcactctgatcctcggctccatcgccggctccgtcatcggctacagctacatcaagctcaccggcaaggacccttcggagtacgaactcccgttcggcaccttcctcggcttcgccgccctcttcgccggcatcgcgggcgcccaactgctggctatctag

SEQ ID NO: 106553 - protein, 269 aa, Solibacter usitatus Ellin6076
MIEAILALIFGLLIGSFLNVCIHRWPRNRSVVKPRSHCVRCRKTIAWYDNIPLLSYLVLGGKCRHCGARISWRYPLVEFLTGLFFFYFVRVNGLTPLAAKMCVFSAIVIALIFSDLEKRILPDEFTKGGIVLGLIFSLFVPVPDITAQAMFWMAGGELTGWKQSLAESAVGAFLPAFFLWFGGWLYFKVRHREGLGFGDVKLIAMVGSFLGLRGALLTLILGSIAGSVIGYSYIKLTGKDPSEYELPFGTFLGFAALFAGIAGAQLLAI

SEQ ID NO: 106554 - DNA, 780 bp, Geobacter metallireducens GS-15
  CDS (1)..(780): transl_table=11
atgtccccagtggttatttttgcactattttcttttctcctcggcgccgcggtcggctccttcctcaacgtctgcatttaccggctgccggcgggggaatcggtggtttctcccccatcccgctgccctgcctgtggtgccagaatccgcccgtggcacaacatcccgattctcggctggctgatcctgcgagggaagtgccgcgactgcggcgcccccatttcgccccgctacccctttgtggagttgctgaacggcctcctcaccctcgcccttttcctgaagttcgggccgtctcccaccttcctggtcctcttcgtcttctgctcggccctggtggccgtcaccttcatcgacctggaccaccagctcatccccgacgtcatcagcctgccggggatcgtggtgggctttgcttgctccttcgcgctcccgtggcttggctggaaaagttccctcatcggcatcgtggccggcgggggaagccttctgtccgtggcgcggctctacgagctcctgacgaagaaggaagggatggggggaggcgacatcaagctcctggccatgatgggggcgttccttggctggcgctccgtgccgttcatcatcttcgcctcgtccctcatcggatcggtgatcggcgtcaccctcatgctcgtccagaaaaaagactccaagctcgccattcccttcgggccgttcctggcgacgggggccgtgctctacatcttcttcggcaagacgatcatcacctggtacctgactttgggcgcccgctag

SEQ ID NO: 106555 - protein, 259 aa, Geobacter metallireducens GS-15
MSPVVIFALFSFLLGAAVGSFLNVCIYRLPAGESVVSPPSRCPACGARIRPWHNIPILGWLILRGKCRDCGAPISPRYPFVELLNGLLTLALFLKFGPSPTFLVLFVFCSALVAVTFIDLDHQLIPDVISLPGIVVGFACSFALPWLGWKSSLIGIVAGGGSLLSVARLYELLTKKEGMGGGDIKLLAMMGAFLGWRSVPFIIFASSLIGSVIGVTLMLVQKKDSKLAIPFGPFLATGAVLYIFFGKTIITWYLTLGAR

SEQ ID NO: 106556 - DNA, 795 bp, Desulfuromonas acetoxidans DSM 684
  CDS (1)..(795): transl_table=11
atgggactgtttgcggatgagacgttgatgatgatttggctatttgtgtttgtcttgggcgctgttattggctcttttttgaatgtgtgcatttatcggattccccttgggaagtccgttgtgtttccgccctcacattgttttagctgtgatagtcgacttcgctggtatcataatattccgattttgagctttctttttttgcgtggacgttgtgctttctgtggtgcttcgtttagttggcgctaccctggtatcgaagctcttaatggggcactttattgtctggttttttactacgcgcgcttttccatggtgactttggttctttttctgtttgtttcggcacttgttgttgtcacgtttattgattatgaccatcagattattcctgatgtaattactttgcctggtatcccgatcggctttatctgctcttttgccattccctgggtcagttggaaggattcgttgatcggggttcttgttggcggggggagtctttttgcagttgcctttctgtatgaattttttactaaaaaagaggggatgggcggaggtgacattaagctattggcaatgattggcgctttttgtggttggcgtgtcattcttccggtggttttcttaagttcactgctgggctcactggtgggtattccagtgatgttgttacaaaaaggagattcaaaaatggcactaccttttgggcctttccttgttgcaggaacgttgatttatttattttggggggaagttcttgtgcggtggtattttaatttatttgtcatttaa

SEQ ID NO: 106557 - protein, 264 aa, Desulfuromonas acetoxidans DSM 684
MGLFADETLMMIWLFVFVLGAVIGSFLNVCIYRIPLGKSVVFPPSHCFSCDSRLRWYHNIPILSFLFLRGRCAFCGASFSWRYPGIEALNGALYCLVFYYARFSMVTLVLFLFVSALVVVTFIDYDHQIIPDVITLPGIPIGFICSFAIPWVSWKDSLIGVLVGGGSLFAVAFLYEFFTKKEGMGGGDIKLLAMIGAFCGWRVILPVVFLSSLLGSLVGIPVMLLQKGDSKMALPFGPFLVAGTLIYLFWGEVLVRWYFNLFVI

SEQ ID NO: 106558 - DNA, 762 bp, Desulfitobacterium hafniense DCB-2
  CDS (1)..(762): transl_table=11
gtgggaattgaactcagtgtattatccggaatattgggggtgatcatcggcagttttttaaatgtggtgatttatcgtgttccccagggaaaatctataattttccctggttcccactgccctgcatgtggtcataatcttcgcccctgggaactggttccggttctaagtttcctcattttgaggggacggtgcgctcaatgccgggagaagatttcatggcgttaccccttaatcgaggggctcaatggatctctgtatttttatgctgcctgggtgaatcacagccgctcatttcttgagttggggataaacttttattttatatctgtgcttttagttctcgctgttattgattgggatacctaccgcctgccggatgttttcactcttcctttactgggtgtcggtattgtggcaggttttttgctgccccagggcccatcgggttgggaaagcctggctacggcactgggggtaggaggagtgttttggatgatcactcggctctatcctgaagggatgggcttaggggatataaagcttattgccggattgagcgcatttttaggatttccggaagctttaatagctgttttcatcgccagtttcacaggatccataggcggacttatcatgttgtcctttgaaaaaagaagtttcagggaacagattccctttgggccttatctggtactgggaggttggattgtgttcttttggggacaaactatcctttctttttattactctctgttttga

SEQ ID NO: 106559 - protein, 253 aa, Desulfitobacterium hafniense DCB-2
MGIELSVLSGILGVIIGSFLNVVIYRVPQGKSIIFPGSHCPACGHNLRPWELVPVLSFLILRGRCAQCREKISWRYPLIEGLNGSLYFYAAWVNHSRSFLELGINFYFISVLLVLAVIDWDTYRLPDVFTLPLLGVGIVAGFLLPQGPSGWESLATALGVGGVFWMITRLYPEGMGLGDIKLIAGLSAFLGFPEALIAVFIASFTGSIGGLIMLSFEKRSFREQIPFGPYLVLGGWIVFFWGQTILSFYYSLF

SEQ ID NO: 106560 - DNA, 867 bp, Methylobacillus flagellatus KT
  CDS (1)..(867): transl_table=11
atgcctgaatttgtttttctggatgctttgagagacaaccccgccctcttcattacctgctctgcgctcctgggcctcatggtcggcagcttcctcaacgtggtgatataccggttgccacgcatgatggagctggcctggcatgctgagcgcttggaagccgaaggccaacctcaaacagaacaggcccgctacaacctgatcacacctcggtcacgctgcccgcattgccagcatgccatcacagcactggaaaatataccaatcatcagctacatgatgctgggaggaaaatgcaggcaatgcaagactgcaatcagcccgcgataccctttggtagaactcctcacggcaacgctgaccggtcttgccagctggcatttcggctattccagccttgccgtggcaagctggcttatcatcttcgcgctgatcgcactcacctttatcgacctcgacacgcatctgctgccagacgatatcaccttgcccttgctctgggcaggactgctgttcaatctcgaccatggcttcaccgacatcagctctgccgtgattggggctgctgccggatatcttgtgttgtggtcagtatactggctattcaagctcatcacaggcaaagagggcatgggctacggtgacttcaagctcttggcagccctgggagcctggttcggctggcaattgctccctgctgtcattttattatcatccgtcgctggttccatcatcggaattggattgatcgtattgaccaagcacggacgggaaaccccgattccattcgggccgtacctggcactgggaggaatcgcagccctgttctgcggtgaacaactttctcaattatatttaggaggctga

SEQ ID NO: 106561 - protein, 288 aa, Methylobacillus flagellatus KT
MPEFVFLDALRDNPALFITCSALLGLMVGSFLNVVIYRLPRMMELAWHAERLEAEGQPQTEQARYNLITPRSRCPHCQHAITALENIPIISYMMLGGKCRQCKTAISPRYPLVELLTATLTGLASWHFGYSSLAVASWLIIFALIALTFIDLDTHLLPDDITLPLLWAGLLFNLDHGFTDISSAVIGAAAGYLVLWSVYWLFKLITGKEGMGYGDFKLLAALGAWFGWQLLPAVILLSSVAGSIIGIGLIVLTKHGRETPIPFGPYLALGGIAALFCGEQLSQLYLGG

SEQ ID NO: 106562 - DNA, 672 bp, Frankia sp. EAN1pec
  CDS (1)..(672): transl_table=11
gtgaacacggtggtggtcgccgccaccgtggcggccgcggtctgcgccgcgctgccgatcccgctgctgccccgggtcgtcgactccttcgatccagtggacggccgtttgccgcgccgggcgacccccgcgccggccgtgctcggcgccgtcaccgccgtcctgatcgccgccgtcgccgcgtcgacctacccgcacccgggacgtctgcccgcgtacctgtacctgacggtcgtcggggtcgtgcttgccgccgtggacctgcgggtgcaccgcctgccggacgtgatcgtgctgccctcgtacgccgtgctggccgcgctgctcgccgtgcccgcgttggccgagggcgcgcccaaccgctggccgcgggcgctgctcgccggcgccgtggcctggctgttgtacgcgggcctgcgcctgctgccgggggccgggctggggcggggggacgtgaagctcgccgggctgctcggcgtggcgacgggctggctgggctggtcggccgtcgtggtgtggctggtcgcgacgaccatgatctccggtgcggtggtcctcgtgctgctggcgctgcgccgtgtgtcccgccgtgatccgatcgcctacggcccgtttctgctgttcggggcgctgatcgcggtgctcggcgtgggctgggagccggccggctga

SEQ ID NO: 106563 - protein, 223 aa, Frankia sp. EAN1pec
MNTVVVAATVAAAVCAALPIPLLPRVVDSFDPVDGRLPRRATPAPAVLGAVTAVLIAAVAASTYPHPGRLPAYLYLTVVGVVLAAVDLRVHRLPDVIVLPSYAVLAALLAVPALAEGAPNRWPRALLAGAVAWLLYAGLRLLPGAGLGRGDVKLAGLLGVATGWLGWSAVVVWLVATTMISGAVVLVLLALRRVSRRDPIAYGPFLLFGALIAVLGVGWEPAG

SEQ ID NO: 106564 - DNA, 744 bp, Moorella thermoacetica ATCC 39073
  CDS (1)..(744): transl_table=11
atgctggtattttttttcttggcgggtctttttatcggcagtttcctcaacgtggtcgtataccgcttaccgcgcggagaaacggtggtctggggccgttcgcactgcccgacctgcgggcgggagctggcctggtacgaccttattcccgtattgagctacctgtttctgcggggcaggtgccgttactgccacctgccgatttcccctcgataccctatagttgagcttgttactggcgtggtgtttaccacccttttttataatttcggcctctcctgggtcctggtaaaataccttttcctgggcgccgtgctggtagccgcaagcttcatcgacctggagcattacttaatccccgatagcctggtggtgaccggagcctgcggaggtattctttttagcctgctggcgcgggatgtggggttccgggctgctttagggggatctgtcgcagcagcaggatttttgctgctcgttgccgtaattagtaatggtggcatgggcggcggggatgtgaaacttgcaggtatggtagggcttttcctcggctggcccctggcatccctggctctcttcctttccctggtcacaggcggcctggcgggcgtttgcttgctggtatctggcctaaaaaaacgggaggacccccttcccttcgcgccctttatcgccataggggggttgctggcattgttttttggcgagaaaatgttgcactggtatcttggcaggtttatgtaa

SEQ ID NO: 106565 - protein, 247 aa, Moorella thermoacetica ATCC 39073
MLVFFFLAGLFIGSFLNVVVYRLPRGETVVWGRSHCPTCGRELAWYDLIPVLSYLFLRGRCRYCHLPISPRYPIVELVTGVVFTTLFYNFGLSWVLVKYLFLGAVLVAASFIDLEHYLIPDSLVVTGACGGILFSLLARDVGFRAALGGSVAAAGFLLLVAVISNGGMGGGDVKLAGMVGLFLGWPLASLALFLSLVTGGLAGVCLLVSGLKKREDPLPFAPFIAIGGLLALFFGEKMLHWYLGRFM

SEQ ID NO: 106566 - DNA, 783 bp, Sphingopyxis alaskensis RB2256
  CDS (1)..(783): transl_table=11
gtggtcgaccaaagcctgaaaatcctcgatgccttgcccttcggcacgggcatcctgctggccgggctgaccgggctgctgctgggcagttttatagcgacgctggtgctgcgttggccggaggggcgctcgctgctcgggcgctcgcagtgcgacggctgcggacgggcgctcggcgtgcgcgatcttgtcccgcttgtatcggcggcgctgtcgcgcgggcggtgccggacgtgcggtgcgaggatcaacccctttcatggccgggtcgagcttgtatcggcgctgattggcgccggggcgctggcgctgcttccgggcacggcgggctggctctgggcgctgttcggctggttgctgctgccgctcgcgctgctcgatgcgcggcatttctggctgcccgaccggctgacgctgttgctggcggtgacgggggtgttgctggcgggaccgatgctcggcacgtcactggtcgatcgctgggtcggagcgctggttggcggtggcacgctcgcgctgctcgcgtggctctatgcgcgtgcgcgccgacgggaaggcatggggggcggcgaccccaaactcgtcgcggcgacgggcgcgtggctcggctggcaggccttgccgctgatgctgctgctcgcgagccttggcggaatcatctgggcgctcgtcgtccagcgaaaaggggaccagccgctcggcgagcggcgagtccccttcggtatgttcctttgcggtgccgcctttgccgcggtgccgctgtggccgcttatcgcccgatga

SEQ ID NO: 106567 - protein, 260 aa, Sphingopyxis alaskensis RB2256
MVDQSLKILDALPFGTGILLAGLTGLLLGSFIATLVLRWPEGRSLLGRSQCDGCGRALGVRDLVPLVSAALSRGRCRTCGARINPFHGRVELVSALIGAGALALLPGTAGWLWALFGWLLLPLALLDARHFWLPDRLTLLLAVTGVLLAGPMLGTSLVDRWVGALVGGGTLALLAWLYARARRREGMGGGDPKLVAATGAWLGWQALPLMLLLASLGGIIWALVVQRKGDQPLGERRVPFGMFLCGAAFAAVPLWPLIAR

SEQ ID NO: 106568 - DNA, 915 bp, Shewanella baltica OS155
  CDS (1)..(915): transl_table=11
atgtcagaattcatctcccttttgggccagcacccttatctctttattgctctaagctttatttttgccgctaccattggtagttttttaaacgtggtaatccacagatttcctgtgatgatgaaacgtgagtggcagcaagaatgtaatcagtatttgcaggaataccacgaagatatagtcaacaagataggtataaaccaactcaataaacctattgatgccttcccagagaagtataatctggttgtgccgggctcagcctgccctaaatgtaaaacgtcgattaagccttggcataatttccccctattaggctggctaatgctcaagggaaaatgcgccgcctgtcaagcagcgatttcagcccgctaccctattattgaattcatcacagggctacttatcgcgactttagcttggcattttggtccaagctggcagtttgtttttgcgagcatactcacctttgtgcttgtagcactgacagctatcgatcttgatgagatgctgctccccgaccagatgacgttgccgttactttggctaggcttgataatcaacctaaatcatacctttgcgagtccaaccgacgccattatgggtgcggcagcaggctatttaagcttgtggtctattttttggctatttaagatcctcaccggcaaggaaggcatgggttatggtgactttaaactgctagccgtgttcggtgcttggcttggctggcaaatgctgccgctggtgattttactttcgtccctcgttggcgcagtcgttggcatcactatgattgttagtaaacgcctgaaacaagggaatccaatcccatttggcccctatattgccgcagctggctggatagccttgctatttgggcaacagattgtcgattggtacctatcgacactgtaa

SEQ ID NO: 106569 - protein, 304 aa, Shewanella baltica OS155
MSEFISLLGQHPYLFIALSFIFAATIGSFLNVVIHRFPVMMKREWQQECNQYLQEYHEDIVNKIGINQLNKPIDAFPEKYNLVVPGSACPKCKTSIKPWHNFPLLGWLMLKGKCAACQAAISARYPIIEFITGLLIATLAWHFGPSWQFVFASILTFVLVALTAIDLDEMLLPDQMTLPLLWLGLIINLNHTFASPTDAIMGAAAGYLSLWSIFWLFKILTGKEGMGYGDFKLLAVFGAWLGWQMLPLVILLSSLVGAVVGITMIVSKRLKQGNPIPFGPYIAAAGWIALLFGQQIVDWYLSTL

SEQ ID NO: 106570 - DNA, 915 bp, Shewanella amazonensis SB2B
  CDS (1)..(915): transl_table=11
atgactgaatttatctccctaatgagccagtttccctggctctttattttgctcgcattcctgttcgcagccaccattggtagcttcctcaatgtcgtaattcatcgcttgcctgtgatgatgaaaagagaatggcagcaggaatgtaatgcctatcttgaagagtaccaacctgaacttgtaaaaaagcttggcaaagcgaatttggacaagccaattgatagctatccagaacgttataacctgattgtgccaggctcatcctgccctaagtgcggtactatcattaagccctggcacaatctgcctgtactgggctggataatccttggcggtaaatgcgcttcctgcaaagccccaatttccagccgttatcccatagtggaagcctttaccggcctgactgttgcagcactggcgtggcactttggtcccacgtggcaatttgtcacagcagcattactcacctttggcttaattgccatgtcgggaatcgacctggatgaaatgctactgccagacagcctcactcttcctctgctgtggctgggattactgcttaattatcatggcctatttaccactctggaagatgcactcattggtgctgcagccggttatctgtcgctttggtctgtgtattggctgtttaagctcaccacaggcaaagagggcatgggctacggtgattttaaactcatggggctctttggtgcttggctcggctggcaaatgctgccgttaattattcttctctcaagcctggtcggtgctgtcgttggcatactgatgatggtttggaaaagccataagcgtgaaaatcccatcccatttggtccctatatcgcggccgctggctggatagcacttatttggggacaagatattgtcagctggtatctgggttctctttga

SEQ ID NO: 106571 - protein, 304 aa, Shewanella amazonensis SB2B
MTEFISLMSQFPWLFILLAFLFAATIGSFLNVVIHRLPVMMKREWQQECNAYLEEYQPELVKKLGKANLDKPIDSYPERYNLIVPGSSCPKCGTIIKPWHNLPVLGWIILGGKCASCKAPISSRYPIVEAFTGLTVAALAWHFGPTWQFVTAALLTFGLIAMSGIDLDEMLLPDSLTLPLLWLGLLLNYHGLFTTLEDALIGAAAGYLSLWSVYWLFKLTTGKEGMGYGDFKLMGLFGAWLGWQMLPLIILLSSLVGAVVGILMMVWKSHKRENPIPFGPYIAAAGWIALIWGQDIVSWYLGSL

SEQ ID NO: 106572 - DNA, 870 bp, Ralstonia metallidurans CH34
  CDS (1)..(870): transl_table=11
atgcaagctgtcctgtcatcgctggcggcgttgccgccagctttccttattgtcgcggcaggggtggttggcctgatggtcggcagtttcctcaacgtggtgatccatcgtctgccgaagatgatggagtacgacgaggccaactacatcgcggaaatccgtggcgaaccgttgccgcaccccgagcgctataacctgatggtgccgcgatccgcgtgcccgaagtgcggccaccagatcgccccctgggagaacatccccgtcatcagctacctgttcctgcgtggccgctgcaaggcctgcaagacgccgatcggcatccgctatccgctcgtcgagctgatcacggcggcgctcagcgccctggcgatgtggcacttcggtccgacggcgcaggcgctggccgcgatcgtgatgacctggtcgctggtcgcgttgttcatgatcgatgccgacacccagcttctgccagaccagatcacgctgccgctgctatggctgggcctgctgctgaacctgcagggcttgttcgcgccgctggcggatgccgtcatcggcgctgcggcgggctacctgctgctgtggagcgtctactggctctacaagctcgtgcggggccgcgagggcatgggccacggcgatttcaagttgatggcggcgcttggcgcatggttcggctggcaggcactgcccgcgctgatcctgatgtcgtcggtggtcggtgccgtgcttggcggcgcgatgctggtcttccgccgcaagagtagtgacacgaccttcccgtttggcccgtacatcgtcggtgccgggctgatcgtgctgttctttggcgcagacgtattaccgctgacgctggtggccggacactag

SEQ ID NO: 106573 - protein, 289 aa, Ralstonia metallidurans CH34
MQAVLSSLAALPPAFLIVAAGVVGLMVGSFLNVVIHRLPKMMEYDEANYIAEIRGEPLPHPERYNLMVPRSACPKCGHQIAPWENIPVISYLFLRGRCKACKTPIGIRYPLVELITAALSALAMWHFGPTAQALAAIVMTWSLVALFMIDADTQLLPDQITLPLLWLGLLLNLQGLFAPLADAVIGAAAGYLLLWSVYWLYKLVRGREGMGHGDFKLMAALGAWFGWQALPALILMSSVVGAVLGGAMLVFRRKSSDTTFPFGPYIVGAGLIVLFFGADVLPLTLVAGH

SEQ ID NO: 106574 - DNA, 555 bp, Magnetococcus sp. MC-1
  CDS (1)..(555): transl_table=11
atggagttattgggaggggttgtggtggtgatggccattgcccgttttggttcaaatgcagaaggatggttattggcactgtttggactggcgctcttgctgctctctgcgatagatatggaaaagcgcattctgcccaatataatcacctatcccttgctggtggtgggtgtggtgtgtagcgcactgcccatgttgggtagtccctttccctcaatgggggatgcccttttgggtatggtggtgggggctggtgggttgttggtactcattgaggtgtggtatcgcgtcacggggcgggtggcaatgggcttgggggatgtcaagctggtgggggtattgagtgcttggttgggttggcaagcgctctattttattatttttggttcagctttgttgggggtcgtggtggggggtggttggttgatatggggggggaaagagaaacagacccctataccctttggtccctttttggctttatcggcttggatttatctgtttttggatgaatccttcaagcagggttatctgctgtggatggttaggagttag

SEQ ID NO: 106575 - protein, 184 aa, Magnetococcus sp. MC-1
MELLGGVVVVMAIARFGSNAEGWLLALFGLALLLLSAIDMEKRILPNIITYPLLVVGVVCSALPMLGSPFPSMGDALLGMVVGAGGLLVLIEVWYRVTGRVAMGLGDVKLVGVLSAWLGWQALYFIIFGSALLGVVVGGGWLIWGGKEKQTPIPFGPFLALSAWIYLFLDESFKQGYLLWMVRS

SEQ ID NO: 106576 - DNA, 480 bp, Nitrobacter hamburgensis X14
  CDS (1)..(480): transl_table=11
ttgccagatcccttgacgacggcgtctctgagcgtgctcggcctcgcgtgcgtctggctcgcatggatcgacctgcgcgacggcatcattcccgaccggctcaatctgctggtggctgcgaccggtgtggtgcggatggcggcgctcgcggggtgggagcctgcgggtgctcggctttgcgagggcgtcgtcatcggcgccgtcgtctggctattgcgttggctttatttcaagtggcgcaagcttcaaggacttgggctcggtgacgtcaagttgctcgcagcttccgccgtctggatcggcgttgccggcgtaccgacgcagcttcttatcgcttcggtcaccgcgctcgcggcggccgggctcatgcagctttcgaagcggacggtgacgcggcaaacggcgttgccgttcggtccgtttctcgcgctcggcctgctcgcggcgatcgtgctgcagcagcgtggtttgatcgactag

SEQ ID NO: 106577 - protein, 159 aa, Nitrobacter hamburgensis X14
MPDPLTTASLSVLGLACVWLAWIDLRDGIIPDRLNLLVAATGVVRMAALAGWEPAGARLCEGVVIGAVVWLLRWLYFKWRKLQGLGLGDVKLLAASAVWIGVAGVPTQLLIASVTALAAAGLMQLSKRTVTRQTALPFGPFLALGLLAAIVLQQRGLID

SEQ ID NO: 106578 - DNA, 918 bp, Shewanella denitrificans OS-217
  CDS (1)..(918): transl_table=11
atgagtgaatttatcgcccttatgggccaatatcctgttatttttatcagtgtttgctttatttttgccgccaccataggcagctttcttaacgtggttatccaccgtctacctgtaatgatgaagcgtgagtggcaagctgaatgtaatcaatacttacaagagtatcacccggatatagtcaaagacgtcagcctgaaacgcttagaaaaaccgttagatagtttccccgaacgttataacttggtagtgcctaattcctgctgccctaaatgcaatgccgccattaagccttggcataacttacctatccttggctggtgcatgctaaaaggaaagtgtgctcagtgccaacaggctatttctgtacgctatcccgttatcgaactactcacagggcttatggttgctgtcttagcttggcactttggccctacaagtcagtttttgtttgcctccctactgacctttgtcttgatagcattgactggcatagatctcgatgaaatgctattgccagaccagcttactatgccgctgctttggctaggcttgttgattaatttacaaggcgtattcacaagtccgactgatgccatcataggggcaattgctggttatatgagcctatggtcggtgttttggctatttaaactcgttacgggtaaggaaggcatgggttacggtgactttaaacttctggcggtgtttggcgcctggcttggttggcaaatgctgccattgataattttactgtcttcattagtgggtgcagttgtcgggattgcgctgattttaagtaaaaaactcaatcaaggaaatccgatcccatttggtccttacatcgccatggctggttggatagcgcttatttggggcaatgacatagttaattggtatctaggcaccttcttgtga

SEQ ID NO: 106579 - protein, 305 aa, Shewanella denitrificans OS-217
MSEFIALMGQYPVIFISVCFIFAATIGSFLNVVIHRLPVMMKREWQAECNQYLQEYHPDIVKDVSLKRLEKPLDSFPERYNLVVPNSCCPKCNAAIKPWHNLPILGWCMLKGKCAQCQQAISVRYPVIELLTGLMVAVLAWHFGPTSQFLFASLLTFVLIALTGIDLDEMLLPDQLTMPLLWLGLLINLQGVFTSPTDAIIGAIAGYMSLWSVFWLFKLVTGKEGMGYGDFKLLAVFGAWLGWQMLPLIILLSSLVGAVVGIALILSKKLNQGNPIPFGPYIAMAGWIALIWGNDIVNWYLGTFL

SEQ ID NO: 106580 - DNA, 927 bp, Shewanella frigidimarina NCIMB 400
  CDS (1)..(927): transl_table=11
atgactgaatctatctcaaactttattacaacaatgactcaatacccttgggtctttgttgcgattagctttatttttgcggccaccattggcagctttctcaacgtcgtgatccaccgtttaccggtgatgatgaaacgtgaatggcaaagcgaatgtaacttttatctcaatgaatatcatcctgacattgtaaaacaagtaggcactgagcgtttacagaaagccatcgatccctttcctgaaaaatacaatctagtagtaccaggttccgcctgccctaaatgcaaggccaatataaagccttggcataatctgccaatattaggttggctgatgcttaagggtaaatgtgccgattgcaaaaccggtatttcaagccgctatcccattattgaactcttaaccggcgtattaattgccgcattagcatggcattttggcccaacatggcaatttgtttatgccagcattctaacgtttgtgttagtggcgttaactggcatcgatttagatgaaatgctattaccggaccaactcacgttaccaattctttggttaggattaatcattaaccttaaaggtatttataccagccctgaagacgcgattatcggcgcagctgcagggtatttaagtttgtggtcggtattctggttatttaaattagtcactggcaaagaaggcatgggctacggtgactttaaactattagccgtttttggtgcctggttaggctggcaaatgttaccactaattattctattatcttcactggtaggcgcggtagtgggcattaccatgattatggctaaacagctcaacaaaggtaaccctatcccctttggtccttatattgctgcagcaggctggatagcgttagtatggggacatgacattctcaattggtatcttagtacgttatga

SEQ ID NO: 106581 - protein, 308 aa, Shewanella frigidimarina NCIMB 400
MTESISNFITTMTQYPWVFVAISFIFAATIGSFLNVVIHRLPVMMKREWQSECNFYLNEYHPDIVKQVGTERLQKAIDPFPEKYNLVVPGSACPKCKANIKPWHNLPILGWLMLKGKCADCKTGISSRYPIIELLTGVLIAALAWHFGPTWQFVYASILTFVLVALTGIDLDEMLLPDQLTLPILWLGLIINLKGIYTSPEDAIIGAAAGYLSLWSVFWLFKLVTGKEGMGYGDFKLLAVFGAWLGWQMLPLIILLSSLVGAVVGITMIMAKQLNKGNPIPFGPYIAAAGWIALVWGHDILNWYLSTL

SEQ ID NO: 106582 - DNA, 900 bp, Psychrobacter cryohalolentis K5
  CDS (1)..(900): transl_table=11
atgcaatttatacagttactacaagaaaatatgaccattgctttggtcgtatttggtctactagggctgtgcgtcggtagcttcttaaacgtggtaattcatcgcactccattgataatggtatcggcttggcgaaaagagtgtagccagtttatgtatgagcaagcagatatgccgcgtgagcatacgatgccactagttaatattgttgccactgatacacctattaccttaagtaaaccagcatcgcgctgcccgcactgtgcccacaaaattaagtggtatgaaaacatacctttaattagctggatagtactacgcggacgttgctcagagtgcaaagcggctatcgggcttcgatatcctatcgttgagctggtcactgctctgctatctgcactagtcatttatcattttggcgttaatatggtagggctgtcggcattagttttagtctggacactcatcgccttaactggtatcgattttgatactcagttattgcctgaccgcttaacttttccattagcagggctaggattggcggtcaattcacaaggttggtttgtgccccctactcagtcgatatggggcttgttattgggatttttatcgttatggatagtggtcaagatattttatttaatcaccaaaaagcatggcatgggacaaggcgactttaaattattggcagtactgggtgcgtggcttggacctatgatgttacccttgattattttattatcatcattgctcggctctatcgttgggcttatcttgatgaaaaaacaaggcgagagcaagccttttgcctttggtccttatattgccattgctggtattgtggcattgttatacggctcagatatcgttaattggtatttaggtatgtatacttaa

SEQ ID NO: 106583 - protein, 299 aa, Psychrobacter cryohalolentis K5
MQFIQLLQENMTIALVVFGLLGLCVGSFLNVVIHRTPLIMVSAWRKECSQFMYEQADMPREHTMPLVNIVATDTPITLSKPASRCPHCAHKIKWYENIPLISWIVLRGRCSECKAAIGLRYPIVELVTALLSALVIYHFGVNMVGLSALVLVWTLIALTGIDFDTQLLPDRLTFPLAGLGLAVNSQGWFVPPTQSIWGLLLGFLSLWIVVKIFYLITKKHGMGQGDFKLLAVLGAWLGPMMLPLIILLSSLLGSIVGLILMKKQGESKPFAFGPYIAIAGIVALLYGSDIVNWYLGMYT

SEQ ID NO: 106584 - DNA, 729 bp, Nocardioides sp. JS614
  CDS (1)..(729): transl_table=11
gtgagcgtcgaccccggtgccgtcgtgctgggcgccgctgcctgcggcgcggccggcctgctggtgccggccctgatcgcgcggatccccgagccggatgcggatcccgagcacgacgtggtgaccgaggacccgggcgcgccgtcgtacgccgaggtcgcggccgcgcccggcctgcgctccgtcgcggcggtgctgagcctggtcgccggtggcctggtcggcgccggtgtgggcctcgactggccgctgctgttcctgctgccgctggtgcccgtcggggtcgcgctcgcggtcgtggacctgcgcacccggctgctgcccaccgtggtggtgtggccgaccctcgcggcgaccgctgtgctggcggtgctgagcgggctcctcgacgacgaccaggatgctctggtccgggccgggctgggcggggtcgtcgtgttcgcgttgttcttcgcgctgtggtggatccacccggcgggcatggggtacggcgacgtccggctctcggccgtgctcgggctcgcgctgggctacctgggttgggccgagctcgcgatcggcatctacggcgggttcctggccttctcggtgcccgggctcctgctggcgctgctgcggcgcgaccgggcgatcctgagagcggcctacccgttcggcccgttcctgctcgccggcgcgctcgcgggcgtcgtgctcggtccgctctggaccggtctcgcctcggggtga

SEQ ID NO: 106585 - protein, 242 aa, Nocardioides sp. JS614
MSVDPGAVVLGAAACGAAGLLVPALIARIPEPDADPEHDVVTEDPGAPSYAEVAAAPGLRSVAAVLSLVAGGLVGAGVGLDWPLLFLLPLVPVGVALAVVDLRTRLLPTVVVWPTLAATAVLAVLSGLLDDDQDALVRAGLGGVVVFALFFALWWIHPAGMGYGDVRLSAVLGLALGYLGWAELAIGIYGGFLAFSVPGLLLALLRRDRAILRAAYPFGPFLLAGALAGVVLGPLWTGLASG

SEQ ID NO: 106586 - DNA, 753 bp, Syntrophomonas wolfei str. Goettingen
  CDS (1)..(753): transl_table=11
atgtattattatgtgttgatggccatattttttctacttctggcttctttcctaaatgtagtcatttatcgacttccccggggagaatctcttctctacccctccagtcgatgtcctgcctgcggtcatagactataccttcttgacctcctgccgttgcttagcttcatccttttgcgtggaaaatgtcgctattgccgagaaagtatcccggctcaatatttactggtggaaataattacccctattctctggatgctggtttttctaaaatggggattctctatgcaaacatttagcggggtggtattaaccgccatcctggtagccgctgcttttaccgacataaataagggtattatccctgatactttaagcctcaccgggcttttattgggtttaggcctgggttttgtcaccataggtattaagcaatcacttttgggagctgtgggttttggcctaatatttctttttatagctctaatctcccgtgggggtatgggtggaggggatataaaactggctgcgcttataggtgcatttactggattttcgggagccctaatggttattcttatctcatcctggctcgggggattatgggctgtagtgttattaatacagggccaggcagggcttaagacagctatcaagtttgctccctttctcgctatagccgcttggctggtatggatgtatcaaatagaattaataagtttttatagggacatgctttggagactttgctaa

SEQ ID NO: 106587 - protein, 250 aa, Syntrophomonas wolfei str. Goettingen
MYYYVLMAIFFLLLASFLNVVIYRLPRGESLLYPSSRCPACGHRLYLLDLLPLLSFILLRGKCRYCRESIPAQYLLVEIITPILWMLVFLKWGFSMQTFSGVVLTAILVAAAFTDINKGIIPDTLSLTGLLLGLGLGFVTIGIKQSLLGAVGFGLIFLFIALISRGGMGGGDIKLAALIGAFTGFSGALMVILISSWLGGLWAVVLLIQGQAGLKTAIKFAPFLAIAAWLVWMYQIELISFYRDMLWRLC

SEQ ID NO: 106588 - DNA, 792 bp, Syntrophobacter fumaroxidans MPOB
  CDS (1)..(792): transl_table=11
atgcccgttgtccttccgatgaccattcaacaggtgctggtgtttgtcgtcgggtgttgcctggggagcttcttcaacgtggtgatccaccgcctcccggccggcgaatccctcgtgcaccccggatcgcgctgtccgggctgccgtcgggaaattgcgttctacgacaacatcccgctgttgagttatgtgttgttgcgggggaagtgccggcactgcggcaagccgatcggcttgcgctacccgttcgtggaagccttgaccggtttgttcgcggtgttgctgttccgacggtacggctggcacgcgcagttcggaatcgagttcttcttcatctcgctgttgatcgtcatcacgtacatcgatctggacacgttcaagatttttgacttgttctccctgggaggattggtcgccggattcggcttctcgttcatttcgatccaggtcacgtgggaggagtcgctcgtcggcatcattctcggcggggggctgttctttctcatcgagaagggatatcagtggatacggcacgacgagggactgggccggggtgacgtctacctgctggccatgatcggcgcttacgtcggctgggccggggtggtgttcaccatcctggtggcttcggtgatcggggccgcggtcggcatgatcgccatgcgccgcgccaatgaggggctcaagacggccattccgttcggaccttttctctcgctcggagcgatcggctacatatttttcggccacagcttttacgcctggtatctgggagaccttctcggaatttag

SEQ ID NO: 106589 - protein, 263 aa, Syntrophobacter fumaroxidans MPOB
MPVVLPMTIQQVLVFVVGCCLGSFFNVVIHRLPAGESLVHPGSRCPGCRREIAFYDNIPLLSYVLLRGKCRHCGKPIGLRYPFVEALTGLFAVLLFRRYGWHAQFGIEFFFISLLIVITYIDLDTFKIFDLFSLGGLVAGFGFSFISIQVTWEESLVGIILGGGLFFLIEKGYQWIRHDEGLGRGDVYLLAMIGAYVGWAGVVFTILVASVIGAAVGMIAMRRANEGLKTAIPFGPFLSLGAIGYIFFGHSFYAWYLGDLLGI

SEQ ID NO: 106590 - DNA, 861 bp, Nitrosomonas eutropha C71
  CDS (1)..(861): transl_table=11
atgaatatttttaataccctgcaagcttcaccagctttttttatttcatttatctcgcttattggcctgattctgggaagtttcctgaatgtagtgatttacaggttgcccgtgatgttaaaacgtgaatggatgcaacaatgtgctgagttgcgtggggagcaggtaaaagtactgccggcgtataacctggctataccaggctccggttgttcacagtgtggtcataaaatttccgtcctcgaaaatattccgattatcagctaccttcttttgcgcggacactgttcaagttgccaggctcgtattccatttgattatccactggttgaggctctgacagctattctaagcggttttgctgcgtggcattttggttttagtgggattttacttgctgcgctgatttttatttgggcaatgattattttgacatttattgatctgaatacccagcttttaccagatagtattacacagccgctgttatgggcaggcctgatcgtgaatctgcataatggttttgtagatatccattcagctgttatcggtgcggttgcaggttacctgacactctggagtgtgtactggctgttcaaactgattaccggtaaggaaggcatggggtatggtgatttcaagttgctggctgcagtcggtgcctggttgggttggcaattactgccactggtaatcttgctttcttctgtgatgggggctgctattggtaccatcctgatcctggccgctaatcgttcaaaaggtacaacacttccctttggtccttatctggcaggaggaggattaattgctttgttctggggcagtcagatcaatcaggcatacctggccatgttttga

SEQ ID NO: 106591 - protein, 286 aa, Nitrosomonas eutropha C71
MNIFNTLQASPAFFISFISLIGLILGSFLNVVIYRLPVMLKREWMQQCAELRGEQVKVLPAYNLAIPGSGCSQCGHKISVLENIPIISYLLLRGHCSSCQARIPFDYPLVEALTAILSGFAAWHFGFSGILLAALIFIWAMIILTFIDLNTQLLPDSITQPLLWAGLIVNLHNGFVDIHSAVIGAVAGYLTLWSVYWLFKLITGKEGMGYGDFKLLAAVGAWLGWQLLPLVILLSSVMGAAIGTILILAANRSKGTTLPFGPYLAGGGLIALFWGSQINQAYLAMF

SEQ ID NO: 106592 - DNA, 822 bp, Trichodesmium erythraeum IMS101
  CDS (1)..(822): transl_table=11
atggatttacttataatgtggcctctaactctaattgtatttcccctaggcgcatctattggtagctttctcaacgttgtcatttatcggatacctgcaggattatctattctgtggcctccatctcgatgtcccaaatgtcatagtagattaaaagctacagaaaatatccctatatttggttggctacggttgcgcggacgttgtggtcattgtcatagccctatttctattcgctatccaatagtagaattaattacagccttactatttttagttgtttttgggaaatttggaattactatctctaccctaggctactggtttttttttagttggttactggctttgtctatgattgacttggacactatgactctgcctaatcctttaactcaatcagggttaattgtaggtttgttttttcaaatgcttaccacatttgaagaaaattttcaagtaaataatctagtaaattatttgataataggtattattggagcggtagttggtctatggctttttgacttaatatctatatttggttccatagcttttgggcaaacagttatgggtggaggagatgccaaactagcagcgatgataggagcttggttgggctggaaatatttattattaacttgttttctggcctgtgctatgggagcacttgttggtggaggagcgatcgccttacgtttactagatcgacgacaaccaataccttttggaccatttttagcaatgggggctggtttaaccgttatctggggtgataatatactatctacttaccttaatcttttttttcctgggttctaa

SEQ ID NO: 106593 - protein, 273 aa, Trichodesmium erythraeum IMS101
MDLLIMWPLTLIVFPLGASIGSFLNVVIYRIPAGLSILWPPSRCPKCHSRLKATENIPIFGWLRLRGRCGHCHSPISIRYPIVELITALLFLVVFGKFGITISTLGYWFFFSWLLALSMIDLDTMTLPNPLTQSGLIVGLFFQMLTTFEENFQVNNLVNYLIIGIIGAVVGLWLFDLISIFGSIAFGQTVMGGGDAKLAAMIGAWLGWKYLLLTCFLACAMGALVGGGAIALRLLDRRQPIPFGPFLAMGAGLTVIWGDNILSTYLNLFFPGF

SEQ ID NO: 106594 - DNA, 768 bp, Pelobacter propionicus DSM 2379
  CDS (1)..(768): transl_table=11
atgacgtcacagttctattattccatcattgtctttatcttcggagccgtgaccggttcattcctcaatgtctgcatatgccgcatgccgaaggacgaatcggtcgtatcgcccccctcccattgcccaacatgcatgtaccggatccgctggtacgacaatattcccctggccagctatctgctgctccgcggcaggtgccgcggctgtggcatccgtatccccatccggtatccgctggtcgagctgggtaacgggctgctggcactggcgctctttctccgttacagcctttccccgacattcgctgccctgttcctgttctgttcggcgctgctggtgatcacctgcatcgatctggagtaccgggtcatcccgaacaagatatcattgccgggaatcgttatcggctttgtcctttcctttttcctcccctggcccgggtggctgaattcgctgctcggcattctggcggggggcggcagcctgctgctggtggcctgcgcctacgagtggctgaccggcagggaggggatgggaggaggcgacatcaagctggtggccatgatgggggcgttcctcggttgggaagccgtcccgttcatcatccttgccggctccctggccggtttgctggcagggggcctgccgatgctgatcaggaggcgagactccggccaggccattcccttcggcccgtaccttgctttcggagcgctgtttcacctcttcctcggtctcaggatactgaaccggtatcttgcgtag

SEQ ID NO: 106595 - protein, 255 aa, Pelobacter propionicus DSM 2379
MTSQFYYSIIVFIFGAVTGSFLNVCICRMPKDESVVSPPSHCPTCMYRIRWYDNIPLASYLLLRGRCRGCGIRIPIRYPLVELGNGLLALALFLRYSLSPTFAALFLFCSALLVITCIDLEYRVIPNKISLPGIVIGFVLSFFLPWPGWLNSLLGILAGGGSLLLVACAYEWLTGREGMGGGDIKLVAMMGAFLGWEAVPFIILAGSLAGLLAGGLPMLIRRRDSGQAIPFGPYLAFGALFHLFLGLRILNRYLA

SEQ ID NO: 106596 - DNA, 786 bp, Pelobacter propionicus DSM 2379
  CDS (1)..(786): transl_table=11
atgacgccgcagctcttgttttcggtcttttcctttattcttggcgctgttgtcggctccttcctcaatgtctgcatctgccgcatgccgcgggacgagtcggtcgtatcgcccccctcccactgtccggggtgtggctaccggattcgttggtacgacaatattccgctggtaagctacctgctgctgcgcggcaggtgccggggctgccgggaaaagatatccccccgctaccctctggtggagttgctcaacgcccttctgtctctggcgctttttctccgcttcgggccgactctcgcgtttgctgtcctgttcctcttctgttccgcgctggttgtcataacctttatcgacctggagcatcagattattcccgacgagatatccctgcccggtatcgtgctcggtttcatcttttctttcttcctcagggggcacggctggctgaactcgcttttgggcatacttctgggaggggggagcctgctgttggtggcctacggttaccagttggtgaccggcaaggaggggatggggggcggtgatatcaagcttttggccatgatgggggcttttctggggtggaaatccatcccgttcatcatcttcgtcagttcgctggccggctcggtgatcggcgtttccctgatgctgatccagaagaaagattcgaagctggccattccctttggcccctatctcgccctgggcgccctgctgtacgttttttacggcccccgtctgatcagctggtacctcaccctgggtggtctccaggggtaa

SEQ ID NO: 106597 - protein, 261 aa, Pelobacter propionicus DSM 2379
MTPQLLFSVFSFILGAVVGSFLNVCICRMPRDESVVSPPSHCPGCGYRIRWYDNIPLVSYLLLRGRCRGCREKISPRYPLVELLNALLSLALFLRFGPTLAFAVLFLFCSALVVITFIDLEHQIIPDEISLPGIVLGFIFSFFLRGHGWLNSLLGILLGGGSLLLVAYGYQLVTGKEGMGGGDIKLLAMMGAFLGWKSIPFIIFVSSLAGSVIGVSLMLIQKKDSKLAIPFGPYLALGALLYVFYGPRLISWYLTLGGLQG

SEQ ID NO: 106598 - DNA, 843 bp, Rhodoferax ferrireducens DSM 15236
  CDS (1)..(843): transl_table=11
atgctggtggcaacatggtttgacgccaccgtgctgggcgttctgggcttgttgattggcagctttctcaacgtggtgatttaccggttaccggtcatgctggaagcgcagtggaaagccgagtgcgccgaaatgaccggtaaagaaacgacgtcggcagagaagttcaatctggccgtacctcgctcgcgctgcctgaagtgcgaccatcaaatccagtggtatgaaaacattccggtgttcagctatctctttttacggggaaaatgttcaaactgcaaggctcccatcagcttgcgttaccccttggtggagctggcaacggctgccctgtttgtttattgcggctggaaatggggcgccacacccactgctctggtctggtgcggtttcggtgccaccatgctggcgttgggctgcatcgactgggacaccacgctgttgccggatgacatcaccctgccgctgctctgggcgggcttgattgccgccgcgctgcaatggacacccgtcgcgctgccagaggcgctttggggcgctgtggcgggctatgtgtcactgtggctggtttattgggccttcaagctcgtgaccggcaaggaaggcatgggttttggcgacttcaagctgtttgctgcactgggtgcctggttcggctggcaggcgctggtgcccatcattttgatggcttcggtgattggcgcggtgattggcattgccatgaaattctccagcgggttgcgtgaaggtggctacattcctttcgggccttttctggtcggcgccggcctgactgcgatgatttttggccccggctcgattcttcgcgcgtttgggctctag

SEQ ID NO: 106599 - protein, 280 aa, Rhodoferax ferrireducens DSM 15236
MLVATWFDATVLGVLGLLIGSFLNVVIYRLPVMLEAQWKAECAEMTGKETTSAEKFNLAVPRSRCLKCDHQIQWYENIPVFSYLFLRGKCSNCKAPISLRYPLVELATAALFVYCGWKWGATPTALVWCGFGATMLALGCIDWDTTLLPDDITLPLLWAGLIAAALQWTPVALPEALWGAVAGYVSLWLVYWAFKLVTGKEGMGFGDFKLFAALGAWFGWQALVPIILMASVIGAVIGIAMKFSSGLREGGYIPFGPFLVGAGLTAMIFGPGSILRAFGL

SEQ ID NO: 106600 - DNA, 717 bp, Escherichia coli
  CDS (1)..(717): transl_table=11
atgttggagaggcggtggcggcgtgaagcgctgacgctattggcacattctgtgcctgagtccgggccggcctttaacctgatgataccgcagtctcattgtccctgctgttttcatccgctcggcatcagggataacattcccctgttaagctacctatttctgaaggggaaatcacgctgttgtggcgagcgtattcccgtttactacccgctagtcgaaataacgaactcagtgttattcattctggccgcgagcaggtttccaccagggctgacattagcggctgcctggctttttatttccatgctgttggttctggcggttattgactgccatacggcgctgctgccggatgtgctgacgttgccattgctctggcttggcctgttattcagtttacagagaagcgttgtcaccttagaggaggcggtagtgggggcggtatctgggtatctctgtctgtggggactgtactggctttttcgtttcgctaccgggagggaagggttaggttacggtgattttaagctagctgcggcattgggagcatggatgggttggcaggcattaccctcaatacttttgtttgcctcagtcagtgggttaatcgtaacagtactgttgcgtattgtaacagctacggactttacccgcccgctgccttttgggccgtggctcgctttgagcggagtgtgccattttttgttgatgtag

SEQ ID NO: 106601 - protein, 238 aa, Escherichia coli
MLERRWRREALTLLAHSVPESGPAFNLMIPQSHCPCCFHPLGIRDNIPLLSYLFLKGKSRCCGERIPVYYPLVEITNSVLFILAASRFPPGLTLAAAWLFISMLLVLAVIDCHTALLPDVLTLPLLWLGLLFSLQRSVVTLEEAVVGAVSGYLCLWGLYWLFRFATGREGLGYGDFKLAAALGAWMGWQALPSILLFASVSGLIVTVLLRIVTATDFTRPLPFGPWLALSGVCHFLLM

SEQ ID NO: 106602 - DNA, 456 bp, Pseudomonas putida
  CDS (1)..(456): transl_table=11
atgtggtgcctgctggccctgagcctgatcgatgcggaccaccagttgctgccggatgcgctggtgctgccgatgctgtggctggggcttatcgtcaatgcctttggcatctatgccccactgaccgacgcgctgtggggcgcggtggccggatacctcagcttgtggaccgtgtactggctgttcaagctgatcaccggcaaggaaggcatgggctatggcgatttcaagctgatggcgctgatcggggcctggggtggctggcaggtgctgccgttgacgctgctgctgtcgtcggtggtgggggcgctggttggcctgtgcttgctgcgtttgcgccggcatgcgatggggacagcgataccgtttggcccttatctggcgattgcggggtggattgctgtgctctggggtgatgaaatgtacgcctcttacatgcaactgcttggatactga

SEQ ID NO: 106603 - protein, 151 aa, Pseudomonas putida
MWCLLALSLIDADHQLLPDALVLPMLWLGLIVNAFGIYAPLTDALWGAVAGYLSLWTVYWLFKLITGKEGMGYGDFKLMALIGAWGGWQVLPLTLLLSSVVGALVGLCLLRLRRHAMGTAIPFGPYLAIAGWIAVLWGDEMYASYMQLLGY

SEQ ID NO: 106604 - DNA, 903 bp, uncultured bacterium
  CDS (1)..(903)
atggacgaaaacctgcaggccttgaacgcgcttctggcggtcttctcgtttgttctgggaagcatgatcgggagttttctcaacgtatgcgtgtaccggttgccgcgcgggctgtcggtcgtcaagccccgctcgaaatgcccgaagtgcgacaatcccatcgcatggtacgacaacatccctgtcgtgagctggctcgtgctgggcgccaagtgccgccattgcggccagcccatcagttggcaatatcccctggtggaagcgatcacgggcgtgttgtttctgctggtgttctggcgttttggcatcgccatcgccacgccgatttacatgctgctctcggccgcgctcgtgctcgtcacgttcgtcgacctgacggactggaccatccccgacgaggtcacgctgcccggcattccggtggggattgcgacgtcggtgttgtttatgctctacccgaaaagcggcctggcggtcatggggccttttgaaatgcccgtgttcaactccctgctcggggtggtcgtgggcgggggcgtgctgtacgccctcgacaagggcgccctgctcctgctcaagaaacccggcatgggcttcggcgacgtcaagctgaacgccatgctcggcgcatttttcgggctgtacggcgcgattctgatcatcgtcatcgccgcgttcatcgggagttttgtcggcatcctcatgatcctggccggaaaacgcaacccggcgccgggcggcccaaccgaggattccggcgaggaaccggccggccggcccgcatcagggcactatcttccctttggcccctatctggcgctcgcgggcgtcatcgtcatgctggccggaccggccatcattggcttctacttcaataccctgcttgcgccgccctcgttgtga

SEQ ID NO: 106605 - protein, 300 aa, uncultured bacterium
MDENLQALNALLAVFSFVLGSMIGSFLNVCVYRLPRGLSVVKPRSKCPKCDNPIAWYDNIPVVSWLVLGAKCRHCGQPISWQYPLVEAITGVLFLLVFWRFGIAIATPIYMLLSAALVLVTFVDLTDWTIPDEVTLPGIPVGIATSVLFMLYPKSGLAVMGPFEMPVFNSLLGVVVGGGVLYALDKGALLLLKKPGMGFGDVKLNAMLGAFFGLYGAILIIVIAAFIGSFVGILMILAGKRNPAPGGPTEDSGEEPAGRPASGHYLPFGPYLALAGVIVMLAGPAIIGFYFNTLLAPPSL

SEQ ID NO: 106606 - DNA, 810 bp, Escherichia coli
  CDS (1)..(810): transl_table=11
atgttttttgatgtttttcagcaataccccgcggcgatgcccgtcctggctaccgtcggaggattgattatcggcagttttttgaatgtggtgatttggcgttaccccatcatgctgcgccaacaaatggcggagtttcacggtgaaatgccgagtacgcagtcaaaaataagccttgcgctaccgcgttcgcactgtccgcattgccagcagaccatccgcgttcgtgacaatattccgctgctctcatggttgatgctcaaagggcgctgccgcgactgtcaggcgaaaatcagcaagcgttatccgctggttgagttattgacagcactcgcttttttgctagcgagtctggtgtggccagaaagtggatgggggctggcggtgatgatattatccgcctggctgattgccgcgagcgtcattgacctcgacaaccaatggctgcccgatgtttttactcagggcgtattgtggaccgggctgattgcagcatgggcgcaacagagtccgttaacgctacaagacgcagttaccggcgtactggtgggatttatcactttttactccctgcgctggatagccggaatagttctgcgtaaagaagcattaggcatgggcgatgtattactcttcgctgcgttaggtggctgggtgggggcattatcactgcccaatgttgctttaatcgcctcatgctgcggcctgatatatgccgttattacaaaaagaggatcaaccacactgccttttggaccgtgtttaagtctgggcggtatagcaacactttatctacaggcattgttttaa

SEQ ID NO: 106607 - protein, 269 aa, Escherichia coli
MFFDVFQQYPAAMPVLATVGGLIIGSFLNVVIWRYPIMLRQQMAEFHGEMPSTQSKISLALPRSHCPHCQQTIRVRDNIPLLSWLMLKGRCRDCQAKISKRYPLVELLTALAFLLASLVWPESGWGLAVMILSAWLIAASVIDLDNQWLPDVFTQGVLWTGLIAAWAQQSPLTLQDAVTGVLVGFITFYSLRWIAGIVLRKEALGMGDVLLFAALGGWVGALSLPNVALIASCCGLIYAVITKRGSTTLPFGPCLSLGGIATLYLQALF

SEQ ID NO: 106608 - DNA, 846 bp, Citrobacter rodentium
  CDS (1)..(846): transl_table=11
atggacgaattttttaccccctggtatccgtggctggcgctgatgctgggcttactgatcggcagctttttaaacgtggtgatttaccgtctgccgctgatgatacttcgcgacgctgtggatgacgcggagcgtgaccgtctacctaacgtcaatttatggtggccgccgtcccactgtccacgctgccagcggaatatcctgccgtgggataatattcccgtggtgagctggctgctgttaaggggaaagtgccgtcactgccgctgcgcgatcccttttatctatccgcttagtgaagctgcaatcggcgccgtgttctgggcgctggtctgttatctgtacccacagtacagccttgtccagcttgcttttttcgctttctttctctgcctgctctatgcgctggcggttatcgatctcaacacttttttgctgccggacagtctggtttatctgttgctgtggggcggactgattgcttcggtccgcaaccttattccggtatctccgcgcgacagcgtcatcggcgccgccatgatctggagctttacctggctgatggcggagggatttcagcggatcgttgggcgcgaagggttcggcaagggggatgttaagctatttgccgcctgtgccgcctggctgggtacgacccacattgccgttctgatgctgggttccgcgctgctgggactctgtttttttctgctgcgcttcggctatctccgtatctgcaaacgcgcgccgcgtagcgacctggctgaaaaagggtattttccttttggcccggcgattgttctgatggcggtctggctgatgtatgtggaggtgcttcatttatga

SEQ ID NO: 106609 - protein, 281 aa, Citrobacter rodentium
MDEFFTPWYPWLALMLGLLIGSFLNVVIYRLPLMILRDAVDDAERDRLPNVNLWWPPSHCPRCQRNILPWDNIPVVSWLLLRGKCRHCRCAIPFIYPLSEAAIGAVFWALVCYLYPQYSLVQLAFFAFFLCLLYALAVIDLNTFLLPDSLVYLLLWGGLIASVRNLIPVSPRDSVIGAAMIWSFTWLMAEGFQRIVGREGFGKGDVKLFAACAAWLGTTHIAVLMLGSALLGLCFFLLRFGYLRICKRAPRSDLAEKGYFPFGPAIVLMAVWLMYVEVLHL

SEQ ID NO: 106610 - DNA, 798 bp, Yersinia enterocolitica
  CDS (1)..(798): transl_table=11
atgatggatacattgtatgctatccaaacaatcgctccgctttggtggagcagtctggccttactgggtctgtgtgtcggcagttttctcaatgtggtcatctatcgcctgccactgatgttaaccggtgcgcagcaagatgacttcaacctctgcctacctcactcccattgcccaaagtgccaaacccaactgaaatggcgagataatattccactgttcagttggatttggttacaggggcaatgccgttactgtcagattgcaattccagtgcgctacccgctggtcgaagtgatgaccatgttggtgacattattgattgccaccaccattccatttggcagcccattgctggctgcgctgttactcagttggacgttgatagcgcttaccatgatcgatatcgatcatttactactaccagataacctgacattaccgctgctgtgggccggattattattccatctgtttgacgatatattgcctttaagtgacgccgtcattggcgcagtgagtggatatttgattttatggagtctttactgggcattttggtgggttacccggcgggaagttctcggttatggagattttaaattattggctgcattaggagcatggttgggatggatggcgctgccttctttactgctaactgcttcactaaccggtatcgctttcgcactgatttttcgcttgcttaggaagcggccactgaacaccgcgctccccttcgggccgtttctcgcattcagtggctggcttttatttctacaacagtacatccaataa

SEQ ID NO: 106611 - protein, 265 aa, Yersinia enterocolitica
MMDTLYAIQTIAPLWWSSLALLGLCVGSFLNVVIYRLPLMLTGAQQDDFNLCLPHSHCPKCQTQLKWRDNIPLFSWIWLQGQCRYCQIAIPVRYPLVEVMTMLVTLLIATTIPFGSPLLAALLLSWTLIALTMIDIDHLLLPDNLTLPLLWAGLLFHLFDDILPLSDAVIGAVSGYLILWSLYWAFWWVTRREVLGYGDFKLLAALGAWLGWMALPSLLLTASLTGIAFALIFRLLRKRPLNTALPFGPFLAFSGWLLFLQQYIQ

SEQ ID NO: 106612 - DNA, 690 bp, Actinobacillus actinomycetemcomitans
  CDS (1)..(690): transl_table=11
atgatgtggctactttttctgcttggcggtgtgctttgtggctggcgcgtttatcattacgtagaacatttcgccgataacctcagccgcgaggttcatgccgcctacacggaaatttacccgcaaaacccaccgcactttacggcggaaaactcggttctaaaaccgcttaaacggcatttttccgcacatctttacagccttttattcaccttgctgttcatgatttgttatgccatcaatgaaccgttacaagccctttgttttgcactgtatggcgccttattaatcgtcatttctttggtggattggcactatcgcctgatttcacccgccttatgccaagccttgttcgctctcggtttaggcgcggcatactggcaactcggcacattaacattggcgcaaagcctgcaaagtgcggtcatttttttcggtgttttttatgccatctaccacgccgcaaaatggtactaccgacaagaagctctcggacgcggcgattattggctggcactgggcttaggcgtttttctaccggcacaacaacttcccgtttttttattcctcgcctgctttttcggcttactttatgccgcctacgcaaaataccaacaccgcacactcaacaccatgcctttcggtccctttatgtccctagccggcgtggtctgtttattgcttaattaa

SEQ ID NO: 106613 - protein, 229 aa, Actinobacillus actinomycetemcomitans
MMWLLFLLGGVLCGWRVYHYVEHFADNLSREVHAAYTEIYPQNPPHFTAENSVLKPLKRHFSAHLYSLLFTLLFMICYAINEPLQALCFALYGALLIVISLVDWHYRLISPALCQALFALGLGAAYWQLGTLTLAQSLQSAVIFFGVFYAIYHAAKWYYRQEALGRGDYWLALGLGVFLPAQQLPVFLFLACFFGLLYAAYAKYQHRTLNTMPFGPFMSLAGVVCLLLN

SEQ ID NO: 106614 - DNA, 810 bp, Escherichia coli
  CDS (1)..(810): transl_table=11
atgctttttgatgtttttcagcaataccctgcggcgatgcccgtcctggcaaccgtcggaggattgatcatcggcagttttttgaatgtggtgatttggcgttaccccatcatgctgcgccaacaaatggcggagtttcatggtgaaatgccgagtgtgcagtcaaaaataagccttgcgctaccgcgttcgcactgcccacattgtcagcagaccatccggatacgtgacaatattccgctgctctcctggctgatgctcaaagggcgctgccgtgattgtcaggcgaaaatcagcaagcgttatccgttggtggagttattgacggcactcgcttttttgctggcgagtctggtctggccggaaagtggatgggcgctggcggtgatgatattatccgcctggctgattgccgcgagcgtcattgacctcgatcaccaatggctgcccgatgtttttactcagggcgtattgtggacgggactgattgcggcatgggcgcagcagagcccgctcacgctacaagatgcagttaccggcgtcctggtggggtttatcgctttttactccctgcgctggatagccggaatagttctgcgtaaagaagcattaggcatgggcgatgtattattgttcgctgcgttaggtagttgggtgggcccgttatcactgcccaatgttgctttaatcgcatcatgctgcgggctgatatatgccgttattacaaaaagaggatcaaccacactgccttttggaccgtgtttaagtctgggcggtatagcaacaatttatctacaggcattgttttaa

SEQ ID NO: 106615 - protein, 269 aa, Escherichia coli
MLFDVFQQYPAAMPVLATVGGLIIGSFLNVVIWRYPIMLRQQMAEFHGEMPSVQSKISLALPRSHCPHCQQTIRIRDNIPLLSWLMLKGRCRDCQAKISKRYPLVELLTALAFLLASLVWPESGWALAVMILSAWLIAASVIDLDHQWLPDVFTQGVLWTGLIAAWAQQSPLTLQDAVTGVLVGFIAFYSLRWIAGIVLRKEALGMGDVLLFAALGSWVGPLSLPNVALIASCCGLIYAVITKRGSTTLPFGPCLSLGGIATIYLQALF

SEQ ID NO: 106616 - DNA, 1065 bp, Thermus thermophilus
  CDS (1)..(1065): transl_table=11
atgtggcccctcttcgccctgctcctcggcctcgcggtgggttcctttctcaacgtggtggtccaccgcctgccccggggggagtccgtcgcctaccccccgtcccgctgcccccagtgcggccaccgcctggggccttgggacctggtccccgtcctctcctacctcgccctaaaggggcggtgccgctactgcgcccgtcccatctccccccgctaccccctggtggaggccctcacgggggggctttttctcctcgcaagcctcttctacccccctggggtggaggccctcttggtcttcctcttcctcgcctttctcgtggccctcgccttcattgacgtggacacctttgagcttcccgatcccctcacctacggcctcctcttccttgggcttttggcctcctgggcgctggccttccccctcccctttagggagagcctggacggaagcctcatggccgccggggggctcgccctggtggcggggtacgggaacctctttctgcggcgctttagggaggccagggccgaggtccccgtggggccccaccaggtccaatcggcggccctctttggggcgctcttgggcccaggggtggggatggccctcgccttcctcgcttgggccctctccgcccgcacggggcggcccgtggtcctccccgaccggctcaccctgccccttttgcccctcgccttcctccttgcccccgccctgggcctggacttcctggaaagccttaagggaagcctcctcgccgccgggggcctggccctcgccggggggctctactgggccttccggccccttcccgaggaggaagaggagcccgtggccatgggctacggggacgtgaagctcttgggggccctcggggcctggcttggcccttacgccttcctcgccctcttcctcggggtcttcgccggggcgcttttgggccttctccttaggcaaaggaagctccccttcggcccctacctcgccctcgggggggtggtggccttcttcttcggggaggccctctggggggcgtacctgcgccttctgggcgtttga

SEQ ID NO: 106617 - protein, 354 aa, Thermus thermophilus
MWPLFALLLGLAVGSFLNVVVHRLPRGESVAYPPSRCPQCGHRLGPWDLVPVLSYLALKGRCRYCARPISPRYPLVEALTGGLFLLASLFYPPGVEALLVFLFLAFLVALAFIDVDTFELPDPLTYGLLFLGLLASWALAFPLPFRESLDGSLMAAGGLALVAGYGNLFLRRFREARAEVPVGPHQVQSAALFGALLGPGVGMALAFLAWALSARTGRPVVLPDRLTLPLLPLAFLLAPALGLDFLESLKGSLLAAGGLALAGGLYWAFRPLPEEEEEPVAMGYGDVKLLGALGAWLGPYAFLALFLGVFAGALLGLLLRQRKLPFGPYLALGGVVAFFFGEALWGAYLRLLGV

SEQ ID NO: 106618 - DNA, 810 bp, Escherichia coli
  CDS (1)..(810): transl_table=11
atgctttttgatgtttttcagcaataccccgcggcgatgcccatactggcaaccgtcggaggattgatcatcggcagttttttgaatgtggtgatttggcgttaccccatcatgctgcgccaacaaatggcggagtttcatggtgaaatgccgagtgcgcagtcaaaaataagccttgcgctaccgcgttcccactgcccacattgtcagcagaccatccggatacgtgacaatattccgctgctctcctggctgatgctcaaagggcgctgccgtgattgtcaggcgaaaatcagcaagcgttatccgctggtggagttattgacggcactcgcttttttgctggcgagtctggtctggccggaaagtggatgggcgctggcggtgatgatattatccgcctggctgattgccgcgagcgtcattgacctcgatcaccaatggctgcccgatgtttttactcagggcgtattgtggacgggactgattgcggcatgggcgcagcagagcccgctcacgctacaagatgcagttaccggcgtcctggtggggtttatcgctttttactccctgcgctggatagccggagtagttctgcgtaaagaagcattaggcatgggcgatgtattattgttcgctgcgttaggtagttgggtggggccgttgtcgctacccaatgttgctttaatcgcatcatgctgcggcctgatatatgccgttattacaaaaagaggatcaaccacactgccttttggaccgtgtttaagtctgggcggtatagcaacaatttatctacaggcattgttttaa

SEQ ID NO: 106619 - protein, 269 aa, Escherichia coli
MLFDVFQQYPAAMPILATVGGLIIGSFLNVVIWRYPIMLRQQMAEFHGEMPSAQSKISLALPRSHCPHCQQTIRIRDNIPLLSWLMLKGRCRDCQAKISKRYPLVELLTALAFLLASLVWPESGWALAVMILSAWLIAASVIDLDHQWLPDVFTQGVLWTGLIAAWAQQSPLTLQDAVTGVLVGFIAFYSLRWIAGVVLRKEALGMGDVLLFAALGSWVGPLSLPNVALIASCCGLIYAVITKRGSTTLPFGPCLSLGGIATIYLQALF

SEQ ID NO: 106620 - DNA, 786 bp, Acetobacter diazotrophicus
  CDS (1)..(786): transl_table=11
atgctgcatctacccgtccttcccctgctcctgtcccccttcatcggctctttcctgggggtgctggccgcgcgcctgccccgcaggctgccggtggcgctggcccggtcggcctgcccgcgctgcggggccgtgctgcgcccgcgcgaactggtgcccgtcgtcagctatctggtgcagaagggacggtgccggtcctgcggcggcgccatttcggccgggcatcccgccatggaagtggcggcgctgctggtcgcgggcctggtcctgctggccgccggtccgttgcgcgccggcacgccggccccgttgctggtggtctggagcggctgcctgttcgggtggtggctgctggtgctggccgcgatcgacctgaaaagcttccgcctgcccgacacgctgacagtgccgttgatcgcggccgggctggggctggcggccctggggggtgccgcgccggtgctgtggcacgccctggcggcggcggcggggtacggcgtctttcgcgggatttcgcttctgtatcgccgggcgcgcggccatgatgggctcggcgggggcgatgccaagctgctggccgccgggggggcgtggctcggtcccgaatccctgccgcatgtcgtcttcctgggggccgtgttgacgctgtgcgcggtcgcgatcgcccggcgtggtgatgtgaatcgcacgctgatggtcccgttcgggccgggactggcgctggcgatgtggggaatctggctgtggcaggccagcctgctccggccggactggctgcccgcatga

SEQ ID NO: 106621 - protein, 261 aa, Acetobacter diazotrophicus
MLHLPVLPLLLSPFIGSFLGVLAARLPRRLPVALARSACPRCGAVLRPRELVPVVSYLVQKGRCRSCGGAISAGHPAMEVAALLVAGLVLLAAGPLRAGTPAPLLVVWSGCLFGWWLLVLAAIDLKSFRLPDTLTVPLIAAGLGLAALGGAAPVLWHALAAAAGYGVFRGISLLYRRARGHDGLGGGDAKLLAAGGAWLGPESLPHVVFLGAVLTLCAVAIARRGDVNRTLMVPFGPGLALAMWGIWLWQASLLRPDWLPA

SEQ ID NO: 106622 - DNA, 873 bp, Pseudomonas fluorescens
  CDS (1)..(873): transl_table=11
atgcccctgagcgaattcttcgtgctgtatcccctggctttcgtgctcgttgcagcattgctcggcctgatcatcggcagcttcctcaacgtgctggtgtggcgcctgccgaagatgctcaaccgcgaatggcgcctgcaggcccacgacctgctgggcctgccggccgaaaccccgggcccggtctacaacctgatgctgccccactcccagtgcccgcactgcggccatcgcatccgcccctgggaaaacattccgctgctcagctacctgatactgcgcggccggccgctgttcgagctgcgccgcgcccatcggaggcgttaccccctgaccgaattggcctgcggcgcgttatcggcgttcgtcgcctggcatttcggttttggctggcacgccgcgatggtgatggtgttgacctggggcctgctggccatgagcctgatcgacgccgagcatcaattgctgcccgataccctggtgctgccgctgttgtggctgggcttgatcatcaacagcttcgggctcttcgtgtccttgaaccaggcgatgtggggcgcggtggccggctacctggcgctgtggtcggtgttctgggtgttcaagctgatcaccggcaaggaaggcatgggctatggggatttcaagctgctggcgatgctcggcgcctggggtggctggcagatcctgccgctgacgctgctgctgtcgtcgttggtcggcgccgttattggggcgattgtgctgcgcttgcgtgatgccccggggtcgacgcagatcccctttggaccttatctggccattgccggctggattgccttgctctggggtggtcaaataaccgacttctattggcagtctgtcggtttttaa

SEQ ID NO: 106623 - protein, 290 aa, Pseudomonas fluorescens
MPLSEFFVLYPLAFVLVAALLGLIIGSFLNVLVWRLPKMLNREWRLQAHDLLGLPAETPGPVYNLMLPHSQCPHCGHRIRPWENIPLLSYLILRGRPLFELRRAHRRRYPLTELACGALSAFVAWHFGFGWHAAMVMVLTWGLLAMSLIDAEHQLLPDTLVLPLLWLGLIINSFGLFVSLNQAMWGAVAGYLALWSVFWVFKLITGKEGMGYGDFKLLAMLGAWGGWQILPLTLLLSSLVGAVIGAIVLRLRDAPGSTQIPFGPYLAIAGWIALLWGGQITDFYWQSVGF

SEQ ID NO: 106624 - DNA, 690 bp, Actinobacillus actinomycetemcomitans
  CDS (1)..(690): transl_table=11
atgatgtggctactttttttgcttggtggcgcactatgcgggtggcgtgttcatcgttatgtagaacatttcgccgataacctcagccgcgaggttcatgccgcctacacggaaatttacccgcaaaacccaccgcactttacagcggaaaagtcgattctgaaaccgcttaaacggcatttttccgcgcccctttacagccttttattcaccttgctgttcattatttgttatgccatcaatgaaccgttacaagccctatgctttgccctttatggcgccttattaattgccatttccctagtggattggcactatcgcttgatttcacccgccttatgccaagccttgtttaccctcggtttaggcgcggcatactggcaaatcggcacattaacattggagcaaagcctgcaaagtgcggttgtttttttcggtgttttttatgccatctaccacgccgcaaaatggtactaccgacaagaagctctcggacgcggcgattattggttggcactgggcttaggcgtttttctcccggcacaccaatttcctgtttttttattcctcgcctgctttttcggcttactttatgctgcctacgccaaataccaacatcgcacactcaacgccgtgcctttcggtccctttatgtccctagccggcgtggtctgtttattgcttaattga

SEQ ID NO: 106625 - protein, 229 aa, Actinobacillus actinomycetemcomitans
MMWLLFLLGGALCGWRVHRYVEHFADNLSREVHAAYTEIYPQNPPHFTAEKSILKPLKRHFSAPLYSLLFTLLFIICYAINEPLQALCFALYGALLIAISLVDWHYRLISPALCQALFTLGLGAAYWQIGTLTLEQSLQSAVVFFGVFYAIYHAAKWYYRQEALGRGDYWLALGLGVFLPAHQFPVFLFLACFFGLLYAAYAKYQHRTLNAVPFGPFMSLAGVVCLLLN

SEQ ID NO: 106626 - DNA, 822 bp, Escherichia coli
  CDS (1)..(822): transl_table=11
atgtatattgaaatcggcattttttttgcgctcttaattgttgggttgtgtattggaagttttttgaatgtggtcatttaccgtattccaattactcttctcaatgctaatgaaaaagtgtttaacattgcatggccaccttcgcattgtacacactgtgggaataatattctcaaaagagataatattccagtaattagctggtttatgttaagaggtcggtgccgattttgtggtagcgtgatttcctcacgctacccgtttgtagagtttattacaggactcattttttccgttttaggtacatatatgttttttatcgcagataaaaacatatatgttgtatcattaattctttttcttttttcaatacttctttgtcttgctgttattgattttgaccatttgctattgccagacagtcttgtttatatcatgctttggggggggctcttggctgcggcatttgagttatcacccataaccttaaaagatgctgtcattagtatatgtggaacatggataactctcagtacgattgttcagttatttatttttatccgtaaaaaggagggattgggagcaggtgatattaagcttatatgcgctttggctgcttggataggctggtataatattccttttttacttgtaatatcttctatcattggtggtgttatgtttatcaatattaaacgaagatttgattgtggctacgatgggaatataaaaaactgccacgtgataccttttggcccggcaatttccatttctgggtttgttatatatttattcatcgctaatgggtacgatgttctctag

SEQ ID NO: 106627 - protein, 273 aa, Escherichia coli
MYIEIGIFFALLIVGLCIGSFLNVVIYRIPITLLNANEKVFNIAWPPSHCTHCGNNILKRDNIPVISWFMLRGRCRFCGSVISSRYPFVEFITGLIFSVLGTYMFFIADKNIYVVSLILFLFSILLCLAVIDFDHLLLPDSLVYIMLWGGLLAAAFELSPITLKDAVISICGTWITLSTIVQLFIFIRKKEGLGAGDIKLICALAAWIGWYNIPFLLVISSIIGGVMFINIKRRFDCGYDGNIKNCHVIPFGPAISISGFVIYLFIANGYDVL

SEQ ID NO: 106628 - DNA, 834 bp, Escherichia coli O157
  CDS (1)..(834): transl_table=11
gtgagtagtttgccggaatttgcggttgattatcccttgttgtggctcatctgcaccggagggctggggggcgttaccggcagttttcttaacgtcgtgattcatcgtctgccgataatgttggagaggcggtggcggcgtgaagcgctgacgctattggcacattctgtgcctgagtccgggccggcctttaacctgatgataccgcagtctcattgtccctgctgttttcatccgctcggcatcagggataacattcccctgttaagctacctatttctgaaggggaaatcacgctgttgtggcgagcgtattcccgtttactacccgctagtcgaaataacgaactcagtgttattcattctggccgcgagcaggtttccaccagggctgacattagcggctgcctggctttttatttccatgctgttggttctggcggttattgactgccatacggcgctgctgccggatgtgctgacgttgccattgctctggcttggcctgttattcagtttacagagaggcgttgtcaccttagaggaggcggtagtgggggcggtatctgggtatctctgtctgtggggactgtactggctttttcgtttcgctaccgggagggaagggttaggttacggtgattttaagctagctgcggcattgggagcatggatgggttggcaggcattaccctcaatacttttgtttgcctcagtcagtgggttaatcgtaacagtactgttgcgtattgtaacagctacggactttacccgcccgctgccttttgggccgtggctcgctttgagcggagtgtgccattttttgttgatgtag

SEQ ID NO: 106629 - protein, 277 aa, Escherichia coli O157
MSSLPEFAVDYPLLWLICTGGLGGVTGSFLNVVIHRLPIMLERRWRREALTLLAHSVPESGPAFNLMIPQSHCPCCFHPLGIRDNIPLLSYLFLKGKSRCCGERIPVYYPLVEITNSVLFILAASRFPPGLTLAAAWLFISMLLVLAVIDCHTALLPDVLTLPLLWLGLLFSLQRGVVTLEEAVVGAVSGYLCLWGLYWLFRFATGREGLGYGDFKLAAALGAWMGWQALPSILLFASVSGLIVTVLLRIVTATDFTRPLPFGPWLALSGVCHFLLM

SEQ ID NO: 106630 - DNA, 873 bp, Aeromonas hydrophila
  CDS (1)..(873): transl_table=11
atggcacttctcctcgagctggcacacggcttgccctggctctatttctcgctggtatttctcttttccctgatgatcggcagttttctcaacgtggtgatccatcgcctgcccatcatgctggaacgggagtggcaggccgaatatcgcagctacttcaaccctgatgacgagggggtcgacgagccgccctacaacctgatggtgccgcgatcctgctgcccccactgcaatcaccccatcacggcactggaaaacatccccctgctgagctggctctggctcaggggtcgctgccgaggctgccaggctcccatatcggcccgctatccgctggtcgagctgctgacggcgctgctctcggtagccgttgccatgacactcgcaccgggctggggcacgttggcggccctgctgctgacctgggtactggtggcactcaccttcatcgatctcgacaagatgctgctgccggaccagctcaccctgcccctgctgtggggcgggctgttgttcaatttgctgggcggttttgtatcgcttggcgatgcggtgatcggtgccatggccggttatctggtgctatggagcctctattgggccttcaagctgctcaccggcaaggagggcatgggctatggcgacttcaagctgctggccgcgctgggtgcctggctgggctggcaggcgctgcccatagtgctgctgctctcctccctggttggcgccttcatgggcataggcctgatcctgctgcgcaatcaccatcagagcaaacccattccctttggcccctatctcgccatcgcgggctggattgcgctgctgtggggcgatagcatcacccgctggtacctcacaaatttcctctga

SEQ ID NO: 106631 - protein, 290 aa, Aeromonas hydrophila
MALLLELAHGLPWLYFSLVFLFSLMIGSFLNVVIHRLPIMLEREWQAEYRSYFNPDDEGVDEPPYNLMVPRSCCPHCNHPITALENIPLLSWLWLRGRCRGCQAPISARYPLVELLTALLSVAVAMTLAPGWGTLAALLLTWVLVALTFIDLDKMLLPDQLTLPLLWGGLLFNLLGGFVSLGDAVIGAMAGYLVLWSLYWAFKLLTGKEGMGYGDFKLLAALGAWLGWQALPIVLLLSSLVGAFMGIGLILLRNHHQSKPIPFGPYLAIAGWIALLWGDSITRWYLTNFL

SEQ ID NO: 106632 - DNA, 876 bp, Aeromonas salmonicida
  CDS (1)..(876): transl_table=11
atgacacttcttctcgagctggcacacggcttgccatggctctacttctcgctggtttttctcttctccctgatgatcggcagctttctcaacgtggtgatccaccgcctgcccatcatgctggaacgggagtggcaggccgaatatcgcagctatttcagttcagacacgccgcagccagaagatgacgagcgctacaatctgatggtgccgcgctcctgctgccctcgctgcaatcaccccataacggccttggaaaacattcccctgctgagctggctctggctcaaaggtcgctgccggggctgccaggccgccatttcggctcgctatccgctggtggagctgctgaccgcgctgctctctgtggtggttgccatgacgctcacccctggctggggtacgctggctgccctcctgctgacctgggtgctggtggcgctcacctttatcgatctggacaagatgctgctgccggaccagctcaccttgccgctactgtggggcgggctgctgttcaacctgctgggcggatacgtgcctctcggcgatgctgtcatcggcgccatggcaggctatctggtgctgtggagcctctactgggccttcaagctgcttaccggcaaggagggcatgggctatggggacttcaaactgctggcagcgctgggagcctggcttggctggcaggcgctgcccatagtactgctgctctcttctctggtcggcgccatcttcggcattggcctcattttgctgcgcaaccatcaccagagcaaacccatcccctttggcccctatctcgccatcgcaggctggatcgcactgctctggggcgatagcatcacccgctggtatctctccactatcctctga

SEQ ID NO: 106633 - protein, 291 aa, Aeromonas salmonicida
MTLLLELAHGLPWLYFSLVFLFSLMIGSFLNVVIHRLPIMLEREWQAEYRSYFSSDTPQPEDDERYNLMVPRSCCPRCNHPITALENIPLLSWLWLKGRCRGCQAAISARYPLVELLTALLSVVVAMTLTPGWGTLAALLLTWVLVALTFIDLDKMLLPDQLTLPLLWGGLLFNLLGGYVPLGDAVIGAMAGYLVLWSLYWAFKLLTGKEGMGYGDFKLLAALGAWLGWQALPIVLLLSSLVGAIFGIGLILLRNHHQSKPIPFGPYLAIAGWIALLWGDSITRWYLSTIL

SEQ ID NO: 106634 - DNA, 861 bp, Bacteroides nodosus
  CDS (1)..(861): transl_table=11
atgcttatcagcgaattattacaaacgccattgggtatttttttcgtcggactgtttagtttgatggtgggcagttttctcaatgttgttatctatcgcgttccggtcatgatggatcgcgaggaaaagcaatatgcatggcaagtttttcatggcgaagatagcgtttgccccgaaatacccaaacaacgttttaatttattggtgcctgcttctcgatgccctcattgtgggcatcgtattcgggcaattgaaaatattcccgtgattagttggttgtttttgaagggaaaatgttctgggtgcggcgcggcgatttcagctcgctatttgttggttgaattgttgaccgctgccttaagcgttattgttgctttccattatcacgatccgctctctctgggatttgctttggtttttacttggacgttgatcgctttatgttttattgacgccgaacaccaattacttcccgatcgcctgacattaccgctcttatggttggggattttagctgctttatttaatgttttcataaacttagaaagtagcgttattggtgccatgattggttatttatctttatggtcggtttattggctttttaaattaatcaccggtcgcgagggtatgggctacggcgatttcaaattgctggcgtgtttatgcgcgtggcagggtgcatggatgttgccgattatcctattttctgcggcgatcttgggcatgatttacgcacttggcattggtttacgaatgggaaaacctatgccgtttggtccttttttagccattgctggctggcttacgtttttatacggcgcccaaattgggcaattgttcggatattttcccgcatga

SEQ ID NO: 106635 - protein, 286 aa, Bacteroides nodosus
MLISELLQTPLGIFFVGLFSLMVGSFLNVVIYRVPVMMDREEKQYAWQVFHGEDSVCPEIPKQRFNLLVPASRCPHCGHRIRAIENIPVISWLFLKGKCSGCGAAISARYLLVELLTAALSVIVAFHYHDPLSLGFALVFTWTLIALCFIDAEHQLLPDRLTLPLLWLGILAALFNVFINLESSVIGAMIGYLSLWSVYWLFKLITGREGMGYGDFKLLACLCAWQGAWMLPIILFSAAILGMIYALGIGLRMGKPMPFGPFLAIAGWLTFLYGAQIGQLFGYFPA

SEQ ID NO: 106636 - DNA, 828 bp, Burkholderia pseudomallei
  CDS (1)..(828)
atgcagcttgcgttcgcgatcgtgctcggcctcgtcgtcggcagcttcatcaacgtcgtcgtccatcggctgccgatcatgatgaagcgcgcgtggctcgccgaaatcgccgaagcgacgggcgcgccgtgcgccgacgacggcctgccggcgcgctacaacctctgcgtgccgcgcagcgcgtgcccgcactgcggccatgcgctgcgcgcgtgggaaaacgtgccggtcctcagctatatcgcattgcggggccggtgccggcactgccgtacgccgatcggcgcgcgctatccgctcatcgaactcgcgagcggcgcgctcgccgccggcgcgctcgcgctgttcgggccgagcggcgccgcactcgccgcgttcggcctgtgcgcggcgctcctcgcgatgagcgcgatcgacatgcagaccggcttcctgcccgattcgctcacgttgccgctcctgtgggccgggctgtgcgtcaatctctggggcacgtttgcgagcctgcgcgccgcggtgatcggcgcgatcgccggctatctgttcctctggtgcattctgtggctcttcaaactgctgcgcggcatcgaaggaatcggctacggcgacctgaagctcctcgccgcgctcggcgcatggctcggctgggaagcattgccgcaggtcgtgctgatcgcagcggtcgccggcgccgcggtcggtctcgtcgcaacctggcgcggccgcatgcgcttcgaggaaccgttgccattcggcccgttcctcgcggcgggcggcgccgcgaccctctttttcggcacgccgttctacctgctgctcggaggctga

SEQ ID NO: 106637 - protein, 275 aa, Burkholderia pseudomallei
MQLAFAIVLGLVVGSFINVVVHRLPIMMKRAWLAEIAEATGAPCADDGLPARYNLCVPRSACPHCGHALRAWENVPVLSYIALRGRCRHCRTPIGARYPLIELASGALAAGALALFGPSGAALAAFGLCAALLAMSAIDMQTGFLPDSLTLPLLWAGLCVNLWGTFASLRAAVIGAIAGYLFLWCILWLFKLLRGIEGIGYGDLKLLAALGAWLGWEALPQVVLIAAVAGAAVGLVATWRGRMRFEEPLPFGPFLAAGGAATLFFGTPFYLLLGG

SEQ ID NO: 106638 - DNA, 840 bp, Erwinia carotovora
  CDS (1)..(840): transl_table=11
gtggacgatttaagggaattcgcacagctgtttccggcgtggtggtttggggcgctgggcgtgttggggttgattgttggcagttttctgaacgtggtgatttaccgcttgccgattatgctggagcgtcgctggcggcaggacatcgagcttgaaacgggcgtggccgatcccgatacgcgctacaacctgtggtggccgccttcgtcttgcccgcactgccagcaggctattgcggtaaaagataatatcccgctattcagctggctgtggctgcgcggccgctcccgctgctgccatcaatcggtttctgtgcaatatccgttagtggaagtcatcaccatgctggcttttctggcggcaggtttgctctggttgcccggcatggcgctgtggggggcgttgattctactgtctttcctgttggtgctgaccgttattgatataaaaacgctgctgctgccggatgagcttacgctgtcgcttctgtggatggggttgctgtttaatctgtcggggacatttgtctcattgaatgatgccgtagtcggcgcgatggccggttatttatctctgtggctactttattgggcattcaaatacgcaacgggcaaagaggcgctggggtacggtgattttaagttgctggctgcgctgggggcttggttgggctggcaggcattgccgaatctggttttggtggcggcgctgagcgggctggtcgtgactctcatctggcgcgggttgcgtaaagaggataccgctaaaccgctggcctttggcccctggctggcaatcggcggggtattcggcatgataatgaacggattcaatctgtag

SEQ ID NO: 106639 - protein, 279 aa, Erwinia carotovora
MDDLREFAQLFPAWWFGALGVLGLIVGSFLNVVIYRLPIMLERRWRQDIELETGVADPDTRYNLWWPPSSCPHCQQAIAVKDNIPLFSWLWLRGRSRCCHQSVSVQYPLVEVITMLAFLAAGLLWLPGMALWGALILLSFLLVLTVIDIKTLLLPDELTLSLLWMGLLFNLSGTFVSLNDAVVGAMAGYLSLWLLYWAFKYATGKEALGYGDFKLLAALGAWLGWQALPNLVLVAALSGLVVTLIWRGLRKEDTAKPLAFGPWLAIGGVFGMIMNGFNL

SEQ ID NO: 106640 - DNA, 852 bp, Erwinia chrysanthemi
  CDS (1)..(852): transl_table=11
atggatctgatcgcctttgccaacacattcccgcgtgtctggctgctcgcactgttgttgctgggcctgattatcggcagttttctcaacgtggtgatttatcggctgccgctcatgctggagcggagttggcggcaggaggcacgttttcaccttggtctaccggctggcaggccgcttgctcgttatgatctttgctggccgccttcttcctgtccccattgccatcagcgactgcgtatgcgcgacaacattccgttgctgagctggatatggctgcgtgggcgggcgcattgttgtggcggcgcggtgtcatggcgttatccgctaattgaattgctgtccgggttatcgtttctgctggccggcttactctggcaaccggggttggcgttgctgggggcattgttgtgttttggcatattcgtggcgctggcggcgattgacgcccgaacacagttactgcccgatgtgatgacattaccgctactatggggcgggttattgtttaacctggcggatacctttgtgccgcttgaacaagctgttgttggtgccgtggccggttatctgtcgctgtggctgatttactgggcatttcgtctgctgagcggacgcgaagcgctgggacatggcgattttaaactattggcggccctgggagcctggctgggctggcaggcactgcccaatctggtgttgattgcctcgctgaccggtctgacggcgacgttattgtggcaacggatacaccgcctcagcatgcagcaaccgctggcgtttggcccctggctggcggtgagtggcgcgatgggtctggtgctgaatgtgctgggcggctggagccattga

SEQ ID NO: 106641 - protein, 283 aa, Erwinia chrysanthemi
MDLIAFANTFPRVWLLALLLLGLIIGSFLNVVIYRLPLMLERSWRQEARFHLGLPAGRPLARYDLCWPPSSCPHCHQRLRMRDNIPLLSWIWLRGRAHCCGGAVSWRYPLIELLSGLSFLLAGLLWQPGLALLGALLCFGIFVALAAIDARTQLLPDVMTLPLLWGGLLFNLADTFVPLEQAVVGAVAGYLSLWLIYWAFRLLSGREALGHGDFKLLAALGAWLGWQALPNLVLIASLTGLTATLLWQRIHRLSMQQPLAFGPWLAVSGAMGLVLNVLGGWSH

SEQ ID NO: 106642 - DNA, 693 bp, Haemophilus influenzae
  CDS (1)..(693): transl_table=11
atgatttatttcacaatgtttttattaggcggtatcttagggatcgcattgtggttctacctatctggttttattacgcgtttgcagcaaaatatttatgcgatttacgttgaattatttccacaaaaccgttctccatttcaaccgcactttgcctctattcaacaaaaaaagtgcggtcatattttgaggtatttttttagtattggggttggatttatatttttacaaattgccttcaaagattctatttttactgtatggatcggactcacacttattattctttggacaatcagttatcttgattggcactatcaacttatttctacgacaccctgtttatggttacttactctaggattatttggagcagacaataacttttcattacttacgttatctgaaagcataaaaagtgcggcaagtttttttattgttttctacgtaatctattggcttgcaaaattctattatggaaaagaagcctttggacggggagattattggctagcaatggcattaggaagttttattcatttagaaaccttaccgcactttttattattagcctcagtgcttggaatatgtttttcgcttattcataggaagaaaaaagaatttttaccttttgccccttttatgaacttatcagctgtcatcatttatttcgtcaaatattacggatattaa

SEQ ID NO: 106643 - protein, 230 aa, Haemophilus influenzae
MIYFTMFLLGGILGIALWFYLSGFITRLQQNIYAIYVELFPQNRSPFQPHFASIQQKKCGHILRYFFSIGVGFIFLQIAFKDSIFTVWIGLTLIILWTISYLDWHYQLISTTPCLWLLTLGLFGADNNFSLLTLSESIKSAASFFIVFYVIYWLAKFYYGKEAFGRGDYWLAMALGSFIHLETLPHFLLLASVLGICFSLIHRKKKEFLPFAPFMNLSAVIIYFVKYYGY

SEQ ID NO: 106644 - DNA, 687 bp, Klebsiella pneumoniae
  CDS (1)..(687): transl_table=11
atggtcgaaaacatcgcgttattacccgagttcgccgcgcaatacccgtttctctggggcagctttttattcctgtccggactggcgttcggcagcttttttaacgtcgttatccaccgtctgccgctgatgatggagcaggcagagggaatcaatctctgttttcccgcgtcgttctgtccgcagtgccgtgagcccatcgcctggcgggacaatattccgctactgggcttcctgtttcttaaggggcgttcgcgctgctgcgggcagccgatctcgcctcgctatcctctgatggagctggcgaccggcgcgctgtttgtgctggcgggatacctaatggcgccgggcgtgccgctgctgggcgggttgattttattgtcgctgctgctgatcctcgccgccatcgacgcgcaaacgcagctgctgccggacgggctgacgctaccgctgatgtgggccgggctgttgttcaatcttagcgcgacttacgtgccgctggcggaggcggtcgtgggcgcgatggccgggtatttatcgctgtggtcggtgtactgggtattccgtctgctgagcggtaaagaggcgctgggctacggcgatttcaaactgctggcggcgctcggcgcgtggctcggctggcaggcgctgccgcagacgctgctgctggcttcgccagcggcctga

SEQ ID NO: 106645 - protein, 228 aa, Klebsiella pneumoniae
MVENIALLPEFAAQYPFLWGSFLFLSGLAFGSFFNVVIHRLPLMMEQAEGINLCFPASFCPQCREPIAWRDNIPLLGFLFLKGRSRCCGQPISPRYPLMELATGALFVLAGYLMAPGVPLLGGLILLSLLLILAAIDAQTQLLPDGLTLPLMWAGLLFNLSATYVPLAEAVVGAMAGYLSLWSVYWVFRLLSGKEALGYGDFKLLAALGAWLGWQALPQTLLLASPAA

SEQ ID NO: 106646 - DNA, 864 bp, Legionella pneumophila
  CDS (1)..(864): transl_table=11
atgataaatgcactaataatcaattatccatggtttatgtatttagtcgttgggctcttttctctagccgttggaagtttgcttaatgtgataatctatcgcttaccaattattttgcaggaagagtggaaagagcaatgctgtgagctattccattttgaacagcgaaaagaaaaaataaaacttaatttatttttaccacgttctttttgtcctcattgtaaagcgatggttaaagcgtggcagaatattcctctgttagctatattggtgttaagaggacgctgttaccaatgtgatagtccattttcaatccgctacccttttgttgagacgttgactacagttttatccttatacgccagttggcattttgggtttacaatacaattattatttgctttattagctatctggatattaatatcacttgtttttattgatcttgatcatcaattactccctgatagcctcactttagggctcttatggattggccttattgctaatacccagaatgtatttgtaagtcttgacgtagctgtattaagctgcgctggcgcctatttagccttatggttattcattaatctgttttatctgatgacatgtaaagtatgtatgggacatggggatttcaaattatttgcagcatttggtgcctggcttggatggatgtatttaccaataattctactaatatcttcaataacgggggctatcattggtttgatttatttaaagataaatggtaaatcaagagatactgcaataccattcggcccttttctttgcatttctggattaatagctatgttttggggagactcaattatcaattggtacataggttattggatgtaa

SEQ ID NO: 106647 - protein, 287 aa, Legionella pneumophila
MINALIINYPWFMYLVVGLFSLAVGSLLNVIIYRLPIILQEEWKEQCCELFHFEQRKEKIKLNLFLPRSFCPHCKAMVKAWQNIPLLAILVLRGRCYQCDSPFSIRYPFVETLTTVLSLYASWHFGFTIQLLFALLAIWILISLVFIDLDHQLLPDSLTLGLLWIGLIANTQNVFVSLDVAVLSCAGAYLALWLFINLFYLMTCKVCMGHGDFKLFAAFGAWLGWMYLPIILLISSITGAIIGLIYLKINGKSRDTAIPFGPFLCISGLIAMFWGDSIINWYIGYWM

SEQ ID NO: 106648 - DNA, 1008 bp, Myxococcus xanthus
  CDS (1)..(1008): transl_table=11
gtgacgcattcttccctgccgggatacttcgggcccctgttcgccgtgttcctgttcgtgctcggcttgtgcgtgggcagctttctcaacgtcgtcatcgcgcgggttccgctggaccagagcatcgtgcgaccacgctcgcgatgccctcggtgcgggcacgtcctggcgtggtacgagaacatcccgttgctgtcctggcttgcgcttcgggcgcgctgccggggctgcggcgtgcccatctccgtgcgttacccgttggtggaactcctgacagggctcctgttcttcgcgtgcctgcgccgttttggctggacgtacgaattggtgccggcgctggtgctcgtatccttgctggtgccgctcgccttcattgacctggaccattggattctgccgctgtccatgacggtgccgggaatgctggcggggattgccctggcgttccccctggggatggacgccttccgtgatgcgctgatgggtgcggcagtgggcttcctgtccttccggatgatggagtacgtcggatggaaggtgttccagcgagaggcgctgggcgcgggggacaagtacctcgttgccatgctcggagccttcctgacgtggcgcgcgctgctgggcgtcctgttgttcgcgtccatgcagggggccgtggtgggcatcctgatgcttctggcgacagggcgcgctggacctcgcacggagaacacccaggatgagccggcgggggatgcgcccccgctcacgatgacctgggagttcacgcagccgggcctcccgctctggaagcggttgctgttggttccggtgtgcctgctggtccagcccatccctgatgcgcccttggacgaagagggtgaggaagaagaatgggtcccggagcgcaccagcattccctttggaccttggctggcgctcgcggggctggagctcctcttgctggggccgtggctttcccgggtgctgcctgcggatatcgccatgatgttgggcggcctgccatga

SEQ ID NO: 106649 - protein, 335 aa, Myxococcus xanthus
MTHSSLPGYFGPLFAVFLFVLGLCVGSFLNVVIARVPLDQSIVRPRSRCPRCGHVLAWYENIPLLSWLALRARCRGCGVPISVRYPLVELLTGLLFFACLRRFGWTYELVPALVLVSLLVPLAFIDLDHWILPLSMTVPGMLAGIALAFPLGMDAFRDALMGAAVGFLSFRMMEYVGWKVFQREALGAGDKYLVAMLGAFLTWRALLGVLLFASMQGAVVGILMLLATGRAGPRTENTQDEPAGDAPPLTMTWEFTQPGLPLWKRLLLVPVCLLVQPIPDAPLDEEGEEEEWVPERTSIPFGPWLALAGLELLLLGPWLSRVLPADIAMMLGGLP

SEQ ID NO: 106650 - DNA, 861 bp, Neisseria gonorrhoeae
  CDS (1)..(861): transl_table=11
atgtctgatttgtctgtattgtcgccgtttgccgtgcctttggcagcagttttggggctgctggtcggcagcttcctgaatgtcgtcatttaccgcgtacccgttatgatggaacgcggctggacggtatttgccaaagaacatttaaacctgccgctgaccgacgatgaaagccgtaccttcaacctgatgaagccggattcctgctgtcccaaatgccgtgtgccgatacgcgcgtggcagaacatcccgattgtcagttacctgctcctgcgcggcaaatgcgcttcctgccaaaccaaaatcagcatacgttatcccttaatcgagctgctgaccggcgtattgttcgggctggtcgcctggcaatacggctggtcttggattacgctgggcggtttgatactgaccgcgtttctgatttccctgacctttatcgatgcggacacccaatacctgcccgactcgatgacattacccttgatctggctggggctgatatttaatttggacggcggcttcgtgcctttgcagtctgccgttttaggtgcggttgccggctatagttcattatggctcttatgtgcagtgtataaactgctcacaggaaaaaccggtatgggcaacggagatttcaaactgattgccgcattgggcgcgtggctcggcatatccgcattgcccgtgctgatttttgtttcctctctgatcggtttggtcgcggcaatcgttatgcgcgtcgccaaggggcggcattttgccttcggccccgcactgacagtttcgggctggataatttttacggcaaacgattccgtatggcgggcggtcaactggtggctgacccatccggtgagatga

SEQ ID NO: 106651 - protein, 286 aa, Neisseria gonorrhoeae
MSDLSVLSPFAVPLAAVLGLLVGSFLNVVIYRVPVMMERGWTVFAKEHLNLPLTDDESRTFNLMKPDSCCPKCRVPIRAWQNIPIVSYLLLRGKCASCQTKISIRYPLIELLTGVLFGLVAWQYGWSWITLGGLILTAFLISLTFIDADTQYLPDSMTLPLIWLGLIFNLDGGFVPLQSAVLGAVAGYSSLWLLCAVYKLLTGKTGMGNGDFKLIAALGAWLGISALPVLIFVSSLIGLVAAIVMRVAKGRHFAFGPALTVSGWIIFTANDSVWRAVNWWLTHPVR

SEQ ID NO: 106652 - DNA, 873 bp, Pseudomonas aeruginosa
  CDS (1)..(873): transl_table=11
atgcccctcctcgactacctggccagccatccgctggcctttgtcttgtgcaccatcctcctcggcctgctggtcggcagcttcctcaacgtcgtcgtgcatcgcctgccgaagatgatggagcgcaactggaaggccgaggcccgcgaagcgctcgggctggagccggaacccaagcaggcgacctacaacctggtgctgccgaattcggcgtgcccgcgctgcggccacgagatccgcccctgggaaaacatcccgctggtcagctacctggcgctgggcggcaagtgctcgtcctgcaaggccgccatcggcaaacgctaccccctggtggaactggccaccgcgctgctttccggctacgtcgcctggcatttcggcttcacctggcaggcgggcgcgatgctcctgctgacctggggtctgctggcgatgagcctgatcgatgccgatcaccaactgctgccggacgtgctggtgctgccgctgctctggctgggcctgatcgccaaccatttcggcctcttcgccagcctcgacgatgcgctgttcggcgcggtgttcggctacctgagcctgtggtcggtgttctggctgttcaagctggtgaccggcaaggagggcatgggctacggcgacttcaagctgctggccatgctcggtgcctggggcggctggcagatcctgccgctgaccatcctgctgtcgtcgctggtcggggcgatcctcggggtgatcatgctgcgcctgcgcaacgccgaaagcggcacgccgatccccttcggtccctatctggctattgccgggtggattgctttgctctggggtgatcaaataacccggacctatctgcaattcgccggattcaaatga

SEQ ID NO: 106653 - protein, 290 aa, Pseudomonas aeruginosa
MPLLDYLASHPLAFVLCTILLGLLVGSFLNVVVHRLPKMMERNWKAEAREALGLEPEPKQATYNLVLPNSACPRCGHEIRPWENIPLVSYLALGGKCSSCKAAIGKRYPLVELATALLSGYVAWHFGFTWQAGAMLLLTWGLLAMSLIDADHQLLPDVLVLPLLWLGLIANHFGLFASLDDALFGAVFGYLSLWSVFWLFKLVTGKEGMGYGDFKLLAMLGAWGGWQILPLTILLSSLVGAILGVIMLRLRNAESGTPIPFGPYLAIAGWIALLWGDQITRTYLQFAGFK

SEQ ID NO: 106654 - DNA, 867 bp, Pseudomonas putida
  CDS (1)..(867): transl_table=11
atgactttatggaccttcctggcgatggagccggcttacttcatcaccctggcgaccgtgctcggcctgttggtgggcagttttctcaacgttgtggtgtaccgcctgccgatcatgctggagcgccaatggcagcgtgaggcacacgaagtgctggggctgccggtgaccgagcacgagcgcttcgacctgtgcctgccggcctcgcagtgcacgcaatgcgggcaccggatacgggcgtgggaaaacctcccggtgctcagctacctggcgttgcgcgggcgctgctcggcctgcaaacagcgcatcagcgtgcgttacccgttggtcgaggtgggttgtgcgctgctgtcgatggtggtggcctggcgctacggggccagcgtcgaggcactggtgctgctgccgctgacctggagcttgctggctctgagcttgatcgaccatgaccaacaactgctgcccgatgccatcgtgctgccggggctgtggcttgggctgatcgtcaattacttcggggtatgggtgcccttgcccgatgccgtatgcggcgcggtggtcgggtacctcagcctgtggacggtgtactggttgttcaagctggttaccggcaaggaaggcatgggctatggcgacttcaagctgttggcgctgctcggcgcctggggtggctggcaggtgctgccgctgaccttgttgctgtcgtcggtgcttggggcgctggttggggtgtacctgctgcgggtgcgcaacgattccatgggtacggccatgccatttgggccctatctggcaattgcggggtggattgccgtgctctggggtgatgaaatatacgcctctaacatgcaactgcttggattctga

SEQ ID NO: 106655 - protein, 288 aa, Pseudomonas putida
MTLWTFLAMEPAYFITLATVLGLLVGSFLNVVVYRLPIMLERQWQREAHEVLGLPVTEHERFDLCLPASQCTQCGHRIRAWENLPVLSYLALRGRCSACKQRISVRYPLVEVGCALLSMVVAWRYGASVEALVLLPLTWSLLALSLIDHDQQLLPDAIVLPGLWLGLIVNYFGVWVPLPDAVCGAVVGYLSLWTVYWLFKLVTGKEGMGYGDFKLLALLGAWGGWQVLPLTLLLSSVLGALVGVYLLRVRNDSMGTAMPFGPYLAIAGWIAVLWGDEIYASNMQLLGF

SEQ ID NO: 106656 - DNA, 870 bp, Pseudomonas stutzeri
  CDS (1)..(870): transl_table=11
atgactcctgtcgaatttctggccagcaacccgctggcctttgttttgtgcgcgctggtgcttggcctgctggtcggcagcttcctcaacgtagtcatccatcgcttgccgatcatgatgcagcgtgattggcaatcgcaggcgcgggagtttctcgagttacctgccgagcctgccggcgctgccttcaatctgtttctcccgcattcacgttgcccccactgcgaccaccagatccgcgcctgggaaaatattccgctgatcagctggctggcgctgcgtggcaagtgttcggcgtgcaaggcgtcgatcagcaagcgctacccgctggtcgagctggcgtgtgggttgctctcgggttacgtcgcctggcatttcggtttttcctggcaggctggcgcgatgctgctgctgacctggggtttgctggcgatgagcatgatcgatgtcgatcatcagttgctgccggattcgctggtgctgccgctgctctggctgggcttaatcattaacagcttcggactgttcgcttcgctggaagatgcgttgtggggcgcagttgtgggttacctcgccctgtggtcggtgtactggctgttcaagctggtgaccggcaaggaggggatgggctacggcgacttcaagctgttggccatgttgggcgcttggggcggctggcaggtgctgccgctgactatcttgctgtcttcggtggtcggcgcggtgctgggcaccgtcatgctgcgtatgcagaaggccgagagcggcacgcccattcccttcggcccctatctggcgatcgctggctgggtcgcattgctttggggggaccagatcactgccagctacctgcagttcgccagactgtag

SEQ ID NO: 106657 - protein, 289 aa, Pseudomonas stutzeri
MTPVEFLASNPLAFVLCALVLGLLVGSFLNVVIHRLPIMMQRDWQSQAREFLELPAEPAGAAFNLFLPHSRCPHCDHQIRAWENIPLISWLALRGKCSACKASISKRYPLVELACGLLSGYVAWHFGFSWQAGAMLLLTWGLLAMSMIDVDHQLLPDSLVLPLLWLGLIINSFGLFASLEDALWGAVVGYLALWSVYWLFKLVTGKEGMGYGDFKLLAMLGAWGGWQVLPLTILLSSVVGAVLGTVMLRMQKAESGTPIPFGPYLAIAGWVALLWGDQITASYLQFARL

SEQ ID NO: 106658 - DNA, 810 bp, Synechocystis sp
  CDS (1)..(810): transl_table=11
atggatcccctgattgccccccttgctttcctacttgccattgctctgggctgtgccgtgggtagttttctcaacgtggtggcctatcgtttgccagaaggtttatccctggtacatcccccttcccgttgtccccactgtggccaccgactgggcccgaaggagaatgtgccagtggtgggttggctttggctacggggtaaatgccgttggtgccaaactgccatttctccccgctatcccttggtggaggctgcgacgggattcttatttgccctgacctgttggcgttttggttggcagtggcaaaccttcggctactggatattaattagttttttaatctccctgactttaattgactgggacaccatgaccctgcccaatagtttgactaaaccgggattggtgcttgggctgttatttcatttactactgggttggcaacgtggccattggattgtccccttggtggaggcgatcgcctcggcggtattggggctatggttgtttgatttgatccgcatgggaggaagtctgttgctcggtagggaaggcatgggggacggggatcccaaattggcatccatggtaggggcttggttgggctggccgtcattactgttgaccaccttcattgcctgtttcatcggttccatctatgggggtttgaagttactgttgggcacattgcaacggcgacagggttttccctttggcccctttttggcgatcggtgccctcatcagtctcttttggggtgaaaaattgatcactagttacttaaattttgtgaccccacaattttga

SEQ ID NO: 106659 - protein, 269 aa, Synechocystis sp
MDPLIAPLAFLLAIALGCAVGSFLNVVAYRLPEGLSLVHPPSRCPHCGHRLGPKENVPVVGWLWLRGKCRWCQTAISPRYPLVEAATGFLFALTCWRFGWQWQTFGYWILISFLISLTLIDWDTMTLPNSLTKPGLVLGLLFHLLLGWQRGHWIVPLVEAIASAVLGLWLFDLIRMGGSLLLGREGMGDGDPKLASMVGAWLGWPSLLLTTFIACFIGSIYGGLKLLLGTLQRRQGFPFGPFLAIGALISLFWGEKLITSYLNFVTPQF

SEQ ID NO: 106660 - DNA, 864 bp, Xanthomonas campestris pv
  CDS (1)..(864): transl_table=11
atggcatttctcgaccagcatcccggtctcggctttcccgccgcggccggactgggactgctgatcggcagcttcctgaatgtagtgatcctgcgcttgcccaagcgcatggagtggcagtggcggcgcgatgcgcgcgaaatcctggaactgcccgacatctacgagccgccgccgccgggcattgtggtggagccatcgcacgatccggtcaccggcgacaagctcaagtggtgggagaacattccgctgttcagctggctgatgctgcgcggcaagtcgcgctacagcggcaagccgatctccatccagtacccgctggtggagctgttgacctcgatcctgtgcgtggccagcgtctggcgcttcggcttcggctggcagggcttcggtgcgatcgtgctgagctgctttctggtggcgatgtcgggtatcgacctgcgccacaagctgctgccggaccagctgaccttgccgctgatgtggttgggcttggtcggttcgatggacaacctctacatgccagccaagcccgccctgctgggtgcggcggtcggctatgtctcgctctggacggtgtggtggctgttcaagcagctcaccggcaaggaagggatgggccacggcgacttcaagttgctggctgcgctgggggcgtggtgcgggttgaagggcattctgccgatcatcctgatctcctcgctggtcggcgccgtgctcggttcgatctggctgttcgccaaggggcgcgaccgcgccacgccgatcccgttcggaccttatctggccatcgccggctgggtagtgttcttctggggtaacgacctggtggatggctacctgcgtttcgcaggcctgcgttga

SEQ ID NO: 106661 - protein, 287 aa, Xanthomonas campestris pv
MAFLDQHPGLGFPAAAGLGLLIGSFLNVVILRLPKRMEWQWRRDAREILELPDIYEPPPPGIVVEPSHDPVTGDKLKWWENIPLFSWLMLRGKSRYSGKPISIQYPLVELLTSILCVASVWRFGFGWQGFGAIVLSCFLVAMSGIDLRHKLLPDQLTLPLMWLGLVGSMDNLYMPAKPALLGAAVGYVSLWTVWWLFKQLTGKEGMGHGDFKLLAALGAWCGLKGILPIILISSLVGAVLGSIWLFAKGRDRATPIPFGPYLAIAGWVVFFWGNDLVDGYLRFAGLR

SEQ ID NO: 106662 - DNA, 810 bp, Escherichia coli
  CDS (1)..(810)
atgctttttgatgtttttcagcaataccccacggcgatgcccgtcctggcaaccgtcggaggattgatcatcggcagttttttgaatgtggtgatttggcgttacccaatcatgctgcgccaacaaatggcggagtttcacggtgaaatgtcgagtgcgcagtcaaaaataagccttgcgctaccgcgttcgcactgcccacattgtcagcagaccatccggatacgtgacaatattccgctgttctcctggctgatgctcaaagggcgctgccgcgactgtcaggcgaaaatcagcaagcgttatccgctggtggagttattgacagcacttgcttttttgctggcgagtctggtctggccagaaagtggatgggggctggcggtgatgatattatccgcctggctgattgccgcgagtgtcatcgacctcgatcaccaatggctgcccgatgtttttactcagggcgtattgtggacaggactgattgcggcatgggcgcagcagagtccgctcacgctacaagatgcagtcaccggcgtcctggtgggatttatcactttttactctctgcgttggatagccggaatagttctgcgtaaagaagcattaggcatgggcgatgtattacttttcgccgcgttaggtggctgggtgggggcattgtcgctgcccaatgttgctttaatcgcctcatgctgcggcctgatatatgccgttattacaaaaagaggatcaaccacactgccttttggaccgtgtttaagtctgggcggtatagcaacactttatctacaggcattgttttaa

SEQ ID NO: 106663 - protein, 269 aa, Escherichia coli
MLFDVFQQYPTAMPVLATVGGLIIGSFLNVVIWRYPIMLRQQMAEFHGEMSSAQSKISLALPRSHCPHCQQTIRIRDNIPLFSWLMLKGRCRDCQAKISKRYPLVELLTALAFLLASLVWPESGWGLAVMILSAWLIAASVIDLDHQWLPDVFTQGVLWTGLIAAWAQQSPLTLQDAVTGVLVGFITFYSLRWIAGIVLRKEALGMGDVLLFAALGGWVGALSLPNVALIASCCGLIYAVITKRGSTTLPFGPCLSLGGIATLYLQALF

SEQ ID NO: 106664 - DNA, 23 bp, Artificial sequence
  primer
atgacaatgctactgccgctctt

SEQ ID NO: 106665 - DNA, 23 bp, Artificial sequence
  primer
ttaataagagatccaggccagat

SEQ ID NO: 106666 - protein, 484 aa, Artificial sequence
  Variant (2)..(2): xaa in position 2 is any amino acid
  Variant (4)..(6): xaa in position 4 to 6 is any amino acid
  Variant (11)..(11): xaa in position 11 is any amino acid
  Variant (13)..(15): xaa in position 13 to 15 is any amino acid
  Variant (17)..(17): xaa in position 17 is any amino acid
  Variant (19)..(22): xaa in position 19 to 22 is any amino acid
  Variant (23)..(72): xaa in position 23 to 72 is any or no amino acid
  Variant (74)..(74): xaa in position 74 is any or no amino acid
  Variant (76)..(77): xaa in position 76 to 77 is any or no amino acid
  Variant (79)..(81): xaa in position 79 to 81 is any or no amino acid
  Variant (83)..(88): xaa in position 83 to 88 is any or no amino acid
  Variant (92)..(93): xaa in position 92 to 93 is any or no amino acid
  Variant (96)..(96): xaa in position 96 is any amino acid
  Variant (97)..(98): xaa in position 97 to 98 is any or no amino acid
  Variant (101)..(104): xaa in position 101 to 104 is any or no amino acid
  Variant (106)..(108): xaa in position 106 to 108 is any or no amino acid
  Variant (110)..(112): xaa in position 110 to 112 is any or no amino acid
  Variant (114)..(115): xaa in position 114 to 115 is any or no amino acid
  Variant (118)..(137): xaa in position 118 to 137 is any amino acid
  Variant (138)..(154): xaa in position 138 to 154 is any or no amino acid
  Variant (157)..(157): xaa in position 157 is any amino acid
  Variant (159)..(160): xaa in position 159 to 160 is any amino acid
  Variant (163)..(167): xaa in position 163 to 167 is any amino acid
  Variant (170)..(171): xaa in position 170 to 171 is any amino acid
  Variant (173)..(176): xaa in position 173 to 176 is any amino acid
  Variant (178)..(179): xaa in position 178 to 179 is any amino acid
  Variant (182)..(191): xaa in position 182 to 191 is any amino acid
  Variant (192)..(210): xaa in position 192 to 210 is any or no amino acid
  Variant (213)..(213): xaa in position 213 is any amino acid
  Variant (215)..(217): xaa in position 215 to 217 is any amino acid
  Variant (219)..(219): xaa in position 219 is any amino acid
  Variant (220)..(330): xaa in position 220 to 330 is any or no amino acid
  Variant (332)..(339): xaa in position 332 to 339 is any amino acid
  Variant (340)..(356): xaa in position 340 to 356 is any or no amino acid
  Variant (360)..(360): xaa in position 360 is any amino acid
  Variant (363)..(363): xaa in position 363 is any amino acid
  Variant (366)..(366): xaa in position 366 is any amino acid
  Variant (368)..(368): xaa in position 368 is any amino acid
  Variant (373)..(373): xaa in position 373 is any amino acid
  Variant (375)..(376): xaa in position 375 to 376 is any amino acid
  Variant (377)..(377): xaa in position 377 is any or no amino acid
  Variant (379)..(381): xaa in position 379 to 381 is any amino acid
  Variant (383)..(384): xaa in position 383 to 384 is any amino acid
  Variant (385)..(387): xaa in position 385 to 387 is any or no amino acid
  Variant (389)..(391): xaa in position 389 to 391 is any amino acid
  Variant (393)..(403): xaa in position 393 to 403 is any amino acid
  Variant (404)..(473): xaa in position 404 to 473 is any or no amino acid
  Variant (482)..(482): xaa in position 482 is any amino acid
LXGXXXGSFLXVXXXRXPXXXXXXXXXXXXXXXXXXXXXXXXXXXXXXXXXXXXXXXXXXXXXXXXXXXXXXSXCXXCXXXIXXXXXXIPVXXWLXXXGRXXXXCXXXIXXXYXXVEXXXXXXXXXXXXXXXXXXXXXXXXXXXXXXXXXXXXXLLXLXXIDXXXXXLPXXLXXXXLXXGLXXXXXXXXXXXXXXXXXXXXXXXXXXXXXAVXGXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXGMGXGDXKLXAXLGAWXGXXXLXXXIXXXXXSXXXGXXXXXXXXXXXXXXXXXXXXXXXXXXXXXXXXXXXXXXXXXXXXXXXXXXXXXXXXXXXXXXXXXXXXXXXXXXXXXXXXXIPFGPFLAXGG

SEQ ID NO: 106667 - protein, 12 aa, Artificial sequence
  Variant (3)..(9): xaa in position 3 to 9 is any amino acid
  Variant (11)..(11): xaa in position 11 is any amino acid
  Variant (12)..(12): xaa in position 12 is Pro or Thr
GSXXXXXXXRXX

SEQ ID NO: 106668 - protein, 43 aa, Artificial sequence
  Variant (2)..(2): xaa in position 2 is any or no amino acid
  Variant (4)..(13): xaa in position 4 to 13 is any amino acid
  Variant (14)..(16): xaa in position 14 to 16 is any or no amino acid
  Variant (18)..(18): xaa in position 18 is Ile, Leu or Val
  Variant (19)..(19): xaa in position 19 is any amino acid
  Variant (20)..(20): xaa in position 20 is Ala, Gly or Ser
  Variant (21)..(25): xaa in position 21 to 25 is any amino acid
  Variant (26)..(26): xaa in position 26 is Ala or Gly
  Variant (27)..(27): xaa in position 27 is any amino acid
  Variant (28)..(28): xaa in position 28 is Cys or Ser
  Variant (29)..(30): xaa in position 29 to 30 is any amino acid
  Variant (32)..(42): xaa in position 32 to 42 is any amino acid
SXCXXXXXXXXXXXXXPXXXXXXXXXXXXXCXXXXXXXXXXXE

SEQ ID NO: 106669 - protein, 27 aa, Artificial sequence
  Variant (2)..(4): xaa in position 2 to 4 is any amino acid
  Variant (5)..(7): xaa in position 5 to 7 is any or no amino acid
  Variant (9)..(13): xaa in position 9 to 13 is any amino acid
  Variant (14)..(14): xaa in position 14 is Ile or Leu
  Variant (16)..(16): xaa in position 16 is Ala, Asp, Glu, Gly or Asn
  Variant (17)..(17): xaa in position 17 is any amino acid
  Variant (18)..(18): xaa in position 18 is Phe, Ile, Leu, Met or Val
  Variant (19)..(25): xaa in position 19 to 25 is any amino acid
  Variant (27)..(27): xaa in position 27 is Phe, Ile, Leu, Met or Val
LXXXXXXDXXXXXXPXXXXXXXXXXGX

SEQ ID NO: 106670 - protein, 29 aa, Artificial sequence
  Variant (2)..(2): xaa in position 2 is any amino acid
  Variant (3)..(4): xaa in position 3 to 4 is any or no amino acid
  Variant (7)..(8): xaa in position 7 to 8 is any amino acid
  Variant (10)..(10): xaa in position 10 is any amino acid
  Variant (11)..(11): xaa in position 11 is Ala, Gly or Ser
  Variant (12)..(13): xaa in position 12 to 13 is any amino acid
  Variant (15)..(17): xaa in position 15 to 17 is any amino acid
  Variant (19)..(28): xaa in position 19 to 28 is any amino acid
  Variant (29)..(29): xaa in position 29 is Ala, Gly, Ser, Thr or Val
GXXXGDXXLXXXXGXXXGXXXXXXXXXXX

SEQ ID NO: 106671 - protein, 8 aa, Artificial sequence
  Variant (4)..(4): xaa in position 4 is any amino acid
  Variant (5)..(5): xaa in position 5 is Ile or Leu
  Variant (6)..(6): xaa in position 6 is Ala, Cys, Ser or Val
  Variant (7)..(7): xaa in position 7 is any amino acid
  Variant (8)..(8): xaa in position 8 is Ala, Gly or Ser
FGPXXXXX

SEQ ID NO: 106672 - DNA, 1568 bp, Escherichia coli K12
  CDS (1)..(1248)
atgactgatcaagctgaaaaaaagcactctgcattttggggtgttatggttatagcaggtacagtaattggtggaggtatgtttgctttacctgttgatcttgccggtgcctggtttttctggggtgcctttatccttatcattgcctggttttcaatgcttcattccgggttattgttattagaagcaaatttaaattatcccgtcggctccagttttaacaccatcaccaaagatttaatcggtaacacctggaacattatcagcggtattaccgttgccttcgttctctatatcctcacttatgcctatatctctgctaatggtgcgatcattagtgaaacgatatcaatgaatttgggttatcacgctaatccacgtattgtcgggatctgcacagccattttcgttgccagcgtattgtggttaagttcgttagccgccagtcgtattacctcattgttcctcgggctgaagattatctcctttgtgatcgtgtttggttcttttttcttccaggtcgattactccattctgcgcgacgccaccagctccactgcgggaacgtcttacttcccgtatatctttatggctttgccggtgtgtctggcgtcatttggtttccacggcaatattcccagcctgattatttgctatggaaaacgcaaagataagttaatcaaaagcgtggtatttggttcgctgctggcgctggtgatttatctcttctggctctattgcaccatggggaatattccgcgagaaagctttaaggcgattatctcctcaggcggcaacgttgattcgctggtgaaatcgttcctcggcaccaaacagcacggcattatcgagttttgcctgctggtgttctctaacttagctgttgccagttcgttctttggtgtcacgctggggttgttcgattatctggcggacctgtttaagattgataactcccacggcgggcgtttcaaaaccgtgctgttaaccttcctgccacctgcgttgttgtatctgatcttcccgaacggctttatttacgggatcggcggtgccgggctgtgcgccaccatctgggcggtcattattcccgcagtgcttgcaatcaaagctcgcaagaagtttcccaatcagatgttcacggtctggggcggcaatcttattccggcgattgtcattctctttggtataaccgtgattttgtgctggttcggcaacgtctttaacgtgttacctaaatttggctaaatccttcaagaagccagccattcgctggcttcttgcctctcaggaaatcacttatgtccaaatggcaactcgcctgatcctccttcaccacgtatgctttgcgtcaccttactatcaggacgctttagcccatgtcccgctttttgatttgtagttttgccctggttttactttatccgccgggattgatatgtacctcgttggtttaccgcgcatcgccgccgatctcaatgccagcgaagcgcagttgcatattgcgttctccgtatatctggcggggatggcagatcaagcttatcgataccgtcgacctcgatcga

SEQ ID NO: 106673 - protein, 415 aa, Escherichia coli K12
MTDQAEKKHSAFWGVMVIAGTVIGGGMFALPVDLAGAWFFWGAFILIIAWFSMLHSGLLLLEANLNYPVGSSFNTITKDLIGNTWNIISGITVAFVLYILTYAYISANGAIISETISMNLGYHANPRIVGICTAIFVASVLWLSSLAASRITSLFLGLKIISFVIVFGSFFFQVDYSILRDATSSTAGTSYFPYIFMALPVCLASFGFHGNIPSLIICYGKRKDKLIKSVVFGSLLALVIYLFWLYCTMGNIPRESFKAIISSGGNVDSLVKSFLGTKQHGIIEFCLLVFSNLAVASSFFGVTLGLFDYLADLFKIDNSHGGRFKTVLLTFLPPALLYLIFPNGFIYGIGGAGLCATIWAVIIPAVLAIKARKKFPNQMFTVWGGNLIPAIVILFGITVILCWFGNVFNVLPKFG

SEQ ID NO: 106674 - DNA, 1867 bp, Escherichia coli
  CDS (473)..(1717)
tgtttgcttctcactccaccatcgaactgccgaaagtatgccgggtgaagtgctgctacactttacgcgcactcgcattctcaacaagccgatgaacatgcagttactgggcgatgcacagccgcatactggcggtgagcgtcgtggcggtggtcgtggtttcggtggcgaacgtcgtgaaggcggtcgtaacttcagcggtgaacgccgtgaaggtggccgtggtgatggtcgtcgttttagcggcgaacgtcgtgaaggccgcgctccgcgtcgtgatgattctaccggtcgtcgtcgtttcggtggtgatgcgtaatcatgcctgaacagcgaacacaatctgtaaaataatatatacagccccgatttttaccatcggggctttttttctgtcttttgtactcgtgtactggtacagtgcaatgcataacaacgcagtcgcactatttttcactggagagaagccctcatggcaacactaaccaccacccaaacgtcaccgtcgctgcttggcggcgtggtgattatcggcggcaccattattggcgcagggatgttttctctgccagtggtcatgtccggggcgtggtttttctggtcaatggcggcgctgatctttacctggttctgtatgctgcattccggcttgatgattctggaagctaacctgaattacagaatcggttcgagttttgacaccatcaccaaagatttgctgggcaaaggctggaacgtggtcaacggcatttccattgcctttgtgctctatatcctgacctatgcctatatttctgccagtggttcgattctgcatcacaccttcgcagagatgtcactaaacgtcccggcacgggcggcgggttttggttttgcattgctggtagcgtttgtggtgtggttgagcactaaagccgtcagtcgcatgacagcgattgtgctgggggcgaaagtcattaccttcttcctcacctttggtagcctgctggggcatgtgcagcctgcgacattgttcaacgtcgccgaaagcaatgcgtcttatgcaccgtatctgttgatgaccctgccgttctgtctggcatcgtttggttatcacggtaacgtgccaagcctgatgaagtattacggcaaagatccgaaaaccatcgtgaaatgtctggtgtacggtacgctgatggcgctggcgctgtataccatctggttgctggcgacgatgggtaacatcccgcgtccggagtttatcggtattgcagagaagggcggtaatattgatgtgctggtacaggcgttaagcggcgtactgaacagccgtagtctggatctgctgctggtcgtgttctcaaactttgcggtagcgagttcgttcctcggcgtaacgctgggtttgtttgactatctggcagatctgtttggtttcgacgactcggctgtgggccgcttgaaaacggcattgctgacctttgccccgccagttgtgggggggctgttgttcccgaacggattcctgtacgccattggttatgctggtttagcggctaccatctgggcggcaattgttccggcgctgttagcccgtgcatcgcgtaaacgctttggcagcccgaaattccgcgtctggggtggcaagccgatgattgcgctgattctggtgtttggcgtcggcaacgcactggtgcatattttatcgagctttaatttactgccggtgtatcagtaatcagcggtgccttatccgacatttctgctgcctacacaatgctgatcgttcgcttatcaggtctatgtaggacagcgttgccagctcggataaggcttcccgcgttaagacacactatcccaacaactcttccttaacatccatcgccag

SEQ ID NO: 106675 - protein, 414 aa, Escherichia coli
MATLTTTQTSPSLLGGVVIIGGTIIGAGMFSLPVVMSGAWFFWSMAALIFTWFCMLHSGLMILEANLNYRIGSSFDTITKDLLGKGWNVVNGISIAFVLYILTYAYISASGSILHHTFAEMSLNVPARAAGFGFALLVAFVVWLSTKAVSRMTAIVLGAKVITFFLTFGSLLGHVQPATLFNVAESNASYAPYLLMTLPFCLASFGYHGNVPSLMKYYGKDPKTIVKCLVYGTLMALALYTIWLLATMGNIPRPEFIGIAEKGGNIDVLVQALSGVLNSRSLDLLLVVFSNFAVASSFLGVTLGLFDYLADLFGFDDSAVGRLKTALLTFAPPVVGGLLFPNGFLYAIGYAGLAATIWAAIVPALLARASRKRFGSPKFRVWGGKPMIALILVFGVGNALVHILSSFNLLPVYQ

SEQ ID NO: 106676 - DNA, 1236 bp, Vibrio cholerae
  CDS (1)..(1236)
atgaaacccaaggattttatcatgtcgaaacaaccctcactgtttgggggagcctgcattattgccagcgtctgcgtaggtgctggtatgcttggtctccccagcgcaggtgccggcgcatggactctctggtctatgttggcgctcgctttaaccatggcggtcatgacgctttcaggctggatgctacttgaagcctttaaacactatgatcttcgagtctcgtttaataccgtgaccaaagatatgctaggcagccatatcaatcgctttaacaacctgaccgtttactttgtcggcggcattttgttgtacgcctacatcacctcttctggtttgattttgcaggatttactgcatatcaatagcaaaatagcctcgatactgttcgtggcggtattttccgctttcgtttggcattcgactcgcgcagtggatcgtatctcggttattttgatcgtatttatggttctgagctttatttttggtgtttcaggattagcgatcaatgtgaaaacatccatcctatttgacaccctaaatcaaagtggtgagtacgctccttatgcgatggcaatgctgcccgttgcgctgacctcgtttggttatcatcactccgtttcatccatgcgtgcctattacggcgaagagcgcaaagccaagtacgcgattttgggaggcacagtgattgcgctaagtctttatgcgctttggctatttagcatttttggcaatttacctcgtgccgattttgcgcctgtcatacagcaaggtgggaatgtggatgtgcttttaaaagccttaggttcggtggtggagtcggagaaagtctcacaagcgatcaacgccttttcgatggccgcgatcctatcttcctttatcggcgttggcttaggcgtatttgattttctggccgatttatttcagttcagcaactgtaaacaagggcgtaccaaaacttggctggtcacctttttgccacctctcattctctctttgctgttcccattcggctttatcattgcgatcggttacgcaggcgcagccgccactatttgggcctgtattatcccagtactgcttgcgcgtaaatcgcgcactttagccaatggagcgcaggggtttgtcgtaccgggaggcaatctagctctcggacttgttctgatctttggtgtgcttaccgcggtttttcatatgatggcgatggccaatttgttacctgcgtttaagggataa

SEQ ID NO: 106677 - protein, 411 aa, Vibrio cholerae
MKPKDFIMSKQPSLFGGACIIASVCVGAGMLGLPSAGAGAWTLWSMLALALTMAVMTLSGWMLLEAFKHYDLRVSFNTVTKDMLGSHINRFNNLTVYFVGGILLYAYITSSGLILQDLLHINSKIASILFVAVFSAFVWHSTRAVDRISVILIVFMVLSFIFGVSGLAINVKTSILFDTLNQSGEYAPYAMAMLPVALTSFGYHHSVSSMRAYYGEERKAKYAILGGTVIALSLYALWLFSIFGNLPRADFAPVIQQGGNVDVLLKALGSVVESEKVSQAINAFSMAAILSSFIGVGLGVFDFLADLFQFSNCKQGRTKTWLVTFLPPLILSLLFPFGFIIAIGYAGAAATIWACIIPVLLARKSRTLANGAQGFVVPGGNLALGLVLIFGVLTAVFHMMAMANLLPAFKG

SEQ ID NO: 106678 - DNA, 1209 bp, Yersinia pestis
  CDS (1)..(1209)
atgaagaatcgcactctgggcagtatatttatcgttgcaggtaccaccattggtgcgggcatgttggccatgccactggcggcggccggcgtagggtttggcgtcacactggccttgcttgtttctctttggttattaatgtgttacaccgcattattgctggtggaagtttatcaatatgaagcggctgataccgggcttggtacattagccaaacgttacctcggtggccatggtcaatggctgacgggtttcagtatgatgtttctgatgtatgcgcttactgcggcttatatcagtggtgctggcgagttattggcaaccagtatcagccaatggactcagcaatcattcccgacctatctcggcgttttactgtttaccctagtcgccggaggagtggtttgcatcggtacccattcggtcgatttgttcaatcgtatcctgttcagtgccaaaatcattttcctgatcgtaatgctggcactgatgatgccgcatatcgaaaaaaccaacctactgacattgccgctagagcaagggctagcactctctgcgatcccggtaatttttacgtcattcggtttccacggcagcgtacccagcattgttaattatatgggcggtaatatccgtaaactgcgctgggtatttatcatcggcagtgcgataccgcttatcgcttatatcttctggcaattagcgacactgggggcgatttcctctcatacttttgtcggtattctggcccagcaagcgggtttgaacggtttactccaggctgtgcgcgacgtcgtggcctctccccatgtcgaactggcggtgcatttgtttgctgatctggcactggcaacctcattcctgggggtagcattagggctatttgactatttggctgatttatttaaacgccgaaattccatacgtggccgtttacaaacggggttaattacctttacgccgccattactgtttgcgctgttttatccgcgtggctttattatggcgttgggttttgccgctgtggcattgtcagtattggcattaattctgcctgcaatgttagcgtggaaagcccgtaaacttcatcagggcaaatatcaggtttggggtgggagacccgcgctggcaatcgtgtttgcctgtggtgttaccgtgattggtattcagattggtattgtcactggcgcattacctgcggtagggtga

SEQ ID NO: 106679 - protein, 402 aa, Yersinia pestis
MKNRTLGSIFIVAGTTIGAGMLAMPLAAAGVGFGVTLALLVSLWLLMCYTALLLVEVYQYEAADTGLGTLAKRYLGGHGQWLTGFSMMFLMYALTAAYISGAGELLATSISQWTQQSFPTYLGVLLFTLVAGGVVCIGTHSVDLFNRILFSAKIIFLIVMLALMMPHIEKTNLLTLPLEQGLALSAIPVIFTSFGFHGSVPSIVNYMGGNIRKLRWVFIIGSAIPLIAYIFWQLATLGAISSHTFVGILAQQAGLNGLLQAVRDVVASPHVELAVHLFADLALATSFLGVALGLFDYLADLFKRRNSIRGRLQTGLITFTPPLLFALFYPRGFIMALGFAAVALSVLALILPAMLAWKARKLHQGKYQVWGGRPALAIVFACGVTVIGIQIGIVTGALPAVG

SEQ ID NO: 106680 - DNA, 1212 bp, Salmonella enterica subsp. enterica serovar Typhi
  CDS (1)..(1212)
atgaaaaacagaactctgggcagtatttttatcgtggcaggcaccactatcggcgccgggatgctggcaatgccgctggcagcggctggcgttggtttcagcgtcacgctgggattgttgattggtctgtgggcgctgatgtgttataccgcgctactattactggaggtatatcaacacgttccggcggataccgggctgggctcgttggcaaaacgctatcttgggcgttacggacagtggcttacgggattcagtatgatgttcttaatgtatgcgctcactgccgcctacatttccggagccggagaattactggcatcaagtattaataactggcttggcgccacgctctcgcccgctgccggagtactgctgttcacctttgttgccggtggggtggtatgtgtgggcacctcgctggtcgacctttttaaccgcttcctgtttagcgcaaagatcatttttctggtcatcatgcttgcgttgctcacgccacatattcataaagtaaatcttcttacgcttcctttacagcaggggctggcattgtccgccataccggtcattttcacctcgtttggttttcacggaagcgtaccgagtattgtgagttatatgaacggcaacattcgccggctgcgttgggtctttatgacgggtagcgccattccgctagtggcctatattttttggcagctcgccacgctgggaagtatcgactcgccgacattcagagggctactggccagccatgccgggttaaatggcctgctgcaggcgctcagagaagtggtcgcttcgccacatgtcgaactggcggtccacctgttcgccgatctggcgctggcgacctcttttctgggcgtagcgctaggattatttgattacctggccgatctattccagcgccgcagtacggtgtccggacgcctgcaaaccgggctgattacctttctgccgccgctggcgtttgcgcttttctacccacgtggatttgtgatggcattaggctatgccggcgtagcgctggcagtgctggcactactcatccctgccatgctggtctggcaatgccgtaaacagagccctcaggcgggatatcgtgtggcaggcggcacgccagcgctggcgctggtgtttatctgcggcattgtcgtgattggcgtccagttttcgatcgcactggggttcctgcccgatccaggttaa

SEQ ID NO: 106681 - protein, 403 aa, Salmonella enterica subsp. enterica serovar Typhi
MKNRTLGSIFIVAGTTIGAGMLAMPLAAAGVGFSVTLGLLIGLWALMCYTALLLLEVYQHVPADTGLGSLAKRYLGRYGQWLTGFSMMFLMYALTAAYISGAGELLASSINNWLGATLSPAAGVLLFTFVAGGVVCVGTSLVDLFNRFLFSAKIIFLVIMLALLTPHIHKVNLLTLPLQQGLALSAIPVIFTSFGFHGSVPSIVSYMNGNIRRLRWVFMTGSAIPLVAYIFWQLATLGSIDSPTFRGLLASHAGLNGLLQALREVVASPHVELAVHLFADLALATSFLGVALGLFDYLADLFQRRSTVSGRLQTGLITFLPPLAFALFYPRGFVMALGYAGVALAVLALLIPAMLVWQCRKQSPQAGYRVAGGTPALALVFICGIVVIGVQFSIALGFLPDPG

SEQ ID NO: 106682 - DNA, 1245 bp, Yersinia pestis
  CDS (1)..(1245)
atgtcgatggccttatcccaaccgttgtcacggccttccgttttgggtggcgcgatgattgtcgcaggtaccgcagtgggtgcgggcatgttctcaatcccaatcgtgacagccggggtatggttcagcggctcagtggtgctgctgatctacacctgggcatgtatgttagtgtccgggctgatgattctggaagctaacctgaactacccaagtggcgccagtttccacaccatggtgcaagacctgctaggcaaggtgtggagctcaattaacgggctgtccattacctttgtgctctacattctgacctacgcctatatctccgccggtggttcgatcatcgcccatacgctgcaaaacgtagccggaattggccagaccagcgcaggctttatctttgcacttttggtggcctttatcgtgtggttatccacccgagcagtggatcgcctcagtacaatattaatcggcggcatggttatcacatttgtcatgtctgtcggtgatatgttcagccatgtagaaagtgcggtgttgtttaatcagacagacagtaatgcccactatctgccctatgcactggcggcattgccttatttgctgacctcttttggctaccacggcaatgtgccgggcctggtgaagtactacaacaaagacagcaaagccgttgtgcgcagcctgctgtacggaacattgattgccttggtgatttatctcctttggcagtatgccattcagggcaatatcgcccgggatgctttcaaacaggttattgccgatggcggtaatatcggcaatctattgcaacaaatggacaccgtttctgccagtaaagccaccagccagctactcaatgccttctcttatatggcactggccagttcgttccttggcgtgtcgctcgggttgtttgattatatttctgatttatttgactttaccgatgaccgcagcgggcgaactaaatcagcattaatgacctttgtccctccgactctcggtgccctgctgttcccggatggcttcttatatgccattggctttgcggggttagccgccaccatttgggcggttattgtgcccgcattaatggcgcgagccagccgtaaacgcttcccacaagcccgttaccgtgctcccggaggccgttttatgattggttttattatcctgtttggcctggtcaatgcggtagcccatatttcagccttgttcggcctattgccggtttatcaatag

SEQ ID NO: 106683 - protein, 414 aa, Yersinia pestis
MSMALSQPLSRPSVLGGAMIVAGTAVGAGMFSIPIVTAGVWFSGSVVLLIYTWACMLVSGLMILEANLNYPSGASFHTMVQDLLGKVWSSINGLSITFVLYILTYAYISAGGSIIAHTLQNVAGIGQTSAGFIFALLVAFIVWLSTRAVDRLSTILIGGMVITFVMSVGDMFSHVESAVLFNQTDSNAHYLPYALAALPYLLTSFGYHGNVPGLVKYYNKDSKAVVRSLLYGTLIALVIYLLWQYAIQGNIARDAFKQVIADGGNIGNLLQQMDTVSASKATSQLLNAFSYMALASSFLGVSLGLFDYISDLFDFTDDRSGRTKSALMTFVPPTLGALLFPDGFLYAIGFAGLAATIWAVIVPALMARASRKRFPQARYRAPGGRFMIGFIILFGLVNAVAHISALFGLLPVYQ

SEQ ID NO: 106684 - DNA, 1203 bp, Haemophilus influenzae
  CDS (1)..(1203)
atgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgataaggctttaattatctctgcaagccctgtatttttcacggcatttggtttccacggttccattccaagtttaaataaatacttagatggcaatgtaaaagcattgcgcttctctattttggtcggctctgccataacactttgtgcttatattctatggcaactatccacgcacggcttgcttacacaaaatgaatttttacaaatcttaaaagaagatgcgactttaaatggcttagtaaaagcaaccttcgccatcactggaagcaatgtgatcgcaagtgcggtaaaattattttctacattagcacttatcacttctttcttaggtgtgggattaggattattagaatgtattgaagatttactaaaacgttcatttaacgttacagcaggtagaatttcacttggtttactgacttttattccaccacttgtttttgcattattttacccagaaggttttattttagcactaggctacgcaggtcaaatgtttgcattctacgccgtagtattgccagttagccttgtttggaaagctcgtcgtgcccacgctaatttgccatacaaagtgtggggaggaaatctgactttaattatcgtattggtattaggcgtgctcattacatccattccatttgcgattcgtgcgggttatttaccctttgttgtaggttaa

SEQ ID NO: 106685 - protein, 400 aa, Haemophilus influenzae
MNKTVGSTLLVAGTMIGAGMLAMPLTSAGIGFGFTLVLLLGLWALLTFSALLFVELYQTAESDAGIGTLAEQYFGKTGRIIATAVLIIFLYALIAAYISGGGSLLKDLLPESFGDKVSVLLFTVIFGSFIVIGTHSVDKINRVLFFVMLAAFAVVLSLMLPEIKFDNLMATPIDKALIISASPVFFTAFGFHGSIPSLNKYLDGNVKALRFSILVGSAITLCAYILWQLSTHGLLTQNEFLQILKEDATLNGLVKATFAITGSNVIASAVKLFSTLALITSFLGVGLGLLECIEDLLKRSFNVTAGRISLGLLTFIPPLVFALFYPEGFILALGYAGQMFAFYAVVLPVSLVWKARRAHANLPYKVWGGNLTLIIVLVLGVLITSIPFAIRAGYLPFVVG

SEQ ID NO: 106686 - DNA, 1242 bp, Neisseria meningitidis
  CDS (1)..(1242)
atgcccaccaaaaccccttcactgttcggcggcgcgatgattatcgccggcacggtcatcggcgcaggtatgctcgccaacccgaccgccacatccggcgtatggtttaccggctcgctggccgtgttgctgtacacctggttttccatgctctccagcggcctgatgattttggaagtcaacacccactacccccacggcgcgagcttcgacaccatggttaaagacctgctcggacggagctggaacatcatcaacggcatcgccgtcgccttcgttttatacctgcttacttacgcttatatcttcgtcggcggcgacctgaccgccaaaggcttaggcagcgcggcaggcggcaatgtttcactcaccgtcggacaactcgtcttcttcggcattctcgccttttgcgtatgggcatccgcacgcttggtcgaccgattcaccagcgtcctcatcggcggcatggtattaacctttatttgggcaaccggcggcctgattgccgatgccaaactgcccgtcctcttcgacacccaagcccctaccggcaccaactactggatttatgtcgccaccgccctgcccgtctgccttgcgtcattcggtttccacggcaacgtctccagcctgctcaaatactttaaaggcgacgcgcccaaagtggctaaatccatctggacgggcacactgattgcgctggtaatttacgtcctctggcaaaccgccatccaaggcaacctgccgcgcaacgagttcgcccccgtgattgccgccgaagggcaagtctccgtcctgattgaaaccctgtccaaattcgcccaaaccggcaatatggacaaaatattgtccctgttttcctatatggcgatcgccacctcgtttttaggcgtaacgctcggactcttcgactacatcgccgacatcttcaaatggaacgacagcgtgtccggccgcaccaaaaccgccgcgctgaccttcctgccgcctctaatttcctgcctgctcttccccaccggctttgttaccgccatcggctacgtcggcctggcggcaaccgtctggacaggcatcatccccgccatgctgctctaccgttcgcgcaaaaaattcggcgcaggcaaaacctataaagtttacggcggcttgtggctgatggtttgggtcttccttttcggcatcgtcaacatcgccgcacaggtattgagccaaatggaactcgtccccgtatttaaaggataa

SEQ ID NO: 106687 - protein, 413 aa, Neisseria meningitidis
MPTKTPSLFGGAMIIAGTVIGAGMLANPTATSGVWFTGSLAVLLYTWFSMLSSGLMILEVNTHYPHGASFDTMVKDLLGRSWNIINGIAVAFVLYLLTYAYIFVGGDLTAKGLGSAAGGNVSLTVGQLVFFGILAFCVWASARLVDRFTSVLIGGMVLTFIWATGGLIADAKLPVLFDTQAPTGTNYWIYVATALPVCLASFGFHGNVSSLLKYFKGDAPKVAKSIWTGTLIALVIYVLWQTAIQGNLPRNEFAPVIAAEGQVSVLIETLSKFAQTGNMDKILSLFSYMAIATSFLGVTLGLFDYIADIFKWNDSVSGRTKTAALTFLPPLISCLLFPTGFVTAIGYVGLAATVWTGIIPAMLLYRSRKKFGAGKTYKVYGGLWLMVWVFLFGIVNIAAQVLSQMELVPVFKG

SEQ ID NO: 106688 - DNA, 1203 bp, Vibrio cholerae
  CDS (1)..(1203)
atgacgcaatcgaagcttttaggcagtactttgattatcgcgggcaccacgattggtgcaggaatgctagctctgcctctagcttccgccggtattggcttctcaacctcattgatgattatgctcggcttgtggatgctgatggcatttactgcattgctgatggtagaaatccaccagtacgcggataaagaggcaactttgcatactctcgccaaacagattttaggcgataaaggcaaatgggttgcgacgttcgctatgttatttttgttttactcgctgtgtgcggcctacattgctggcggcggcgcacaatttacccaacgaattaccgatttcactggcgtgaacgttgaaagttcgagcggtactttgctgtttaccttgattgtcgctttggtcgtcaccgttggaacaggcacagtggatcgcgtcaaccgcgtattatttgccggaaagatgatcgctatggtagcggtactgtttttcctcgcgcccaatgtttcgcagtcttacctactgagtatgccgattcagcagggcttgattgtcgcggccattcccgtcatttttacttcctttggtttccacggcagtattcctgcgattgtgaattacttggatggtgatacccctgcgctgcgcaaagcgattttgatcggctctgcgattccgctagtgatttacattttctggcagttggtcactcttggagtagtaagtcaatctgccctactcgacaatatggggctcacagcgctcatcggtgtactctcgaccacggttcaccaatcaaatcttggcaacatcatcggcgtattcgctgaccttgctctactcacctcgtttttgggtgttagtctaggtttgtttgaatttatgggtgattctctacgtaaccaacaaggtaaaatgaaccgcccattagcgtctgtcgtcaccttcttaccaccgctgatttttgctctgttctacccgcaaggcttcattatggcgctgggctatgccgcgattgcgctcgccattctggccatctttttacctctggtgatggtgatcaaagtgcgccaacaagccactgagcaacactatcaagtcacagggggcaatggggctctgcttgtgacaggtttggtcgggctgctcatcatcggcgcacagctattgattacgttaggcatacttcccgctctcggttaa

SEQ ID NO: 106689 - protein, 400 aa, Vibrio cholerae
MTQSKLLGSTLIIAGTTIGAGMLALPLASAGIGFSTSLMIMLGLWMLMAFTALLMVEIHQYADKEATLHTLAKQILGDKGKWVATFAMLFLFYSLCAAYIAGGGAQFTQRITDFTGVNVESSSGTLLFTLIVALVVTVGTGTVDRVNRVLFAGKMIAMVAVLFFLAPNVSQSYLLSMPIQQGLIVAAIPVIFTSFGFHGSIPAIVNYLDGDTPALRKAILIGSAIPLVIYIFWQLVTLGVVSQSALLDNMGLTALIGVLSTTVHQSNLGNIIGVFADLALLTSFLGVSLGLFEFMGDSLRNQQGKMNRPLASVVTFLPPLIFALFYPQGFIMALGYAAIALAILAIFLPLVMVIKVRQQATEQHYQVTGGNGALLVTGLVGLLIIGAQLLITLGILPALG

SEQ ID NO: 106690 - DNA, 1254 bp, Pseudomonas aeruginosa
  CDS (1)..(1254)
atgtcgtcctctccagctcaaacgcccagccgccggccctcgctgctcggcggttcgatgatcatcgccggcaccgccgtcggcgccggaatgttctccctgcccatcgccatgtccggcatctggttcggctggtcggtggcggtgttcctgctcacctggttctgcatgctgctgtcggggatgatgatcctcgaggccaacctcaactacccggtgggctcgagcttctcgaccatcacccgcgacctgctcggccagggctggaatgtggtcaacgggctgagcatcgccttcgtcctctatatcctcacctatgcctatatctccggcggcggctcgatcatcggctacaccctgtccagcggcctcggcgtgaccctgccggaaaagctcgccgggctgctgttcgccctggcggtggcgctggtggtgtggtggagcacccgcgcggtggaccgcatcaccacgctgatgctcggcggcatgatcattaccttcggcctctccatcagcggcctgctcgggcgcatccagccggcgatcctgttcaacagcggcgagccggacgcggtttactggccctacctgctggcgaccctgccgttctgcctgacttccttcggttaccacggcaacgtgccgagcctgatgaagtactacggcaaggacccgcagcggatcagccgttcgttgtggatcggcaccctgatcgccctggccatctacctgctgtggcaggccagcaccctgggcaccatcccgcgcgagcagttcaagggcatcatcgccggcggcagcaacgtcggcaccctggtggaatacctgcaccggatcaccgcgtcggattcgctgaaagcgttgctcaccaccttctccaacctggcggtggccagctccttcctcggcgtgaccctcggcctgttcgactacctggccgacctgtgcaggttcgacgacagccacttcgggcgcttcaagaccgcgttgctgaccttcgtcccaccgaccatcggcgggctgctgttccccaacggcttcatctacgccatcggtttcgccgggctggccgcggcgttctgggcggtgatcgttccggcgctgatggcgcgggcctcgcgcaagcgcttcggcagcccgctgttccgcgcctggggcggcacgccggcgatcgtgctggtgctgctgttcggcgtggccaacgcggtcgcgcacatcctggccagcctgcactggctgccggagtaccgttga

SEQ ID NO: 106691 - protein, 417 aa, Pseudomonas aeruginosa
MSSSPAQTPSRRPSLLGGSMIIAGTAVGAGMFSLPIAMSGIWFGWSVAVFLLTWFCMLLSGMMILEANLNYPVGSSFSTITRDLLGQGWNVVNGLSIAFVLYILTYAYISGGGSIIGYTLSSGLGVTLPEKLAGLLFALAVALVVWWSTRAVDRITTLMLGGMIITFGLSISGLLGRIQPAILFNSGEPDAVYWPYLLATLPFCLTSFGYHGNVPSLMKYYGKDPQRISRSLWIGTLIALAIYLLWQASTLGTIPREQFKGIIAGGSNVGTLVEYLHRITASDSLKALLTTFSNLAVASSFLGVTLGLFDYLADLCRFDDSHFGRFKTALLTFVPPTIGGLLFPNGFIYAIGFAGLAAAFWAVIVPALMARASRKRFGSPLFRAWGGTPAIVLVLLFGVANAVAHILASLHWLPEYR

SEQ ID NO: 106692 - DNA, 1257 bp, Haemophilus influenzae
  CDS (1)..(1257)
atgatacaacaaaaatctccttctctcttaggcggtgcaatgatcattgcaggtacagcgattggtgcaggcatgctggctaacccaacttcaacggcaggtgtatggtttatcggttcaattcttgctttaatttatacttggttttgtatgacaacctcaggattaatgatcctagaagctaatctacattatccaacaggttcaagttttgacactatcgttaaagatttattaggaaaaagttggaatactatcaatggtctttctgttgctttcgtcttgtatattttgacttatgcctacataacctcaggcggaggcattacacagaatctgctcaaccaagcattcagttctgctgaaagtgcggtagatattgggcgaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaaacatatttaccttatttattgaccgcacttccagtttgtctcgtgtcgtttggtttccacggaaatgtcccgagtctcgtcaaatattacgatcgtgatggtcgtcgcgtgatgaaatcgatctttattggtacaggcttagcattagtgatttacatcttatggcagctcgctgtacaaggtaatttaccacgcactgaatttgcgccagtcattgaaaaaggcggcgatgtttctgcattattagaggctttacataaatatattgaagtggaatacctttccgtcgcattaaatttctttgcttatatggcaatttctacttcattcttaggcgtcactttagggttatttgactatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaattttatttggcatattaaatattgtggcgcaaattggggcaaacttaggttggtttgcaagttttactgggtaa

SEQ ID NO: 106693 - protein, 418 aa, Haemophilus influenzae
MIQQKSPSLLGGAMIIAGTAIGAGMLANPTSTAGVWFIGSILALIYTWFCMTTSGLMILEANLHYPTGSSFDTIVKDLLGKSWNTINGLSVAFVLYILTYAYITSGGGITQNLLNQAFSSAESAVDIGRTSGSLIFCLILAAFVWLSTKAVDRFTTVLIVGMVVAFFLSTTGLLSSVKTAVLFNTVAESEQTYLPYLLTALPVCLVSFGFHGNVPSLVKYYDRDGRRVMKSIFIGTGLALVIYILWQLAVQGNLPRTEFAPVIEKGGDVSALLEALHKYIEVEYLSVALNFFAYMAISTSFLGVTLGLFDYIADLFKFDDSLLGRTKTTLVTFLPPLLLSLQFPYGFVIAIGYAGLAATIWAAIVPALLAKASRQKFPQASYKVYGGNFMIGFVILFGILNIVAQIGANLGWFASFTG

SEQ ID NO: 106694 - DNA, 1191 bp, Chlamydophila pneumoniae, Chlamydia pneumoniae
  CDS (1)..(1191)
atgtcaaataaagttctaggtgggtccttgcttattgcaggttctgccatcggtgctggtgttttagcagttcctgtattgaccgcaaaaggcggttttttccctgcaacttttctctatattgtctcctggcttttttctatggcctcaggcctttgccttcttgaagtcatgacttggatgaaagaatcaaagaacccagtgaacatgctttctatggcggaatctattttaggtcatgtaggcaagatttctatatgccttgtctacttgtttctcttttactccctactgattgcctatttctgcgaagggggaaacatcttatgccgcgtgtttaattgtcaaaatttaggaatctcatggattcgtcaccttggccctctaggttttgctatattgatggggcctatcattatggcgggaacaaaagtgattgattactgtaatcgtttctttatgttcggcttaactgtagcttttggaattttctgtgcccttggatttttaaaaatccaacctagctttctggtgcgttcctcatggttaactacaataaacgcatttcctgtgtttttccttgcttttggattccaaagtatcattcctacgttgtactactacatggacaaaaaagttggagatgttaaaaaggcaattctcataggaacgttgattcctcttgttctctatgtcttatgggaagttgtggttttaggtgctgtctctcttccgattctttcccaggctaagataggtggatatactgctgtagaagctctcaagcaggcccatcgttcttgggcattttatattgctggagaactttttggcttctttgctttagtctcctcttttgtaggagttgctctcggtgttatggacttcctggcagacggtttaaaatggaataaaaaatcacatccattttcaattttctttttaacatttattattccccttgcttgggctgtttgttatcctgaaattgttttgacctgtcttaagtatgctgggggattcggggccgccgtgattatcggggtattcccaacattgattgtgtggaaagggcgttatggcaaacaacatcacagagagaaacagttagttccaggaggaaagtttgctttatttttgatgttcttgttgatagtaataaatgtagttagcatttatcatgagctttaa

SEQ ID NO: 106695 - protein, 396 aa, Chlamydophila pneumoniae, Chlamydia pneumoniae; identical to SEQ ID NO: 79954

SEQ ID NO: 106696 - DNA, 1212 bp, Escherichia coli
  CDS (1)..(1212)
atgaaaaacagaaccctgggaagtgtttttatcgtggcgggaaccacaattggcgcaggcatgctggcaatgccgctggctgcggccggtgttggttttagcgttacgttaatcttgttgattgggctttgggcgttgatgtgctacacggcgctattactgctggaggtgtaccagcatgttccggcagataccggtctgggcacgctggcaaaacgctatctgggacgctacggtcaatggctgacaggcttcagtatgatgttcttaatgtatgctctgactgcagcatacatcagcggtgccggtgaattgttggcctccagcatcagcgactggacaggtatttcaatgtcggcaaccgctggcgtgctgttgttcacttttgttgccggtggcgtggtttgtgttggaacatcgctggtcgatttatttaaccgttttctgttcagcgccaaaattatttttctggtggtgatgctggtattgctgctaccgcatattcacaaagtgaatcttttaaccctgccgttgcaacaggggctggcactgtctgcaatcccggtgatttttacgtcgtttggttttcacggtagcgtgccgagtattgtcagctatatggatggcaacattcgtaagctacgctgggtgtttataatcggtagtgccatccccctggtggcatatattttctggcaggtggcgacgcttggcagcattgattcaacaacctttatgggattgctggctaatcatgctggattaaacgggctgttacaggcgttacgcgaaatggtggcctctccgcatgttgagctggcggtgcatttatttgctgatttagccctcgccacgtcatttctcggcgttgcgttaggcttatttgattatctggctgatttgtttcagcgttcaaataccgttggtggacgattgcaaactggtgcaattacctttctgccgccgttggcgtttgcactgttttatccacgaggatttgtgatggcgctgggttacgccggtgtggcgctggcggtactggcattgattatcccttcactattgacctggcaaagcagaaagcacaatcctcaggcgggttaccgggtcaaaggtggtcgtccggcgctggtggtggtgtttctctgtggtattgctgtgattggcgtgcaatttttgattgcggcagggttgttaccagaagtggggtga

SEQ ID NO: 106697 - protein, 403 aa, Escherichia coli
MKNRTLGSVFIVAGTTIGAGMLAMPLAAAGVGFSVTLILLIGLWALMCYTALLLLEVYQHVPADTGLGTLAKRYLGRYGQWLTGFSMMFLMYALTAAYISGAGELLASSISDWTGISMSATAGVLLFTFVAGGVVCVGTSLVDLFNRFLFSAKIIFLVVMLVLLLPHIHKVNLLTLPLQQGLALSAIPVIFTSFGFHGSVPSIVSYMDGNIRKLRWVFIIGSAIPLVAYIFWQVATLGSIDSTTFMGLLANHAGLNGLLQALREMVASPHVELAVHLFADLALATSFLGVALGLFDYLADLFQRSNTVGGRLQTGAITFLPPLAFALFYPRGFVMALGYAGVALAVLALIIPSLLTWQSRKHNPQAGYRVKGGRPALVVVFLCGIAVIGVQFLIAAGLLPEVG

SEQ ID NO: 106698 - DNA, 1218 bp, Haemophilus influenzae
  CDS (1)..(1218)
atgttctacgaaaaaacaacttccatttttggtggcgcctgtattattgctagtgtttgcgtcggagctggaatgcttggtttaccaacatctggtgctggagcttggacaatatggtcagcattagcaatttgcttaacgatgataatcatgacattatcaggctggttattacttgaggcctattctacttatgatttaagagcatcatttagtaccgtaactaaagatatgctcggttcaactatcaattctattaataatcttgcggtgtattttgtcgggggtattttactttatgcttataccactgcatctggaggtatactagaaaaccttattaaaccgtggattgattttggttcatctacattggcaatttgctccactgtatttgtattagtcttttccttctttgtttggcattccactcgcattgtagacagaatatctgttttattgattgtattcatggggtttacttttatttttagtacttatggattagcaactaatattagtttagatactttattagatattggtggaaaagatacaaactatgcaaaatatgcggtagggatgtttcctgttgcattaacatcttttggttaccatcattctgtttgtactatgcgagcctattatggagacgagaaaaaagctaaatatgccatttcaggtggaacagccattgctcttactctttatttactttggattttttcaattttcggaaatttgcctcgcaatcaatttgcacctgtaatagctagtgatggcaatctagatatattacttaacgctttaggtagagtaatagaatctaacacggttaaacaaatgattaatgccttttctatcgccgcaattttgtcatcttttattggcgtaggattaggcgtattcgattatctcgctgatttcttcaaatttgataatagcaaaattggacgaacaaagtcatgggctgtgactttcctacctccactaattatgtcaattttatttccattgggtttcttaaaagccattggatatgccggcgcagtagcgacaatttggacttgcataattccagcacttcttgcttataaatctcgcaaaataaatgcagcagcaacaacattccgagtttgtggtggaaatggcttaataatctttattgtattatttgggtgttttgtggctattttccattttcctagcaatgtttga

SEQ ID NO: 106699 - protein, 405 aa, Haemophilus influenzae
MFYEKTTSIFGGACIIASVCVGAGMLGLPTSGAGAWTIWSALAICLTMIIMTLSGWLLLEAYSTYDLRASFSTVTKDMLGSTINSINNLAVYFVGGILLYAYTTASGGILENLIKPWIDFGSSTLAICSTVFVLVFSFFVWHSTRIVDRISVLLIVFMGFTFIFSTYGLATNISLDTLLDIGGKDTNYAKYAVGMFPVALTSFGYHHSVCTMRAYYGDEKKAKYAISGGTAIALTLYLLWIFSIFGNLPRNQFAPVIASDGNLDILLNALGRVIESNTVKQMINAFSIAAILSSFIGVGLGVFDYLADFFKFDNSKIGRTKSWAVTFLPPLIMSILFPLGFLKAIGYAGAVATIWTCIIPALLAYKSRKINAAATTFRVCGGNGLIIFIVLFGCFVAIFHFPSNV

SEQ ID NO: 106700 - DNA, 1197 bp, Chlamydia trachomatis
  CDS (1)..(1197)
atgataaacaaaatgttgggcggagccttgcttgtcgcaggaacaaccattggcgccggagtattagccgtccccgtttctacctcagaagggggattcctgcctacgacgttactctatattgtttcttggttcattgctgtggcttccgggtattgctttttggaagtattgacctggacacattcaagaaagaatgtaaatatggtctctatggcagagtatactttaggccataaaagcaagatcattatgtggttggtatacctactgctcttttattccctcttggtggcttatttttgtgatggtgggaatattctcatgcgagtcatgggatgtcgcagttgggatactccttggattcgacatgctatgcctgtagtattttttgctttgttttccccattattaatggcgaaaacatccattatcgatcaatgtaacagggttttcgtttttggcttaggaatcgcattcgctatgttttgctatttcggtttccctcttatgaaaacggatttgttagtaagatctgcttggggagctaccttaaaaggatttcccattttatttttggcatttggatttcaaaacgttgttcctacgttgtatcactacatggataagaacgtaaaagatgtgaagaaggccattgttattggaagttcgattcctttggttctgtacatcatttgggaagccattgtgttaggagccgttcctatttctttcttagaacaagcgaaagtagagggatggactgctattggagcattacaaacagctttgaaatgctcggctttttatgttgcaggggagttttttggattttttgctttgatttcctcatttattggcgtctctttgggtttaaaagacttttttatagatgcttttcaatgggatgagaaaaagcgtaaagtggaaatctttttcttagtttttgttttccctttggtgtgggctgttttctatccaggcattgttttgaaatgtttggagtgcaccggcgctttaggtgagacgatagttttaggagttttccccgtattgatggtatggaaagggcgctacggaaagaaacgttattacggtaaacgcattcttcctggcgggaaagggactctcttggttatgtcagggctagtgcttcttaacctggtgttgattgcccagaagtttctaggctattaa

SEQ ID NO: 106701 - protein, 398 aa, Chlamydia trachomatis
MINKMLGGALLVAGTTIGAGVLAVPVSTSEGGFLPTTLLYIVSWFIAVASGYCFLEVLTWTHSRKNVNMVSMAEYTLGHKSKIIMWLVYLLLFYSLLVAYFCDGGNILMRVMGCRSWDTPWIRHAMPVVFFALFSPLLMAKTSIIDQCNRVFVFGLGIAFAMFCYFGFPLMKTDLLVRSAWGATLKGFPILFLAFGFQNVVPTLYHYMDKNVKDVKKAIVIGSSIPLVLYIIWEAIVLGAVPISFLEQAKVEGWTAIGALQTALKCSAFYVAGEFFGFFALISSFIGVSLGLKDFFIDAFQWDEKKRKVEIFFLVFVFPLVWAVFYPGIVLKCLECTGALGETIVLGVFPVLMVWKGRYGKKRYYGKRILPGGKGTLLVMSGLVLLNLVLIAQKFLGY

SEQ ID NO: 106702 - DNA, 1209 bp, Erwinia carotovora subsp
  CDS (1)..(1209)
atgaaaaatcgtactcttggcagtgtttttatcgttgctggtaccacaattggagcaggaatgttggcgatgccgttggcaacggctggcgtcggatttggtaccacattgatgatattgatcggcctgtgggcactgatgtgttatagcgccttgttgctggttgaagtgtatcagcatcagccgtcacacaccgggttaggcacattggcaaaaatctacctcggccgctggggacagtggattaccggtttcagtatgctatttctgatgtatgcactaacggcggcctatatcagcggcgcaggcgaactgatcgccagtagcatcagccagtggagtggctactcacttccgatgtccgcagggattttgctcttcacgctggttgctggcggcgtcgtctgtatcgggacatcctcagtcgacttgtttaatcgcatcctgtttagcggcaaagtgctgatgctcgtcatcatgctggccgtcatggttccgcatattcagcgcgtcaatctcttaacgctgccgctgcaacagggcctcacgctctcggcattaccggtcattctgacctcattcggctttcacggcagtatccccagcatcgtctactacatggggggagacagccgcaagctgcgccggatatttcttatcggtagcgtgataccgctgattgcctatattttctggcagttcgtgatactaggcagcctcagctcttcgacattcaatgctattttggccgatcaggcaggattgaatgggttgatgcaggcaattcgcacactcgttgcctctccacacgttgaactggccgtccacctgtttgccgatctggcactggcgacctctttcctcggcgtggcgctcgggttgttcgattatttagccgatctgtttaaacgtaaaaatagcgtcacagggcgcgcgcagacgggcttactgacctttattccaccactggtgttcgcactcttttatccacaagggtttgtgatggcgctgggctatgcggcgattgcactggccgtgctggcattacttattcccgttctgctgagctggcaagtacgcaaacagaatcctgaaatacgcgcgactcgcggtggtgtaccggtattggcgctggtgttcgccagcggcgtaagcatcatcctgatccaactagcgatggtggcaggctggttgccatccatcagttaa

SEQ ID NO: 106703 - protein, 402 aa, Erwinia carotovora subsp
MKNRTLGSVFIVAGTTIGAGMLAMPLATAGVGFGTTLMILIGLWALMCYSALLLVEVYQHQPSHTGLGTLAKIYLGRWGQWITGFSMLFLMYALTAAYISGAGELIASSISQWSGYSLPMSAGILLFTLVAGGVVCIGTSSVDLFNRILFSGKVLMLVIMLAVMVPHIQRVNLLTLPLQQGLTLSALPVILTSFGFHGSIPSIVYYMGGDSRKLRRIFLIGSVIPLIAYIFWQFVILGSLSSSTFNAILADQAGLNGLMQAIRTLVASPHVELAVHLFADLALATSFLGVALGLFDYLADLFKRKNSVTGRAQTGLLTFIPPLVFALFYPQGFVMALGYAAIALAVLALLIPVLLSWQVRKQNPEIRATRGGVPVLALVFASGVSIILIQLAMVAGWLPSIS

SEQ ID NO: 106704 - DNA, 1275 bp, Erwinia carotovora subsp
  CDS (1)..(1275)
atggcaacacgtgcagtgaaagaaaatacagtagaaaaaaacggtacagaaaagcgtcttccttcgctgtttggcgggtcgatgattattgcagggacgattattggcgctgggatgttttccctgccggtggtgatgtcgggtgcctggtttttttggtcatttgccgtgttggtcttcacctggttttgtatgtatcactctgggctaatgatattggaggctaaccttaattatcaggcaggtgccagcttcgatacactgaccaaagatttgttgggtaagggttggaatgtgattaacggcatatcgattgcctttgtcctctacattctgacctacgcctatatctctgcgagcggttcaattatccatcacacgcttactgagatgtcgatcgatttctctgcccgcgtcggcggctgcctgtttgcgctatttgttgcgtttaccgtatggctgagcacggcggcggtgagccgcatgaccgcgttttttctggcagcaaaggtactgacctttttcatgacgttcggcagcctgctgtggaatgtgaagccggttgttttactcaatgttgcggaggaggcacccagctaccttccatatgtgttgatgacgctgccattttgtctggcctctttcggttttcatggcaacgttcccagtttggtgaagcattacggccacaagccacaggtaatcaagcgttgtctgtttattggcagcgcgctggcgctggtgatgtatgccatctggctgattggtacgatgggaaatattgctcgtccagattttatcgggattgcagagcggggcggtaatattgacgttctggtacagacgttggccggcgtgctgaatagcccttatctggacgtgttgctcacggtcttttccaacttcgccgtcgcctgttcgtttcttggggtaacgctggggctgtttgattatctggcagatttgctgaaatttgacgatagccgaatgggtagggctaaaacggcgctggtaacctttctgccgcctattattggcgggctggtctatccgaacggttttatttacgcgattggatttgccgggttagctgccaccatatgggcggtgattacgcctgcgttgctggcgcttgcgtcgcgtcgccgcttcggtagcccgcagttccgcgtgcggggcggtaatgcgatggtggtgctggtgctgctatttggcgtcggcaccgcgctgatacatattctttccagcctcgatttgctaccggtttatcgctag

SEQ ID NO: 106705 - protein, 424 aa, Erwinia carotovora subsp
MATRAVKENTVEKNGTEKRLPSLFGGSMIIAGTIIGAGMFSLPVVMSGAWFFWSFAVLVFTWFCMYHSGLMILEANLNYQAGASFDTLTKDLLGKGWNVINGISIAFVLYILTYAYISASGSIIHHTLTEMSIDFSARVGGCLFALFVAFTVWLSTAAVSRMTAFFLAAKVLTFFMTFGSLLWNVKPVVLLNVAEEAPSYLPYVLMTLPFCLASFGFHGNVPSLVKHYGHKPQVIKRCLFIGSALALVMYAIWLIGTMGNIARPDFIGIAERGGNIDVLVQTLAGVLNSPYLDVLLTVFSNFAVACSFLGVTLGLFDYLADLLKFDDSRMGRAKTALVTFLPPIIGGLVYPNGFIYAIGFAGLAATIWAVITPALLALASRRRFGSPQFRVRGGNAMVVLVLLFGVGTALIHILSSLDLLPVYR

SEQ ID NO: 106706 - DNA, 1149 bp, Photobacterium profundum
  CDS (1)..(1149)
atgctggggctcccaagtgcgggagcaggtgcatggacaacttggtcagttttcgcgattacaataaccatggtcgtcatgaccatttcgggttggatgctgctagaggcattcaagaattatgacttaaaggtatctttcaacacggtaaccaaagacatacttggtgataaggtcaacatgttcaataacctgatggtgtactttgtagggggtattttgctgtacgcctacatcacatcttcaggccttatccttcaagatgttctgggcctcgatagcaaaatcacctctatcttgtttgtttttgtattttctcccttcgtttggcactcaactcgagcagtagaccgaatttccgttattttaatcttatttatggtcttaagttttgtatttggtgtgtcagggctggcgatcaaagtagatatgtccatcttgtttaataccattgatgaaaaaacgagctacgcaccctacgcaatggcgatgctgcctgtcgctttgacgtcgtttggttatcaccattctgtggcaacaatgcgtgcttattacggcgaagaggaaaaagcgaaatacgcgattttgggtggcacaataatcgcgttaagtctgtatgttctatggttgttcagcatttatgggaatttacctagaagtcaatttggacctgtgattgagcaaggcggtaacgtagatgcactactaactacattaggctcagtcattgaatctgaaaaagtagcgcatgcgatccataccttctcaatggcggcaattctatcttctttcattggtgttggacttggggtgtttgactatttggctgatttgttcaagttcgaagacaccaaacaaggccgtgcaaaaacgtggctaatgactttcataccacctttgatcctgtcattgctatttccgtttggttttgtcattgccattggctatgccggcgctgcggcaaccgtctggacatgtattattcctgcacttctcgtaagaaaagcacgcacgttagagaatggtgataaaggctttaaagcgccaggcggcaagccaatgactgttctcgtcattagctttggtattttaactgccgtgtttcacttcatgtcgatgttaggcatgcttccagcgtttacaggctaa

SEQ ID NO: 106707 - protein, 382 aa, Photobacterium profundum
MLGLPSAGAGAWTTWSVFAITITMVVMTISGWMLLEAFKNYDLKVSFNTVTKDILGDKVNMFNNLMVYFVGGILLYAYITSSGLILQDVLGLDSKITSILFVFVFSPFVWHSTRAVDRISVILILFMVLSFVFGVSGLAIKVDMSILFNTIDEKTSYAPYAMAMLPVALTSFGYHHSVATMRAYYGEEEKAKYAILGGTIIALSLYVLWLFSIYGNLPRSQFGPVIEQGGNVDALLTTLGSVIESEKVAHAIHTFSMAAILSSFIGVGLGVFDYLADLFKFEDTKQGRAKTWLMTFIPPLILSLLFPFGFVIAIGYAGAAATVWTCIIPALLVRKARTLENGDKGFKAPGGKPMTVLVISFGILTAVFHFMSMLGMLPAFTG

SEQ ID NO: 106708 - DNA, 1266 bp, Photobacterium profundum
  CDS (1)..(1266)
atgacttcaatgagtatgagtaaaacgttcggcagtacgctgatcatcgcaggcacaacaatcggggcgggtatgctagctctccctctcgcatcagcagggttagggttcaccgcagcaacattaacgatgatgggtatttgggcattaatgatttataccgctctattaatgctagaggtacaccaacatgccgataaaaatgcaacattgcataccctggcacatcaattattgggccgcaaaggtcaagtgattgccagcttcgcaatgatgttcctattttacgcattatgtgccgcatacattgcaggcggcggcagccaacttaatgacaagttaacgaattggatggggctaagtcttgcacctcaagtgggtacagttggatttaccgttattattgcaatcgttgtatccataggtacgcattcagtcgatatggttaatcgcgtattattctcactaaaagttattgcattagccgttatgtttgttctattaatgccacatgttcaagcggttaatttggttgagatgccgattcaaaaaggattaatcatttcagcactgcccgtcatttttacctcttttggctttcacggtagcattccctccattgttcgttacgttggtttggatattaaagcactgcgaaaaataatggtcattggctctgcaacaccactgatggtctacatattatggcaagtagcaagtcaaggtgtgcttggtcagcccgatttaatggcaagtacaacactgggttcgtttatagcaacacttagcaatattttacataacccgctcgttagccaatctgtatcagtatttgctgacctagccttggcaacgtctttcttgggggtgagtttaggcttatttgattttatctctgatattttaaatcgtaataatcaagtaaaaggtcgtatgcaaacagcgctggtgacctttgttccacctctttgctttgccctattctacccacaaggctttattatggctttaggctatgcggcgattgcactggttattttggctatttttctacctgttgcgatggtgcgagctcagcgtaagcaaataaacactctaccagtaggtcaagaaacacatacgacaacaactgataaagaaataaagacagcgacttaccaagttcgtggaggtacaccagcattaattactgtgacaagcattggaatactcatcatctctgcacaattgttacaaatgattggggtcatcccttccgtcggataa

SEQ ID NO: 106709 - protein, 421 aa, Photobacterium profundum
MTSMSMSKTFGSTLIIAGTTIGAGMLALPLASAGLGFTAATLTMMGIWALMIYTALLMLEVHQHADKNATLHTLAHQLLGRKGQVIASFAMMFLFYALCAAYIAGGGSQLNDKLTNWMGLSLAPQVGTVGFTVIIAIVVSIGTHSVDMVNRVLFSLKVIALAVMFVLLMPHVQAVNLVEMPIQKGLIISALPVIFTSFGFHGSIPSIVRYVGLDIKALRKIMVIGSATPLMVYILWQVASQGVLGQPDLMASTTLGSFIATLSNILHNPLVSQSVSVFADLALATSFLGVSLGLFDFISDILNRNNQVKGRMQTALVTFVPPLCFALFYPQGFIMALGYAAIALVILAIFLPVAMVRAQRKQINTLPVGQETHTTTTDKEIKTATYQVRGGTPALITVTSIGILIISAQLLQMIGVIPSVG

SEQ ID NO: 106710 - DNA, 1179 bp, Photobacterium profundum
  CDS (1)..(1179)
atgaatttaaaattagtgggtagttcgttaatcattgcaggtaccgcgctgggcgcaggtatgttagccattccaatggtactggcgcagtttggtcttttatggggcacccttttgatgctggtgatttggttgggtacaacctacgccgcattgttattacttgaagccagtattaaatccggtggtggcttagggatgaacaccattgcgcgtaaaaccttgggtaaaggcggccagctggtcaccaacggtttactttacgcgttgttagtatgcttattgatggcttacatcatcggagccggtgatttagtgaagaagatgctgcacggtgttggcattgaaatgtcgatgatgcagacacaaatcttgttcacactggttgcgggcgtagttgttgcctctggtactgctgctatcgataaggttaaccgtctgttgtttgctgtaatggttgtcgtattaggtatcacgctattctcgctcgtgccgactatgtcttttgaacaccttttagatgcggcaagcaatgataaagttgagctaataaaaaccagctcagtgttgttcaccagctttggttttatggtcgtgattccatcacttgtaacctacaacaaaggcgcgtcacaccgtgatttgcgtaacatggttattgtaggctctgttatcccattagcttgttacttattgtggttatatgccgttgtgggtaacttaaccccagaacaattggtgaagttctcgaatgtatctgaattgattgctgcattgggcacgcgtttcagcggtattcaagtgattctgtctaccttcacaggcctagcgttactgacgtcgttcttgggtgtggcgatggcactgtttgatcaaaatgcagatacatttaagcaaaataaagccgttacctatgtacttacctttatttttccgttagttggcgcactttgggctgctgatcagttcttatctgtattgggttatgctggctttattcttgtgttcttggctatctttgtaccaatggcgatgacaatgaaactgcgtagttttgaaaagcaaaagtcagcagggcatgaagtattggctgaagcttaccaagcgggtggcggttcaattgctatggggcttagtttcgtatttggttgcttcttaattggtgctcagctggtataa

SEQ ID NO: 106711 - protein, 392 aa, Photobacterium profundum
MNLKLVGSSLIIAGTALGAGMLAIPMVLAQFGLLWGTLLMLVIWLGTTYAALLLLEASIKSGGGLGMNTIARKTLGKGGQLVTNGLLYALLVCLLMAYIIGAGDLVKKMLHGVGIEMSMMQTQILFTLVAGVVVASGTAAIDKVNRLLFAVMVVVLGITLFSLVPTMSFEHLLDAASNDKVELIKTSSVLFTSFGFMVVIPSLVTYNKGASHRDLRNMVIVGSVIPLACYLLWLYAVVGNLTPEQLVKFSNVSELIAALGTRFSGIQVILSTFTGLALLTSFLGVAMALFDQNADTFKQNKAVTYVLTFIFPLVGALWAADQFLSVLGYAGFILVFLAIFVPMAMTMKLRSFEKQKSAGHEVLAEAYQAGGGSIAMGLSFVFGCFLIGAQLV

SEQ ID NO: 106712 - DNA, 1290 bp, Photobacterium profundum
  CDS (1)..(1290)
atgattcaatatttatgtgagttactcatgaataaattaaatgtatcgaatccagaaaagcaagtgtctttaatgtatggagtggctgttgtcaccagtactgcgataggggttggcatgatgagcttaccgatcgtgagtatcggaatgtggtttcctctaagtatttttgtcatcgctattacggctgtatatatcatctcggcaggctccttattgctcgaagtgaatatgaattaccctcctggtactggcattcatagcatggtgaatgacttgatgggaggaaagcatgcaatgttcaatgattttatgatgttatttaacggctttattctcttgtatgcttatatcaccgtgggaacggaagctgttcagttttatatcgataaaatagtgggttttgaactgaataatgttctctctggtctcttatttaccgctttttttggggtgattttttatacacctcccttaattatcagtcgtatcctgagtgtctttattggcttaatggtcctttcttttatctacatcgcttattccttagggatcaatgtcaacctcggtaatattttgcttccaagcatcgaaaatagtcactcctttggtctcttaccttttgtttttataacacttcccttttttatggccgcgatgggtttccagcagacgatcccaatgctaagacatctttaccatgataatccgcagcgggtagtcaggagtatctttctgggtattactttagtttcctgtatttatcttgtttggctttttgtcatcatggggaatcaatctcaaaacagtatgattttacaggtcgcttcaggggaaagtagcttagaaaatattgtggagaccttaagcagaagtgaagacataaaagccttgatgttcttttttgtacaagtggctgttgtgacttctttcgtgggcgttgctaaaggtttgttggactatttaatggatatttttgttaatcattttaaattaatggcagtgtatcccaaagccttagtgattcttcccccgctcttattatctctactttttccttatgggtttcttattgcgataggctttgccggactcgctggagcaatatggggcggtatttatcctgctttaatggcgcaaataatccggaaaagaatacccacagacgacatggaatttgtgactgtgggagggaagtacacgccctggtttaccttactctacagtttcttaatcatcgttgtgatgttgttggaactggtcgattttttacctaaatatccgaattaa

SEQ ID NO: 106713 - protein, 429 aa, Photobacterium profundum
MIQYLCELLMNKLNVSNPEKQVSLMYGVAVVTSTAIGVGMMSLPIVSIGMWFPLSIFVIAITAVYIISAGSLLLEVNMNYPPGTGIHSMVNDLMGGKHAMFNDFMMLFNGFILLYAYITVGTEAVQFYIDKIVGFELNNVLSGLLFTAFFGVIFYTPPLIISRILSVFIGLMVLSFIYIAYSLGINVNLGNILLPSIENSHSFGLLPFVFITLPFFMAAMGFQQTIPMLRHLYHDNPQRVVRSIFLGITLVSCIYLVWLFVIMGNQSQNSMILQVASGESSLENIVETLSRSEDIKALMFFFVQVAVVTSFVGVAKGLLDYLMDIFVNHFKLMAVYPKALVILPPLLLSLLFPYGFLIAIGFAGLAGAIWGGIYPALMAQIIRKRIPTDDMEFVTVGGKYTPWFTLLYSFLIIVVMLLELVDFLPKYPN

SEQ ID NO: 106714 - DNA, 1284 bp, Parachlamydia sp
  CDS (1)..(1284)
atggaagacaaggaaacgaatcctgaaaaaggaagtttaatttctgcaatattcttagtagcaggaacatgcattggtggaggaatgttagcacttcctgtatcaacaggaataagcggatttattccttcaacaatcgtaatgggatgctgttggattgcgatgactttgtcagcattattgttattagaagtgaatttatggatgaaggaaggcgcgcatgtgattactatgtcttccaccattttaggtccggtaggccgtgtgattagttggattctctttttatttatctcttatgcttctattgtggcttatacatctgctggaggatcgttggttagagatgtagccccttctttattgggaatgtctatttcgaaagaatggggatgcttaatttttatcgtttgctttggaggaattatttactttggaagtcgtattgtgggaaaagtaaatgcgattttttttgttgcgatgattgtggcttatttagctttaatcagtactggattgtctgaagtgaaattagaaatgcttggacatcgtcgttggtcaacatcatttttagcgattcctattttattaacgacatttagttttcaaacaatgttacctagtttgactccttatctaaaaaggaatgcgatagcattacgttgggctattattggaggaacaactttaactttttttgtttatttgatttggcagtttttagttcttggagtcattcctctttttggaccaaatagccttttaaaagctttagaagtaggtgaacctgtaactcaattcgttcgacaacatgtgcaaagctcttgggtttctagtttggccgaatattttggattttttgctcttgttacttcttttttaggaatagctttaggtttgttcgattttttgtctgatggtttaaaaataaaaaagcaaggggtaggaaagattgttttaggtttattgatcgtaattcccacatttattttttctgcttattttgaacgaattttcttgcttgctttagatacttctggagggtttggtgattctattttaaatggaattatgcctgtattaatggtttggattggccgctattatcttcattttcccaatgaaaatcgcgttcctggtggaaaaccgttacttttatttgtcttcgctttctttttgacttcactgattattgaaattttaattcatacaggatttatttgttccatttttgaagcttgtcaaatcatgttaaatcaacaacaatacggtattagcttttaa

SEQ ID NO: 106715 - protein, 427 aa, Parachlamydia sp; identical to SEQ ID NO: 80010

SEQ ID NO: 106716 - DNA, 1200 bp, Parachlamydia sp; identical to SEQ ID NO: 80007
  CDS (1)..(1200)

SEQ ID NO: 106717 - protein, 399 aa, Parachlamydia sp; identical to SEQ ID NO: 80008

SEQ ID NO: 106718 - DNA, 1191 bp, Parachlamydia sp
  CDS (1)..(1191)
atgaaaacttatgcaacccaaaagggaagtctcttaggaggaatcttattagtggctggttgttgcattggagctggaatgttaggcttaccagtgttgagcgcaatggctggttttatccctagtgtcgccatgtttatgacttgttgggcttttatggtttgcacaggccttctgttgttagaagtgaatttatggtttggccaagaaattagtattattacgatggcagaaaaaactttgggagaagtaggaaaaggtgtgagttggtttgtttttctttttcttttttattcgctaatggtggcttatgtagcggcaagtggatctttagtttcagatttagttgaacaagggttcaatcactcttttccccaagggttaggaagtgttttgttttgcttactttttggagtgctcatttatttaggtattggggctgttgactggtttaatcgatttttaatgtgtgggttaattttgacttatgtttgtttaatgataacgggaattccttatatagatgcttctcttttaaaacatcaagattggaatgccgcgactttagttcttccagcagttattgtttcgtttgggtttcataatttgatccctagtttaacaacctatcttaacagcgatcgaaaaactcttttaaaggctatcttgattggaagcgccattcctttagtgatttatttagcttgggaatggttgattttaggattggttcctcttggagaatttaaagaagctttagataaaggggaaatagcaacagaagctttaaaagatgtggtaggaatttcttggattctcgatgttgcacaaggttttgctttttttgcaatagtcacttcttttttaagcgtagctattagttttgttgactttctagcagatggattaaatattcaaaaaactgccggaggtaaaatgtttttagcaggacttgtactagttcctccacttatttgttctatagtttaccctaggatttttttgtcggctttaaattatgctggaggatttggagccgtgattctttttggtatcttgccggctctcatggtttggaaaggtcgttatacaaaaaagattaacttacctcaaattgttcccggagggaggccacttttaattggcgtcattctattttctctatggattatggcccttcaacttatttaa

SEQ ID NO: 106719 - protein, 396 aa, Parachlamydia sp
MKTYATQKGSLLGGILLVAGCCIGAGMLGLPVLSAMAGFIPSVAMFMTCWAFMVCTGLLLLEVNLWFGQEISIITMAEKTLGEVGKGVSWFVFLFLFYSLMVAYVAASGSLVSDLVEQGFNHSFPQGLGSVLFCLLFGVLIYLGIGAVDWFNRFLMCGLILTYVCLMITGIPYIDASLLKHQDWNAATLVLPAVIVSFGFHNLIPSLTTYLNSDRKTLLKAILIGSAIPLVIYLAWEWLILGLVPLGEFKEALDKGEIATEALKDVVGISWILDVAQGFAFFAIVTSFLSVAISFVDFLADGLNIQKTAGGKMFLAGLVLVPPLICSIVYPRIFLSALNYAGGFGAVILFGILPALMVWKGRYTKKINLPQIVPGGRPLLIGVILFSLWIMALQLI

SEQ ID NO: 106720 - DNA, 1260 bp, Desulfovibrio vulgaris
  CDS (1)..(1260)
atgcagaacgcggctcatcgccccgggcagaacgcggcacatcgccccggagtcttcggtggcaccatgatcatcgccggtacgtccatcggcgcaggcatgctcgccctgcccaccatctcggcgggcatgtggttcggctggtcgcttgcggtcatgctgctggcgtggctggtcatgctgctttcgagtcaggcactgctcgaggtgaacctgcatttcgaaccgggggccagcttccacaccctcgtccgcgagacactcggccccggctggagcgtcatcaacggcgcggccgtggctttcgtgctgtacatcctcgtctacgcctacgtcagcgggggcggttccatcatgcggcacaccctgctggcggtctcgggctacgaaccctcgaagctggcggcgggcctctccttcgcgttgctgctggcggcatgtgtgtggtggagcacatggatcgtcgaccgtctgtccgtcatcatgatgggtggcatggtcgtcagcttcatcctctccatgtccgggatgctctcggacatccgcgccgacgtactcttcgacgccggaggcgaaggcggttcggccctcttcgtgtggggggccctctcgacctatctcacctcgttctgcttccacgccagcgtgcccagcctcgtgaagtacttcgggcgcaggcccgccgacatcaaccgctgtctcgtggggggcacgggcatcgccctcgtctgctacctgctgtggatagtggcgtgcgacggcaccatcccccgcgcggagttcagggatgtcatcgccgcaggcggcaacgtgggcgacctcgtgcgtgcggcaggttccaacctgaacagcgggttcatcctgcggatgctcgaagccttctctgcgcttgcggtggcgacgtcgtttctcggggcgggcttgggcctgttcgactacatcgccgacctgtgccgcttcgacgacacgcgcgccggacgcacgaagaccacgctggtcaccttcggccctcccaccgtgggcggtctgctgtggcctgacggcttcctgctggccatcggctgggcggggcttgccgccacggtgtggtcggtggtcgttcccgcactcatgctgcgggcgagtcgcgccacacgtcccgcgccgggctaccgtgtcggcggcggcagccttacggtgcctgcactgctggccttcggcctcgtcaccgccgtgtgccacacgctcttcgtcttcggtgtgctgcccatgtacaggtag

SEQ ID NO: 106721 - protein, 419 aa, Desulfovibrio vulgaris
MQNAAHRPGQNAAHRPGVFGGTMIIAGTSIGAGMLALPTISAGMWFGWSLAVMLLAWLVMLLSSQALLEVNLHFEPGASFHTLVRETLGPGWSVINGAAVAFVLYILVYAYVSGGGSIMRHTLLAVSGYEPSKLAAGLSFALLLAACVWWSTWIVDRLSVIMMGGMVVSFILSMSGMLSDIRADVLFDAGGEGGSALFVWGALSTYLTSFCFHASVPSLVKYFGRRPADINRCLVGGTGIALVCYLLWIVACDGTIPRAEFRDVIAAGGNVGDLVRAAGSNLNSGFILRMLEAFSALAVATSFLGAGLGLFDYIADLCRFDDTRAGRTKTTLVTFGPPTVGGLLWPDGFLLAIGWAGLAATVWSVVVPALMLRASRATRPAPGYRVGGGSLTVPALLAFGLVTAVCHTLFVFGVLPMYR

SEQ ID NO: 106722 - DNA, 1278 bp, Desulfovibrio vulgaris
  CDS (1)..(1278)
atgtcacagtgcatgacagccaacgggcagaccgccacgcaagccggggtgaagaatccctcggttcttggcggcgccatgatcatagccgggacgaccatcggcgcgggcatgttctcgctgccgagcgtctctgccggcatgtggttcttctattccctcttcgtcctgttcggcacgtggctttgcatgtgccattccggcctgatgatcctcgaggccaacctcaactatcccgccgggacatccttcgacaacatcgccaaggactgccttgccagacccgtgcggctgctgaacagcctctcggtggccttcgtgctctacattctcacctacgcctatatcagcggcggcgggtccatcgtcgcgcatacggtgaaggcggctgtgggcatcgacgttcccatgaagctgggcggcttcctcttcgcgcttgtgctcgcgttcgtcgtatggctgagcacccgcgccgtcgaccgcatctccaccatcatgctcggcggcatgatactcaccttcttctcgtcggtgagcggcctcatgttcaacgtgcagcccgctgtgctcttcgacaccggcgacaccagtgcgccatactcgcccttcatactcgccacgcttccctactttctcacctcgttcgggtaccacggcaacgtccccggactcgtgaagtactacaacaaggacccgaaggccgtcgccaagaccatcatctacggcagcttcctcggcctcattctctacgtgtgctggcaactcagcgtactgggcaacatcccgcgcgaggaattcctcgacatcgtcgccaagggcggcaacatgggcatcctcgtgggggcgctgtccaaggtcacaggcagcaccaacctcgactacctgctccaggtcttctcgcatcttgccgtggcgacctcgttcctcggcgtgacgcttggcctgttcgactgcatcgccgatacgctcggcttcgacgactcgcgtctcggacgtaccaagaccgccatcgtcaccttcgtgcccccggccattggcggcctgttctaccccgacggattcatcatggccatcggctttgccgggcttgcagccaccgtgttcgctgtcatcgtacccgccatgatggcactggccacacgcaggaagttcggcaacaccacctaccgcgcccccggcggcaacgtgatgctctatgtgaccatcgcctatggcatcaccgtggccatctgccatgtgctgaccatgttcgacatgctgcctgtctacggcaagtag

SEQ ID NO: 106723 - protein, 425 aa, Desulfovibrio vulgaris
MSQCMTANGQTATQAGVKNPSVLGGAMIIAGTTIGAGMFSLPSVSAGMWFFYSLFVLFGTWLCMCHSGLMILEANLNYPAGTSFDNIAKDCLARPVRLLNSLSVAFVLYILTYAYISGGGSIVAHTVKAAVGIDVPMKLGGFLFALVLAFVVWLSTRAVDRISTIMLGGMILTFFSSVSGLMFNVQPAVLFDTGDTSAPYSPFILATLPYFLTSFGYHGNVPGLVKYYNKDPKAVAKTIIYGSFLGLILYVCWQLSVLGNIPREEFLDIVAKGGNMGILVGALSKVTGSTNLDYLLQVFSHLAVATSFLGVTLGLFDCIADTLGFDDSRLGRTKTAIVTFVPPAIGGLFYPDGFIMAIGFAGLAATVFAVIVPAMMALATRRKFGNTTYRAPGGNVMLYVTIAYGITVAICHVLTMFDMLPVYGK

SEQ ID NO: 106724 - DNA, 1215 bp, Vibrio vulnificus
  CDS (1)..(1215)
atgtcaaagcaaccctcgttaattgggggagcgtgcattattgccagcgtctgtgtcggcgctggaatgctcggcctccccagtgcaggggctggcgcgtggacgctctggtctctattggctctcactcttaccatggtcgtcatgacgctatctggttggctactgctcgaagcgtttaaacactacgaactgcgggtctccttcaatactgtcaccaaagatatgctcggcagcaaagtaaactggttcaacaatttgatggtttactttgtgggtggcattttgctgtacgcttacatcacttcttctggtcttatcttgcaagatgttctgcaaatagacagtaaagtggcctctatcttgttcgttgcggtattttcggcctttgtttggcattcaacacgcgcggttgaccgtatctcggtcattctcattgtctttatggttctcagttttatctttggcgtttcagggttagcgatcaacgtcaaaacctccgttttattcgataccatcaatgagaatgccgattacgctccctacgccatggcgatgcttcccgttgctctaacctcttttggttatcaccattccgtctcttctatgcgctcttattacggcgaagaacgaaaagccaaatacgccattcttggcggaacgattattgcgctgagcctctatttcttatggttactgagcatcttcggcaacttacctcgctcagagtttggctcggtgatcgaacaaggtggcaatgtcgatgtgttgctcaaagcgctgggttcggtgattgaatcagagaaggtctcgcaagcgatcaacgcattctcgatggcggcgattctctcctctttcattggcgttggattaggggtgtttgatttcttggctgatctgtttaagtttggcaactgcaagcgtggcagaagcaaaacttggctggtgacgtttcttccaccgttgatcttgtcgctactgttcccgtttggcttcattattgccattggttatgctggcgcggcggccaccgtctgggcttgtattatcccagtactgctcgcctacaaatctcgttcgatggagaatggctatcaaggctttgtggtaccaggaggcatgtcagtgctcgttctggtactgggttttggtgtgttaaccgccatcttccatatgctggccatggccaacatgttgcccacatttacggggtaa

SEQ ID NO: 106725 - protein, 404 aa, Vibrio vulnificus
MSKQPSLIGGACIIASVCVGAGMLGLPSAGAGAWTLWSLLALTLTMVVMTLSGWLLLEAFKHYELRVSFNTVTKDMLGSKVNWFNNLMVYFVGGILLYAYITSSGLILQDVLQIDSKVASILFVAVFSAFVWHSTRAVDRISVILIVFMVLSFIFGVSGLAINVKTSVLFDTINENADYAPYAMAMLPVALTSFGYHHSVSSMRSYYGEERKAKYAILGGTIIALSLYFLWLLSIFGNLPRSEFGSVIEQGGNVDVLLKALGSVIESEKVSQAINAFSMAAILSSFIGVGLGVFDFLADLFKFGNCKRGRSKTWLVTFLPPLILSLLFPFGFIIAIGYAGAAATVWACIIPVLLAYKSRSMENGYQGFVVPGGMSVLVLVLGFGVLTAIFHMLAMANMLPTFTG

SEQ ID NO: 106726 - DNA, 1206 bp, Photorhabdus luminescens
  CDS (1)..(1206)
atgaagaatcgtactcttggcagtatttttatcgtagcgggcacgacaattggcgcaggaatgctggcgatgccgctggcagcagccggtgtcggttttggaacaaccttcgtgatgttaatcactctttgggttttgatgagctataccgctttattgttggtggaagtttatcaatacagcccggccgatacgggcctgggaacgctggcaaaacgttatcttgggcgaggaggccaatggctcaccggtttcagtatgcttttcctcatgtatgctctgacaaccgcttatatcagtggtgcaggtgagttgctgtcaggcagcctctcttcatggctggataaacctattcctgtttcatacggtgtgctgattttcactcttgtcgcgggttgtgttgtcactatcagtactcaatctgtcgatatgattaaccgcctgctatttacggcaaaaatcatctttctggttattatgctgaccgtcatgatgccccacatcaaaagcactaacttgatgtcaatgcctttggaacaaggtttggtattatcagctattcccgtggtattcacctcttttggttttcacggcagtgtgccaagtatcgtcaattatatgggaggtgatacccgtaagttacgcaaaatatttgttatcggcagtgctatcccactgactgcctatatcttatggcaattagccactctgggtgccatctcttcccatacttttgtcggcatcttagcggagcaatcagggctgaatggactgttaaaagcggtgagagaagttgtcgcgacgcctcgtgtagagcttgctgtccgtctgtttgctgatttggcactggcaacctcatttcttggggtctccttaggtttgtttgactatatggcagatctgttcaaacgccgtaataatgcgacaggccgcctgcaaaccggcatcatgacttttgttccaccactactttgctccttgtactatccaaactttgttatggcgttaactttcgccgcagttgcactgtccattctcgccctgttactgccttccatgctggcttggcgcagtcgtcaaattgaacaaaaagcctatcgggtaaaaggcggaaaacccgttctgattctggtatttctttgcggaattacggtcattaccatccagataggtattgtcagtggtttactgccagaagtaggttaa

SEQ ID NO: 106727 - protein, 401 aa, Photorhabdus luminescens
MKNRTLGSIFIVAGTTIGAGMLAMPLAAAGVGFGTTFVMLITLWVLMSYTALLLVEVYQYSPADTGLGTLAKRYLGRGGQWLTGFSMLFLMYALTTAYISGAGELLSGSLSSWLDKPIPVSYGVLIFTLVAGCVVTISTQSVDMINRLLFTAKIIFLVIMLTVMMPHIKSTNLMSMPLEQGLVLSAIPVVFTSFGFHGSVPSIVNYMGGDTRKLRKIFVIGSAIPLTAYILWQLATLGAISSHTFVGILAEQSGLNGLLKAVREVVATPRVELAVRLFADLALATSFLGVSLGLFDYMADLFKRRNNATGRLQTGIMTFVPPLLCSLYYPNFVMALTFAAVALSILALLLPSMLAWRSRQIEQKAYRVKGGKPVLILVFLCGITVITIQIGIVSGLLPEVG

SEQ ID NO: 106728 - DNA, 1260 bp, Photorhabdus luminescens
  CDS (1)..(1260)
atgtccactgagacaccccagagtttaaagcgccctcccatactgggtggtgcaatgatcattgccggaactgctgtcggtgcaggaatgttctctactcctgtggcaacttccggtgtctggtttactggctcaattattctgctggtttacacatgggtgtgtatgtatttctccggcttgatgatactagaaaccaacctgaactacccatcaggtgcaagcttccataccatgactaaagatttactcggtaaaggatggaatgcaatcaatggtatctctattgcattcgtgctttatatattaacctacgcctatatttcagcgggtggctcaattattgcccacaattttaaaaatattatttcgatatcacaggcaaatgctggctttattttcgcttttatcgttgcatttattgtctggttatcgactcaagctgtcgatcgtttgagcacaattttgatcggcggtatggttattactttttttatgtccgttggcggcatgtttaccgaagttaaatatgtcattttgtttaatcagacggatactacatcaaacgacacggcaacaagttatatatcttacgctttaaccgctctaccctatttactcgtttcattcggatatcacggtaacatcccaagtttagtaaaatattatcataaagatagaaaagccgttattcgcagcctgttattaggtacattaatcgcattaactatttatatcctatggcaatatgtcattcagggaaatattccccgcgaagcattcaaacagattattgctgatggcgggaatatcggtgatttattaaaacacatggataatacaacaaacagcaaaaccgttcaccagcttctaaatgccttctcttatatggcattagcaagttcatttcttggtgtctctttagggctatttgattacatagccgatttcttcggttttaaagataacaacaccggccggttaacatctgcattagtgacatttattccgccaacagcgctagctttactgttccccaatggttttctatatgccattggctttgctggattcgctgcaaccatctgggctgtcattattccagcactgatggctagggcaagtcgccagcgcttccctgaagccagttaccgagcaccaggagggaaattcctcattgggttcgtcattctgtttggtttgataaatgctatagcccatattttgtcctctcttgatttattacctgtgtatcattga

SEQ ID NO: 106729 - protein, 419 aa, Photorhabdus luminescens
MSTETPQSLKRPPILGGAMIIAGTAVGAGMFSTPVATSGVWFTGSIILLVYTWVCMYFSGLMILETNLNYPSGASFHTMTKDLLGKGWNAINGISIAFVLYILTYAYISAGGSIIAHNFKNIISISQANAGFIFAFIVAFIVWLSTQAVDRLSTILIGGMVITFFMSVGGMFTEVKYVILFNQTDTTSNDTATSYISYALTALPYLLVSFGYHGNIPSLVKYYHKDRKAVIRSLLLGTLIALTIYILWQYVIQGNIPREAFKQIIADGGNIGDLLKHMDNTTNSKTVHQLLNAFSYMALASSFLGVSLGLFDYIADFFGFKDNNTGRLTSALVTFIPPTALALLFPNGFLYAIGFAGFAATIWAVIIPALMARASRQRFPEASYRAPGGKFLIGFVILFGLINAIAHILSSLDLLPVYH

SEQ ID NO: 106730 - DNA, 1209 bp, Photorhabdus luminescens
  CDS (1)..(1209)
atgaagaaccgtacttttggcagtacttttattatcgccggaacaaccatcggtgctggtatgctagccatgccattagccaccgccggtgtaggatttggtgtaagtttgatcatgttggttagcttgtgggttttgatgagttacaccgcattattgctggttgaaacttaccaatatgaatcccctgatacggggttagggacacttgctcaacgttatcttggcagcagcggcaaaatattagccggtttcagcatgatgtttctaatgtatgcattaacatcagcctacattagtggcgcaggggaattactgacagtcagcctcaacaaatggctgaatctatctcttcctgcctcagtcggtgttatcctgtttaccgtgattggtgggggagttgtttgcattggtacccgttcagtagatatggttaaccgagttatttttggtgcaaaaattattttcttggtattaatgttggggatgatgatgccgcatgttcagcatattaacttactgaccatgccattagaacaaggattaatactatcttcaattccggtgatattcacctcgtttggttttcacggtagtgttcccagtattgtgaaatatatggatggcgatatccgtcgactccgctgggtgtttatcatcggcagcgcaattccgctaattgcttatattctctggcaattggcgacactcggaagtattaattccagcacattcgtcaatattttagctgaaaacgcagggttgaatggcttattacacagcattcgcgaagttgttgcttcaccgaaaactgagcttgcagtacaaatgtttgccaacctggcgctcgcaacctcattcctcggtgtcacacttggcctgtttgattttctgggtgatctatttaaacgcaaaaatagcgtagccgggcgtatgcaaactggtttgttaactttcgttccgccattgattttcgcgctattttacccaaaaggatttgtaatggcgttaggatatgccgcggtcgcgctatcaattttggcgttagtattgcctagcctcctggcatataaatcccgccagcaaaatgaacgtcgatatcgggtacctggtggtaagcctgtactattactggtgtttgcctgcggtattgcagtaatagcaatccaaattggcatagtcagtggaatgttgccggaagtagggtga

SEQ ID NO: 106731 - protein, 402 aa, Photorhabdus luminescens
MKNRTFGSTFIIAGTTIGAGMLAMPLATAGVGFGVSLIMLVSLWVLMSYTALLLVETYQYESPDTGLGTLAQRYLGSSGKILAGFSMMFLMYALTSAYISGAGELLTVSLNKWLNLSLPASVGVILFTVIGGGVVCIGTRSVDMVNRVIFGAKIIFLVLMLGMMMPHVQHINLLTMPLEQGLILSSIPVIFTSFGFHGSVPSIVKYMDGDIRRLRWVFIIGSAIPLIAYILWQLATLGSINSSTFVNILAENAGLNGLLHSIREVVASPKTELAVQMFANLALATSFLGVTLGLFDFLGDLFKRKNSVAGRMQTGLLTFVPPLIFALFYPKGFVMALGYAAVALSILALVLPSLLAYKSRQQNERRYRVPGGKPVLLLVFACGIAVIAIQIGIVSGMLPEVG

SEQ ID NO: 106732 - DNA, 1245 bp, Photorhabdus luminescens
  CDS (1)..(1245)
atggctactttgccgataaaaaaatcgtctccatctttatttggcggtgccatgatcattggtggaacggttattggtgcgggcatgttttctttaccagttgtcatgtcaggggcatggttttactggtcaattgccactttgatttttacctggttttgcatgttgcattcaggattaatgatattggaagccaatcttaattatcgaattggctcaagtttcagtactataacaaaagatctgttgggcaatggttggaatatcattaatggtattacccttgcttttgttttatatatactgacttacgcttatatttccgcgagcggatcgattattcaacatgctatgcgagaagtatcgatagatttttcacctgggtttgctggttttttatttgctcttgtggttgcatttattgtctggttaagtactaaaacggttagccggatgacgtcgattattcttggtgctaagatattaactttctttatgacgttcggcggtttggtttataacgttaaaccagcggtattgtttaatacaactgaagttaatccaacttactggccttatgtattaatgactttacctttctgtctggcctcctttggatatcatggtaatgttcctagcctgatgaaatattatggaaaagaaccagagaaaataaagagatgcctgtttattgggacatcaatggccttggtgctttatttgatctggttgattggaacaatgggaaatatttcccggcctgattttgtcgaaatcatcgcaaaggggggcaatattgatgttttggttcaatcattaagtggaggattgaacagttctgctctgggtttattattgactcttttttctaactttgcggttgccagctcattccttggtgtcacgcttgggttgttcgattacctggctgatctgcttaaatttgatgacaccaagctggggcgctttaaaacggcattagtgacgtttcttccgccaatggttggtggaatgatttatccgaatggttttattcatgcgataggttttgctggccttgctgcaacagtttgggcggctattgttcccgcattacttgccagagcatcccgtaaacgatttggtagccctatgtatcgagtttggggaggtaatgtgatgatcggcttgattttgctatttggcgtactaaatgctgcggcccatatcttgtcaaattttaacctgctgcccgtttattcataa

SEQ ID NO: 106733 - protein, 414 aa, Photorhabdus luminescens
MATLPIKKSSPSLFGGAMIIGGTVIGAGMFSLPVVMSGAWFYWSIATLIFTWFCMLHSGLMILEANLNYRIGSSFSTITKDLLGNGWNIINGITLAFVLYILTYAYISASGSIIQHAMREVSIDFSPGFAGFLFALVVAFIVWLSTKTVSRMTSIILGAKILTFFMTFGGLVYNVKPAVLFNTTEVNPTYWPYVLMTLPFCLASFGYHGNVPSLMKYYGKEPEKIKRCLFIGTSMALVLYLIWLIGTMGNISRPDFVEIIAKGGNIDVLVQSLSGGLNSSALGLLLTLFSNFAVASSFLGVTLGLFDYLADLLKFDDTKLGRFKTALVTFLPPMVGGMIYPNGFIHAIGFAGLAATVWAAIVPALLARASRKRFGSPMYRVWGGNVMIGLILLFGVLNAAAHILSNFNLLPVYS

SEQ ID NO: 106734 - DNA, 1227 bp, Haemophilus ducreyi
  CDS (1)..(1227)
atgattatgaataaaactttaggcagtacattattggtttcagggacgatgattggtggcggtatgttggctatgccattgacgtcagcaggtattggtttttgtttaactttagtattattggtcgtgctgtggatattgcttacttatagtgccttattatttgtggaagtatatcaaactgcagaacatgatgttggtattggcacattagcggcgcgatattttggtaaaacaggacgagtcattgctacgttagtattaatggtctttttgtatgcgttgttatccgcttatgttacgggcggtggtaatattttagcgtcaatgtttccagctgcgcctgatcatttaatgacagagaaagagaaaattgcgatagtcatgtttacgataatttttggtgcttttattgtttttggcactagaagtgttgatggtattaaccgttttctgttttttattatgttagccggtttagcgttggtactgtttgctttaatgccttttattcagatagataatttactcgcaatgcctgtggataacttattattagtttctgctagcccgatctttttcaccgcttttggatttcatggctctattccaagtttaaataattatttaaatggtaatgtgaaagcattacgttttgctattatagttggttcattgattaccttaatggtttatattttatggcaaatggcgacccacggtttattaagtcaaaccgcatttcttgatatcttacagaaagatccaaccttgaatggtttagtcgtggcaacggcgcaaacaactggcagtaatattattggttatatagtgaagtttttctcggcatttgctttaatcacttcttttttgggggttgcgcttggcttatttgaatgtattaacgatttattaaagcaatcgtttaattttgcatcaaatcgtttaaatgttggcttactgactttctcgccaccattattatttgcattgttttatcctgaaggctttgtgttagctttacgttatgctgggcaaatgtttgcgttttatgctgtagtgttgccggtgttattagtttggaaagttcgtcaactacaccctaatttgccttatcgagtatggggcggcaatgtattactctggttagtggctttacttggtattgtcatcacgtgcattccttttatggtaaaaacaggttgtttacctacagtggtagggtag

SEQ ID NO: 106735 - protein, 408 aa, Haemophilus ducreyi; identical to SEQ ID NO: 79998

SEQ ID NO: 106736 - DNA, 1218 bp, Haemophilus ducreyi
  CDS (1)..(1218)
atgaaaaataaaatattaggcagtgcattaatgattgccggcacaacgattggtgcgggaatgcttgcaatgccattaacttcagcaggaatgggctttggcgcgaccttgtttttgttgattagtttgtggggattattagcttacactggattattgtttatggaagtctatcaaactgcaccaaaacgcgatgtcggtgtggctagtttagctgagcaatattttggtattgttggacgtgtacttgcgactgctactttattagttttactttatgctttattagccgcctatattacaggcggtggctcattattatccggtattttgcctgaaataatggatagtcaattaaccaacaagatcgctatcttattattcactactttattaggtacttttgtcgtggtgggtattaaaggggtagatggattaactcgtgtgctatttatgggcaaaattatagcgtttttacttgtattagcaatgatgttaccaaaagcaaaaattgagaatttatttgctatgccactggataacttattggttatttctgtggtgccaatttttttcacatcatttggttttcacgtaattatggcaagcattaataattacttagaggcggatatcggtaaaattcgcattgcaatttatattggtaccgctattccattaattgcttacttattatggcaattagcaacgcatggcgtattaacgcaagccgaatttgttgaaattttaaagtcagatccaagcttaaatggtttagtaaaagcaactagtcaaattacaggaagtacatttttaggtgaaatgttgcgtttattttctgccttagcattaattacgtcatttttaggcgttgctatgggtatttttgaatgtatcggcgatttattaaaacggattaatttacccacaaatcgtttagtattaacattagtaacctttattcctcctttattatttgctttattttatcctaatggttttattgcagcattaggttatgccggtttattatttgctttttacggaatgttattaccaatagggcttgcatggcgagcacgtaaattacaccctaatttaccttatcgcgtctcgggggggaatagcgcattgctgattgcattattaatgggcattattattatgattattccatttttaattcaatttggttatctaccacaagtaatgggctaa

SEQ ID NO: 106737 - protein, 405 aa, Haemophilus ducreyi
MKNKILGSALMIAGTTIGAGMLAMPLTSAGMGFGATLFLLISLWGLLAYTGLLFMEVYQTAPKRDVGVASLAEQYFGIVGRVLATATLLVLLYALLAAYITGGGSLLSGILPEIMDSQLTNKIAILLFTTLLGTFVVVGIKGVDGLTRVLFMGKIIAFLLVLAMMLPKAKIENLFAMPLDNLLVISVVPIFFTSFGFHVIMASINNYLEADIGKIRIAIYIGTAIPLIAYLLWQLATHGVLTQAEFVEILKSDPSLNGLVKATSQITGSTFLGEMLRLFSALALITSFLGVAMGIFECIGDLLKRINLPTNRLVLTLVTFIPPLLFALFYPNGFIAALGYAGLLFAFYGMLLPIGLAWRARKLHPNLPYRVSGGNSALLIALLMGIIIMIIPFLIQFGYLPQVMG

SEQ ID NO: 106738 - DNA, 1200 bp, Haemophilus ducreyi
  CDS (1)..(1200)
atgcaaaaacaaccttctatttttggcggcgcctgtattattgctggtgtatgtgttggagccggtatgctcggcttacctacttcaggtgctggagcatggacaatttggtcaattattagcttaacattaacaatgattgttatgacactatctggttggctcttactcaatgtttaccaaaattatgatgcacgcgcctctttcaatacggtaacaaaagatttgttaggcaataacattaatattgtaaataatcttgccgtttattttgttggtggcattttactttatgcctatacaaccgcttctggtgggattttatctaacctaaccaactcaacttttgaattaggtgaatacagtaatcgaatttggtcaactatttttgtctttatcttttcattctttgtatggcattctactcgcttagttgatcgtatttcagtgctattgatcctgtttatggcattttcttttgcctttagtatttctggattagtgatcaatatcgatctgccaacgttatttgaccaacaaaatcagcaaggcgaatacgctaaatatgcgttagcaatgttccctattgctttaacgtcttttggttatcatcactcagtatcatcaatgcgcgcctattatggtgaagaacaaaaagcaaaatatgcgattgcaagcggtacatttattgctttaattctctatttattatggattataagtattttgggcaacttaccgcgtcaacaatttattcccattattgctagcaatggtgatttagaaatattactcaatactgtcggtaaagttgttgaatcaccttatgttcgccaagcgattaatgctttttcaatggccgctattctttcttcttttattggtgttggtttggggacctttgattttttagctgatttctttaaatttgataacagtaaaatgggtcggatgaaaagctgggcggcgacttttctaccgccgttagtattttcattaattgcaccgcttggtttcttaaaagcgatcggttatgccggtgctgtcgcaacattatggacctgtattatccccgctttattagcctataaagctcgaaaagggcatttattggtgattacgttggtcttgctatttggtgtttgtacggcaattttccatttccttgcgatgtttgaaattttacctgtcttcaattaa

SEQ ID NO: 106739 - protein, 399 aa, Haemophilus ducreyi
MQKQPSIFGGACIIAGVCVGAGMLGLPTSGAGAWTIWSIISLTLTMIVMTLSGWLLLNVYQNYDARASFNTVTKDLLGNNINIVNNLAVYFVGGILLYAYTTASGGILSNLTNSTFELGEYSNRIWSTIFVFIFSFFVWHSTRLVDRISVLLILFMAFSFAFSISGLVINIDLPTLFDQQNQQGEYAKYALAMFPIALTSFGYHHSVSSMRAYYGEEQKAKYAIASGTFIALILYLLWIISILGNLPRQQFIPIIASNGDLEILLNTVGKVVESPYVRQAINAFSMAAILSSFIGVGLGTFDFLADFFKFDNSKMGRMKSWAATFLPPLVFSLIAPLGFLKAIGYAGAVATLWTCIIPALLAYKARKGHLLVITLVLLFGVCTAIFHFLAMFEILPVFN

SEQ ID NO: 106740 - DNA, 1188 bp, Chlamydophila caviae; identical to SEQ ID NO: 79989
  CDS (1)..(1188)

SEQ ID NO: 106741 - protein, 395 aa, Chlamydophila caviae; identical to SEQ ID NO: 79990

SEQ ID NO: 106742 - DNA, 1281 bp, Coxiella burnetii
  CDS (1)..(1281)
atgattatggaacccccaaatatcctcttcgatgaatctcaagacgtcacattcgtcaatgagattgaatccccaaaagctgaaacgactcgcggaaaagtttttggcgctattttattaattattggcacatcggtcggcggaggcatgttggctttgcccatggcaatcgctgccggtggctattatcactccattttcttattttttggcgcttggctaatcacggtgttggccgctttttacattttagaagctaatttatggctgccggaaaatacgaatctcatttcaatggcgcgaataacgctgggcaaagcgggtcagttaatcacctggattagctatttattgttgttatatacgctattagctgcctacatgtctggcgggaccgatttaattcacaatttactgtcattaattaatatccccacgccgacgtggctggattcgattttattcgttgtgattttaggtgcagttttgttttatggggtgcgcgccgtggattgggtcaaccgcggtttgatgtcaacgaaattagcggtttattttttactggtcttatttatttcgccgcacatcgatgtgggcaaactttctggcggtcgtttagcacttttatccggggcggtcatggtgattatcacttctttcggttatgccactattgtgcctactttgcgaagttatttgaaaagccaagtcaatgccttgcgattaacgatcgccatcggaagcctaatgccgttaattttatatttattatggactttcgttgtcaacggaacgctgggaagccatggagctaatggtttaattcacatggccgcttccaccgacgccgtgagcgaattaagtaatactttatctgctcacgtaaatggcgaacttgtgaaaggattaatccacttttttacttctatttgtatcgcgacttcttttctcggggtctcgttgtgcttatcagattttatggcggatggtttaaaaattaaaaaagaaaaaaacggccgctggttattggttgcattaacccttgcgccgccgcttttagtcattctgttttatccaggcgctttcattgcaagtttaaattacgccggcgttttatgcgtcattttacttatcttcttgcccgcattaatggtctggagcggccgttatgttaaaaagatcgctatcggttacgaagtcatcggcggaaaaacatttattatccttgaaatcctcgtcgcccttgcgttgctgatttttgcgttaatgcatttagggtga

SEQ ID NO: 106743 - protein, 426 aa, Coxiella burnetii; identical to SEQ ID NO: 79988

SEQ ID NO: 106744 - DNA, 1158 bp, Vibrio parahaemolyticus
  CDS (1)..(1158)
atgaacctaaaacttgtcggcagctccctgatcgttgcaggtactgctcttggcgctggtatgcttgccatacctatggtgcttgctcaatttggcctcctttggggcactcttcttatgttgttcatctgggctggaacgacttatgccgctttgcttctacttgaagcgagttgcaaagtcggtggtggcgtaagtatgaacgcaatcgcccgcgaaacacttggtaaaggcggtcagttagtgactaatggtctgctttacgcgttgcttgtttgtctattgatggcttacatcattggcgctggcgatctagtgcaaaaaatcacggcatcagtcggcctctctgtttccactgtttctagccaagttggctttaccatcttagtgggtctgattgtttctgctggcactggtgtggtcgacaagcttaaccgtggtctgtttatcggtatgattgttgcgcttgttttaacgctgtttgctcttgctcctagtgtttcattcgaaggcctaaacgaagtcgttagtagcgacaaaatggcactgatcaaaaccagttctgtgctattcaccagttttggctttatggtcgtcattccttcgttggtgacttacaacaaagaagcgagcaaaactcagctgcgcaacatgatcgttgtcggctctacgattcctttggtttgttacctattgtggttgtttgcggttgtgggtaacttgccgccacatgagctggtacagtactcaaacgtcactgaacttatctcggttcttggtcaacagtacaatggcttggagtttattctgtccatgtttactggtttggcgttgctaacttcattcttgggtgtggcaatggcgctttacgaccaaaacgcggacttgctcaaaaccagcaagccagtggtattcgtcaccacatttattctgccgctacttggtgctgtatttgctccggaacatttcttagcaattttaagctacgcaggcattattcttgtgttcttggcggtttttgttccattgtcgatgacaatgaaagtgcgccgtgtacctgtcgaagacaacagcgtttatgaagctggtggtggtgtgatgggcatgagtatgatcttcctgtttggctgtttcctactatttgcgcaagctgtgtaa

SEQ ID NO: 106745 - protein, 385 aa, Vibrio parahaemolyticus
MNLKLVGSSLIVAGTALGAGMLAIPMVLAQFGLLWGTLLMLFIWAGTTYAALLLLEASCKVGGGVSMNAIARETLGKGGQLVTNGLLYALLVCLLMAYIIGAGDLVQKITASVGLSVSTVSSQVGFTILVGLIVSAGTGVVDKLNRGLFIGMIVALVLTLFALAPSVSFEGLNEVVSSDKMALIKTSSVLFTSFGFMVVIPSLVTYNKEASKTQLRNMIVVGSTIPLVCYLLWLFAVVGNLPPHELVQYSNVTELISVLGQQYNGLEFILSMFTGLALLTSFLGVAMALYDQNADLLKTSKPVVFVTTFILPLLGAVFAPEHFLAILSYAGIILVFLAVFVPLSMTMKVRRVPVEDNSVYEAGGGVMGMSMIFLFGCFLLFAQAV

SEQ ID NO: 106746 - DNA, 1206 bp, Vibrio vulnificus
  CDS (1)..(1206)
atgagccgttcaaagatttttggtagtactttgattattgcaggcaccactattggtgctggaatgcttgcattgccccttgcttcagcagggattggtttttccacctccgtcatgattatgatcggcttttgggttttgatgtcgtataccgcgttgttgatggtggagctccatcaagaggcagatagaagtgcgacgctgcacacgctggcaaaacaaattctaggcacgaaaggaaaatgggttgccagtttcgctatgctgtttctgttttacgcgctttgcgcggcttacattgctggtggtggtgcgcagtttggtgaacgcgttgctgcttggttttccatcgaaatggatgcctctgtggcaacggtcatttttaccgtgattgtggctgcggtggtgaccagtggcacggcgaccgtcgataaagtaaaccgcgttttatttggtttgaaaatggttgccatggtcgcggtgcttttctttcttgctcctaacgtgacggaatcttacttgctcagtatgccgattcaacaagggttgattgtcgctgctctgccagtcatttttacgtcgtttggtttccacagcagcattcctgctattgtgaattaccttgatggggacaccaaagcgctgcgcaaagcgattgtcattggctcgtccatccctctggttatttatgtgttctggcaactggtcacgcttggcgtggtgaatcaagaggtactgcttaataactcagggttgacggcgttgattgcccagttggccgcgaaagttcagcaatcttacttaagccaattggtaggcgtgttcgcggacttggcactgttaacctcatttttaggggtgagcctaggtttgtttgagtttcttggcgatgtcatcaagaagagtggtcagaaacaaaatcgcgtcattcctgctgtggtgacatttacaccgccgctgatgtttgcgcttttctacccacagggcttcattatggcgcttggttacgccgcaattgcattggctgttttggcgattttcttgccggtggtgatggtaaacaaagtacgtaaatcaccagagaagcaggggagttaccaagtggctggtggacaattagcgctaacgctcacaggtgtgaccggggttgtgattgttgctgctcagatcctgataaccgttggggttctgcctgcgttagggtaa

SEQ ID NO: 106747 - protein, 401 aa, Vibrio vulnificus
MSRSKIFGSTLIIAGTTIGAGMLALPLASAGIGFSTSVMIMIGFWVLMSYTALLMVELHQEADRSATLHTLAKQILGTKGKWVASFAMLFLFYALCAAYIAGGGAQFGERVAAWFSIEMDASVATVIFTVIVAAVVTSGTATVDKVNRVLFGLKMVAMVAVLFFLAPNVTESYLLSMPIQQGLIVAALPVIFTSFGFHSSIPAIVNYLDGDTKALRKAIVIGSSIPLVIYVFWQLVTLGVVNQEVLLNNSGLTALIAQLAAKVQQSYLSQLVGVFADLALLTSFLGVSLGLFEFLGDVIKKSGQKQNRVIPAVVTFTPPLMFALFYPQGFIMALGYAAIALAVLAIFLPVVMVNKVRKSPEKQGSYQVAGGQLALTLTGVTGVVIVAAQILITVGVLPALG

SEQ ID NO: 106748 - DNA, 1245 bp, Shewanella oneidensis
  CDS (1)..(1245)
atgaatgcggtaaaaaataagccggtagggaagtctctgctcggtggcgccatgattattgcggggaccactgttggggctgggatgttttcattgcccgttgttggctcaggcatgtggtttggctattcgatattgatgttgctgggtatttggttttgtatgttgatgtcggggctgttactgctcgaaaccaatttacatttcgagccaggcgcaagtttcgataccctcaccaaggaaaccctaggccagttctggcgtatagtgaacggggtttctatcgcctttgtgctctatatcttaacctacgcctatatcagcggtggtggttcgatagtaaaccatagcctacaggggatggggattgaactaccccaaagtgttgccggattagtgtttaccgtggtgctcgcctgtatcgtgttgattagcactaaggctgtcgatcgcattacaaccattatgctaggtgggatgatcatcactttcttcctcgcgattggtaatctactgattgagatcgatgtgactaagttactcgagccggatggaaatcaacgttttataccatatctatgggttgcattgccctttgggctcgccagttttggttatcatggcaacgtgcctagcttggtgaagtattacggcaaagattcctctaccattattaaggccatttttgttggtacttttatcgcgttgattatttacgtttgttggttagtggcgactatgggcaatattccccgcagccaatttagcgagattattgcccaaggtggcaatatgggggtgctcgtcggtgcgctgtcaaaagtgatggaaagtagttggttaaacagtatgttaacgctatttgccaacttagccgtcgcttcatctttcctaggtgtcacactcggtttattcgattacctagccgatttgtttggttttgatgattcgcgctcaggccggatgaaaaccgcgattgttacctttgtgccgccaacagtattcggtttgttattccccgatggctttttgattgctatcggttttgctgctttagcggcaaccgtgtgggcagtgatagtgcccgcgctgatggcttataagtcgaggcaactctttcccaatcaccaaggttttagggtttttggtggcacgccgctgattatccttgtggtgttgtttggtgtggtgacgggggcttgccatttactggcaatggcgaatttattgccgcagttttcctaa

SEQ ID NO: 106749 - protein, 414 aa, Shewanella oneidensis
MNAVKNKPVGKSLLGGAMIIAGTTVGAGMFSLPVVGSGMWFGYSILMLLGIWFCMLMSGLLLLETNLHFEPGASFDTLTKETLGQFWRIVNGVSIAFVLYILTYAYISGGGSIVNHSLQGMGIELPQSVAGLVFTVVLACIVLISTKAVDRITTIMLGGMIITFFLAIGNLLIEIDVTKLLEPDGNQRFIPYLWVALPFGLASFGYHGNVPSLVKYYGKDSSTIIKAIFVGTFIALIIYVCWLVATMGNIPRSQFSEIIAQGGNMGVLVGALSKVMESSWLNSMLTLFANLAVASSFLGVTLGLFDYLADLFGFDDSRSGRMKTAIVTFVPPTVFGLLFPDGFLIAIGFAALAATVWAVIVPALMAYKSRQLFPNHQGFRVFGGTPLIILVVLFGVVTGACHLLAMANLLPQFS

SEQ ID NO: 106750 - DNA, 1188 bp, Shewanella oneidensis; identical to SEQ ID NO: 79975
  CDS (1)..(1188)

SEQ ID NO: 106751 - protein, 395 aa, Shewanella oneidensis; identical to SEQ ID NO: 79976

SEQ ID NO: 106752 - DNA, 1188 bp, Shewanella oneidensis
  CDS (1)..(1188)
atgaattcaaaaatgttaggctcgatagccattgttgcaggcaccgctattggcgcgggaatgttagctttaccgctcgctacagcggccttaggtatggtacctgctattttgttgatggtagtgatttgggggctatcagcttatacctcattgttaatgcttgagattaaccttcgctctggcgtgggtgataatgtccatgcgattacaggcaaattactcggcaagaaaggccagatagtgcagggggcatcatttttgagtctgctggttgctttaacggctgcttatctaacggggggctcgtccctgttggtgcttaaagcccaaaatatgtttgacatagtgttagataaccaactggcggtggtgttatttaccattgtgctcggcggttttgcagcgttaggggtggcttgggttgataaagtctcacgctttttattttcgttgatgattttattgctaattgtcgtggtgctgtttctattacctgaagtcagtatttccaccatagcaactagtgcagtggcgcaatccttgaccagcagttggatggcggctatccccgtggtatttacttcctttggttttcacgtctgtatcgcgaccttagtacgttatttagatggcgataccgtgtctctgcgcaaggtgctattgattggttcaaccattccgctagcctgttatatcttctggttattggtgaccttaggtacggtaggcggcaacgaaattaatggctttaatggttctttacctgcgcttatcagtgcgttacaagagattgcccacacgcctttgatcagcaaatgtatttctctgtttgctgatttagccttaatcacttccttccttggcgttaccttaagcctatacgattttgtggctgagttaacccgtgccaagaagaccttcgtcgggcgggcgcaaacctggttattaacctttgtgccaccgctgttatgcgcactttatgtgccagaaggcttcgttgccgtattaggttttgccgctgtgccgttggtggtgatgattatcttcttgccaattgcgatggccctgcgtcagcgtcaaatacagcctcaaggatatcaggttgtaggcggcacatttgcgctcggtcttgccgggatcttgggggccattattattggtgctcagttatttgtcgcactctaa

SEQ ID NO: 106753 - protein, 395 aa, Shewanella oneidensis; identical to SEQ ID NO: 79974

SEQ ID NO: 106754 - DNA, 1245 bp, Salmonella typhimurium
  CDS (1)..(1245)
atggcaacacttaccaccacccaaacgtcaccttcgctgcttggcggcgtggtgattatcggcggcaccatcattggcgcggggatgttctccctgccggtggtcatgtccggggcgtggttcttctggtcgatggcggcgctggtctttacctggttttgtatgctgcactccgggctgatgattctcgaagccaaccttaactaccgcattggttcgagtttcgacaccatcaccaaagatctgttggggaaaggctggaacgtggtcaacggcatttctattgcctttgtgctctacatcctgacttacgcctatatctcggcgagcggctcaattctgcatcatacctttgctgagatgtcgctgaacgttccggcgcgagcggcaggttttgcctttgcgctgctggtggcgtttgtcgtgtggctgagtacgaaggcggtcagccggatgacggcgattgtgctgggcgcgaaagtgattactttcttcctgaccttcggcagcctgttggggcacgttcagcctgccacgttgtttaacgtggctgaaagccacgcgtcatatacgccgtacctgctgatgacgctgccattttgtctggcctcttttggttatcacggtaacgtaccgagcttgatgaaatattacggcaaagatccgcgtaccatcgtcaaatgcctgatttatgggacgttactggcactagcgctctattccgtctggctgctggggacgatgggcaacatcccgcgtccggaatttatcggcattgcgcagaaaggcggcaatattgatgtgctggtacaggcgttgagcggcgtgctgaacagccgcagcctggatctgctgctggtggtgttctctaactttgcggtcgccagttccttccttggcgtgacgctggggctgtttgactatctggcggatctgtttggttttgatgactcggcaatgggacgttttaaaacggcgctgctgactttcctgccgccgatgattggtggcctgctgtacccgaacggttttctgtacgccattggctatgcaggtttagctgcaactatctgggcggccattgtgcctgcgctgttggcacgtaaatctcgcgaacgtttcggcagcccgaaattccgcgtctggggcggtaaaccgatgattgtactgattctgctatttggcgtcgggaacgcactggtgcatattttatcgagctttaatttgttgccggtgtaccagtaa

SEQ ID NO: 106755 - protein, 414 aa, Salmonella typhimurium
MATLTTTQTSPSLLGGVVIIGGTIIGAGMFSLPVVMSGAWFFWSMAALVFTWFCMLHSGLMILEANLNYRIGSSFDTITKDLLGKGWNVVNGISIAFVLYILTYAYISASGSILHHTFAEMSLNVPARAAGFAFALLVAFVVWLSTKAVSRMTAIVLGAKVITFFLTFGSLLGHVQPATLFNVAESHASYTPYLLMTLPFCLASFGYHGNVPSLMKYYGKDPRTIVKCLIYGTLLALALYSVWLLGTMGNIPRPEFIGIAQKGGNIDVLVQALSGVLNSRSLDLLLVVFSNFAVASSFLGVTLGLFDYLADLFGFDDSAMGRFKTALLTFLPPMIGGLLYPNGFLYAIGYAGLAATIWAAIVPALLARKSRERFGSPKFRVWGGKPMIVLILLFGVGNALVHILSSFNLLPVYQ

SEQ ID NO: 106756 - DNA, 1574 bp, Pantoea agglomerans
  CDS (154)..(1404)
caaccctggccccgcaggggccctgtttctctcctatcacccttcctttatttcagacctgccgccatggcaggtctgcagtagaaccgttattatccagcgaattcagaatgacgccaaaatgataataaagagtcaacaggagaatttctcatggttattaagaaaacaacacccggtttaatgagtggaacgatgcttatcattgccaccgtcataggtggcggaatgttctcactgccgattgctatggctggcatatggttcccaggcgcatcaattattttaacgctcattgccataatgatgctgttaaccggactgatgctggttgaagtcaatctccattatggcggtggtgcgagttttaacaccttcacacaggatttattaggtcataaatggaatgttgtggtgggtatcgcatttggctttgtcttgtatattttaacttatgcttatatttctggctcttctgctgtcatctctcagacggtagaaaaatacagcggattttatcttccagcccgcttatctgtgatcatcgtaagcgtgttggtcggtggcatcgcatggtacagctcgcttttggttggccgtattacaacggtgttaattatcgggaagtttgttgccttttttgctaccttctctggcctgatatggcatgtcgaaggcgctaaacttattgacagtgccgcctgggcgctgcctgatacgcaatatctgccatatattttaatgacgctacctttctgcatcatctcttacggtttccacggcaacgtgcccagtctggtgaagctgtatggcactcagggggttaagaatatcacccggtcgatttttattggcacggctttcgctctgctgctttacatattctggttggtcgtcaccatgggcaatatcagccgcgccgatttttcgcccattatcgccaaaggggggaatattgatgtatttgtcgaggcaatagggggcttatttaccagcacgtctatggatctgatcctcactttctttggtaattttgcggtagccagttcattgctagccgcgacgctggggcttttcgattatattgccgatctgtttcatttttcagacgaccgttctggccggtttaagacggccctggtaacgtatttgccacccgctgtcgtttgtttcatcctgcccggtggctttgtctatgcaattggctatgccggtctggcctttacgatctggagcgttattctcccgccttttcttgtgaaagcggcccgcaagcgttttcccactgcagtctataccgcaccctgtaataacacgatccttaatctggttatcgtggcggggggattcgtttacctgacggtggtacttgatgtattccggctgctgccttcgtttagctaaagtaaagcgagcgcgatgtgtgcaccttatcactatcaccatcctgtgctctcatgctgcctgattagcccagtgtcccttgccgggggctgagcgactcacgtcttcaacacttctcaggcttcagccgcgatgctcccacggacaagctggctgaagctcagtgtcag

SEQ ID NO: 106757 - protein, 416 aa, Pantoea agglomerans
MVIKKTTPGLMSGTMLIIATVIGGGMFSLPIAMAGIWFPGASIILTLIAIMMLLTGLMLVEVNLHYGGGASFNTFTQDLLGHKWNVVVGIAFGFVLYILTYAYISGSSAVISQTVEKYSGFYLPARLSVIIVSVLVGGIAWYSSLLVGRITTVLIIGKFVAFFATFSGLIWHVEGAKLIDSAAWALPDTQYLPYILMTLPFCIISYGFHGNVPSLVKLYGTQGVKNITRSIFIGTAFALLLYIFWLVVTMGNISRADFSPIIAKGGNIDVFVEAIGGLFTSTSMDLILTFFGNFAVASSLLAATLGLFDYIADLFHFSDDRSGRFKTALVTYLPPAVVCFILPGGFVYAIGYAGLAFTIWSVILPPFLVKAARKRFPTAVYTAPCNNTILNLVIVAGGFVYLTVVLDVFRLLPSFS

SEQ ID NO: 106758 - DNA, 1227 bp, Pasteurella multocida
  CDS (1)..(1227)
atgaaaaagacgccttcaattttcggtggtgcctgtattattgccagtgtgtgtgtcggcgcgggtatgttagggttaccaagctcgggtgccggtgcttggacaatttggtctattttgacgatctgttttacgatgtttaccatgacaatttcaggttggttattattagaagcctacaagcattatgatctgcgtgcttcgtttaataccgtgaccaaaagcatgctcgggaattccgtcaatacgatcaataatcttgcagtttattttgtcggggggattttattgtatgcttatactaccgcgtctgggggtatcttaagtggacttgcggcaccgtattttgccttagattcacggatttggtcagtgatttttgtctttgttttttccttctttgtttggcattcaacgcgtattgttgaccgtgtttccgttttactgatcatctttatggcgctttcattcctttttagtgtctttggtttaaccgtaaatattgatttaagcactttatttgatacgaaaggtacagaatcacattatgcgatgtatgcaatgggattattacccgtggcattaacttcctttggctatcatcattcagttgcaacaatgcgagcttactatggtgatgagcgtaaagcgaaatatgcgatccttggcggtaccggtatcgcgttaactctttatctattatgggtggtatcgatttttgggaacttaccacgcgatcaattcgcaccagtgttagccagtgacggaaatttagatgtattacttggcgctttgggtaatgtgattgagtctgcttcagtcaaacaagcgattaatgcgttttcaattgcggcgattttatcttcatttattggtgtgggattaggggtgtttgatttcttagcagatttctttaaatttgataacagcaaagaaggacgtgcgaagtcttgggcggtaaccttcttaccaccactaattctttctgtcgcctacccactcggtttcttaaaagcgattggttatgctggcgcggtagccactatttggacttgtattatccctgccttattagcaagaaaatcacgtagcttaccaaatggacaaacgggctttatggtcggtggcggcaatattacgattgttgtggtcatggtatttggtattgtgactgcgttattccacttccttgccatgtttggcatgttacctgcatttaaagggtaa

SEQ ID NO: 106759 - protein, 408 aa, Pasteurella multocida
MKKTPSIFGGACIIASVCVGAGMLGLPSSGAGAWTIWSILTICFTMFTMTISGWLLLEAYKHYDLRASFNTVTKSMLGNSVNTINNLAVYFVGGILLYAYTTASGGILSGLAAPYFALDSRIWSVIFVFVFSFFVWHSTRIVDRVSVLLIIFMALSFLFSVFGLTVNIDLSTLFDTKGTESHYAMYAMGLLPVALTSFGYHHSVATMRAYYGDERKAKYAILGGTGIALTLYLLWVVSIFGNLPRDQFAPVLASDGNLDVLLGALGNVIESASVKQAINAFSIAAILSSFIGVGLGVFDFLADFFKFDNSKEGRAKSWAVTFLPPLILSVAYPLGFLKAIGYAGAVATIWTCIIPALLARKSRSLPNGQTGFMVGGGNITIVVVMVFGIVTALFHFLAMFGMLPAFKG

SEQ ID NO: 106760 - DNA, 1257 bp, Pasteurella multocida
  CDS (1)..(1257)
atgacaacaaaacaattgccttctcttttaggtggcgccatgattattgccggtacagcgatcggtgctggtatgttagccaatccaacggctacagcaggcgtttggtttatcggttctcttcttctattagcctacacttggttttgcatgaccacgtcaggcttaatgatccttgaagccaatttacactacccaacaggggcgagttttgacaccatcgtgaaagatttactcggcaaacgctggaatctcatcaatggcttatctatcgcttttgtattatatattttaacgtatgcttatatcacatctggtggtggcattacccaacatctcttaaatcaagttctcagccgccctgacaatacggtggaaattggacgtggcttggggtctttacttttttgttgcgtgctcgctggatttgtctggttatcgactaaagccgtggatcgttttaccactgtactgatcggtggcatgatcatcgcctttcttctttccacgagtggactcatggcttctgtcagaagtgatgtgcttttcaataatcttgcgcaaggggaaacacactatttaccttattttctcaccgcacttcctgtttgcttagtctcctttggctttcacggtaatgtaccaagcttagtaaaatactacgatcgtcatgctcaatctgtggtcaaagcaatcttcctcggtaccggtatcgccttcgtgatctatgcattttggcagcttgcggtacaagggaatttacctcgccatcaatttgcaccagtcattgaaaaagggggtgatattgctgccttactaaaagccttatcgcaatatatccaaaccgattacatgggcgtcgtacttaatttctttgcttatatggcgattgcaagctcatttttaggcgtcagtttgggtttatttgattaccttgcggacttattaaaatttgatgacagtagcttagggcgaactaaaaccacgttagtgacctttctgcctccgctcttactcagcttacaattcccttatgggtttgtcgtggcaattgggtatgcaggcttagccgccaccatttgggcagcgattgtcccagccctattagcgaaagccacacgccagcgtttcacggaatctcactatactgtttatggtggtaacttcatgatttattttgtgattttatttggtttgttaaatattttggcacaaattgctgctcaatttggtgttttaccgacatttttaggttaa

SEQ ID NO: 106761 - protein, 418 aa, Pasteurella multocida
MTTKQLPSLLGGAMIIAGTAIGAGMLANPTATAGVWFIGSLLLLAYTWFCMTTSGLMILEANLHYPTGASFDTIVKDLLGKRWNLINGLSIAFVLYILTYAYITSGGGITQHLLNQVLSRPDNTVEIGRGLGSLLFCCVLAGFVWLSTKAVDRFTTVLIGGMIIAFLLSTSGLMASVRSDVLFNNLAQGETHYLPYFLTALPVCLVSFGFHGNVPSLVKYYDRHAQSVVKAIFLGTGIAFVIYAFWQLAVQGNLPRHQFAPVIEKGGDIAALLKALSQYIQTDYMGVVLNFFAYMAIASSFLGVSLGLFDYLADLLKFDDSSLGRTKTTLVTFLPPLLLSLQFPYGFVVAIGYAGLAATIWAAIVPALLAKATRQRFTESHYTVYGGNFMIYFVILFGLLNILAQIAAQFGVLPTFLG

SEQ ID NO: 106762 - DNA, 1215 bp, Pasteurella multocida
  CDS (1)..(1215)
atgaataaaacattgggaagtactttgcttgtttcaggtaccatgatcggcgcagggatgttagcgatgcccttaacgtctgcgggaattggtttcacctttaccgtagttctgttacttgtcctttggttcttattgacatacagtgcattgttatttgttgaagcgtatcaaaccgtagaaagtgatgcggggattggttctctgagtgcggtctattttggtggttttggtcgatttatttctacagcagcattattgatctttttatatgccttgttagccgcgtatgtgacgggcggtggtggtttattgtcttctattctaccaacaattcaatcagccgaaacaacctctcacatttctattgtcattttcacgacagtttttggtgctttcattatcattggtacgcaaacagttgatggactaaatcgtcttttattttttaccatgttagttgcattgggtgctgtattatttttgttagtgcctgaagtaaaaatggataatttaatggcgatgccaattgataaagccctgttgatttctgccagtccggtcttttttacttcctttggttttcatggctcaatacctagcttgaataaatacctgggtgggaatattaaggcattacgtatttcgattttagtcggttcattcattacactgtgtggctatattttatggcaatttggtacgcatggggtgttaacacaatctgttttcttacagattttacaagatgaacctactttgaacgggctggtagccgctaccaaacaagtgacgggaagcagtgtcatttctggtgctgtgaaattattctcggctttggctttaattacttccttcttaggggttgctttagggctttttgagtgtattgaagacttgttaagccgcgtctttaaatttaaagcaggtcgtattacacttgggctactgacttttattccaccattattatttgctttattttatccaaaagggtttattctagccttagggtatgcaggacaaatgtttgctttttatgcggtagtattacctgcagcattagtgtggaaagtgagaaaattgcatccaaatctcccttatcgtgtatcgggtggttcagcattactggtcatttcggcggtattaggtgtgatcattacctcgatcccatttgcgattaaagcaggttatttacctgctgtcgtgggataa

SEQ ID NO: 106763 - protein, 404 aa, Pasteurella multocida
MNKTLGSTLLVSGTMIGAGMLAMPLTSAGIGFTFTVVLLLVLWFLLTYSALLFVEAYQTVESDAGIGSLSAVYFGGFGRFISTAALLIFLYALLAAYVTGGGGLLSSILPTIQSAETTSHISIVIFTTVFGAFIIIGTQTVDGLNRLLFFTMLVALGAVLFLLVPEVKMDNLMAMPIDKALLISASPVFFTSFGFHGSIPSLNKYLGGNIKALRISILVGSFITLCGYILWQFGTHGVLTQSVFLQILQDEPTLNGLVAATKQVTGSSVISGAVKLFSALALITSFLGVALGLFECIEDLLSRVFKFKAGRITLGLLTFIPPLLFALFYPKGFILALGYAGQMFAFYAVVLPAALVWKVRKLHPNLPYRVSGGSALLVISAVLGVIITSIPFAIKAGYLPAVVG

SEQ ID NO: 106764 - DNA, 1212 bp, Pasteurella multocida
  CDS (1)..(1212)
atgaaaaataaaacctttggaagcgcattattagttgcgggaaccaccatcggtgccggcatgcttgctatgccattaacctcggccgaaatgggctttacttacacgttaattctattatttatcctatggggactgctctcttatagtgcgttactttttgttgaagtttaccaaaaagcagaaaccaaaaatgctggaatcgctacccttgcggaacaatattttggcttaccgggacgtattttagctaccttatcacttgtcgtttttatgtacgcgattttatcagcctatgtcacagggggcggttcacttttagccggtgtccttccttttttaggtgagcatgccacaccaatttctatcgtttctttcacgattgtccttggggtatttattgtgatcagtacaggcgcagtagatatgctcacacgcttcctatttatgattaagttagtggcttttgtgtttgtcttattgatgatgttacctttggtcaatggcgataacttactggcaatgccattaaaagattttttaattatttctgccagtcccgtattttttacctcttttggtttccatgtcatcattccaagtattaacagctatttagacggcaatattcgtcgtttacgtattgcaattattacggggacagcgattcctttagtggcttacattatttggcaattagccactcatggtgttttcccacaagcccagttcgtacaaattttaaacactgaccctactttaaatggtttaatcacggcgacttaccaagctacagaaagcgctattatcagccatgcgatgcgtttattctttaccttagcactgattacgtctttcttgggtgtcgcgttatctttattcgattgtttatacgatttacttaaacgagtaaaaatcaaaacaaaccgtgtgtcgctaggtttacttaccttcttacccccattaatttttgcgttgttctaccctgagggttttgtcatggcattaggttatgcggggcaaatgtttaccttttacggtttagtattacctgttggcatggcatggcgtgctagaaaacgttatccggatctaccatatcgtgtcatgggaggcaaccttaccttattcggtgccttaatcttaggtatcttgattatgaatgtgcctttcttaatcaaagccggttatctccctgctgttattggttaa

SEQ ID NO: 106765 - protein, 403 aa, Pasteurella multocida
MKNKTFGSALLVAGTTIGAGMLAMPLTSAEMGFTYTLILLFILWGLLSYSALLFVEVYQKAETKNAGIATLAEQYFGLPGRILATLSLVVFMYAILSAYVTGGGSLLAGVLPFLGEHATPISIVSFTIVLGVFIVISTGAVDMLTRFLFMIKLVAFVFVLLMMLPLVNGDNLLAMPLKDFLIISASPVFFTSFGFHVIIPSINSYLDGNIRRLRIAIITGTAIPLVAYIIWQLATHGVFPQAQFVQILNTDPTLNGLITATYQATESAIISHAMRLFFTLALITSFLGVALSLFDCLYDLLKRVKIKTNRVSLGLLTFLPPLIFALFYPEGFVMALGYAGQMFTFYGLVLPVGMAWRARKRYPDLPYRVMGGNLTLFGALILGILIMNVPFLIKAGYLPAVIG

SEQ ID NO: 106766 - DNA, 24 bp, Artificial sequence
  primer
atgactgatcaagctgaaaaaaag

SEQ ID NO: 106767 - DNA, 26 bp, Artificial sequence
  primer
ttagccaaatttaggtaacacgttaa

SEQ ID NO: 106768 - protein, 419 aa, Artificial sequence
  Variant (2)..(7): xaa in position 2 to 7 is any amino acid
  Variant (10)..(11): xaa in position 10 to 11 is any amino acid
  Variant (16)..(18): xaa in position 16 to 18 is any amino acid
  Variant (20)..(26): xaa in position 20 to 26 is any amino acid
  Variant (28)..(37): xaa in position 28 to 37 is any amino acid
  Variant (39)..(49): xaa in position 39 to 49 is any amino acid
  Variant (51)..(71): xaa in position 51 to 71 is any amino acid
  Variant (74)..(85): xaa in position 74 to 85 is any amino acid
  Variant (87)..(88): xaa in position 87 to 88 is any amino acid
  Variant (90)..(90): xaa in position 90 is any amino acid
  Variant (92)..(93): xaa in position 92 to 93 is any amino acid
  Variant (96)..(99): xaa in position 96 to 99 is any amino acid
  Variant (101)..(128): xaa in position 101 to 128 is any amino acid
  Variant (130)..(143): xaa in position 130 to 143 is any amino acid
  Variant (146)..(174): xaa in position 146 to 174 is any amino acid
  Variant (176)..(198): xaa in position 176 to 198 is any amino acid
  Variant (200)..(203): xaa in position 200 to 203 is any amino acid
  Variant (207)..(207): xaa in position 207 is any amino acid
  Variant (209)..(211): xaa in position 209 to 211 is any amino acid
  Variant (213)..(216): xaa in position 213 to 216 is any amino acid
  Variant (218)..(232): xaa in position 218 to 232 is any amino acid
  Variant (234)..(237): xaa in position 234 to 237 is any amino acid
  Variant (239)..(240): xaa in position 239 to 240 is any amino acid
  Variant (242)..(243): xaa in position 242 to 243 is any amino acid
  Variant (245)..(249): xaa in position 245 to 249 is any amino acid
  Variant (251)..(292): xaa in position 251 to 292 is any amino acid
  Variant (294)..(296): xaa in position 294 to 296 is any amino acid
  Variant (298)..(300): xaa in position 298 to 300 is any amino acid
  Variant (306)..(306): xaa in position 306 is any amino acid
  Variant (310)..(310): xaa in position 310 is any amino acid
  Variant (312)..(314): xaa in position 312 to 314 is any amino acid
  Variant (316)..(326): xaa in position 316 to 326 is any amino acid
  Variant (328)..(333): xaa in position 328 to 333 is any amino acid
  Variant (336)..(336): xaa in position 336 is any amino acid
  Variant (339)..(345): xaa in position 339 to 345 is any amino acid
  Variant (347)..(348): xaa in position 347 to 348 is any amino acid
  Variant (350)..(351): xaa in position 350 to 351 is any amino acid
  Variant (353)..(355): xaa in position 353 to 355 is any amino acid
  Variant (357)..(368): xaa in position 357 to 368 is any amino acid
  Variant (370)..(376): xaa in position 370 to 376 is any amino acid
  Variant (378)..(406): xaa in position 378 to 406 is any amino acid
  Variant (409)..(418): xaa in position 409 to 418 is any amino acid
GXXXXXXGTXXGAGMXXXPXXXXXXXFXXXXXXXXXXWXXXXXXXXXXXEXXXXXXXXXXXXXXXXXXXXXLGXXXXXXXXXXXXFXXYXLXXAYXXXXGXXXXXXXXXXXXXXXXXXXXXXXXXXXXFXXXXXXXXXXXXXXVDXXXXXXXXXXXXXXXXXXXXXXXXXXXXXLXXXXXXXXXXXXXXXXXXXXXXXPXXXXSFGXHXXXPXXXXYXXXXXXXXXXXXXXXGXXXXLXXYXXWXXXXXGXXXXXXXXXXXXXXXXXXXXXXXXXXXXXXXXXXXXXXXXXXFXXXAXXXSFLGVXLGLXDXXXDXXXXXXXXXXXRXXXXXXTFXPPXXXXXXXPXXFXXAXXXAXXXXXXXXXXXXPXXXXXXXRXXXXXXXXXXXXXXXXXXXXXXXXXXXXXGGXXXXXXXXXXG

SEQ ID NO: 106769 - protein, 96 aa, Artificial sequence
  Variant (1)..(1): xaa in position 1 is Ile, Leu, Leu or Met
  Variant (2)..(2): xaa in position 2 is Ile, Val or Leu
  Variant (3)..(3): xaa in position 3 is any amino acid
  Variant (4)..(4): xaa in position 4 is Gly, Ser or Ala
  Variant (5)..(6): xaa in position 5 to 6 is any amino acid
  Variant (7)..(7): xaa in position 7 is Ile, Val or Leu
  Variant (9)..(9): xaa in position 9 is Ala, Gly or Val
  Variant (11)..(11): xaa in position 11 is Met or Val
  Variant (12)..(12): xaa in position 12 is Leu, Phe or Met
  Variant (13)..(13): xaa in position 13 is Ala, Ser or Gly
  Variant (14)..(14): xaa in position 14 is Leu, Ile, Val, Met or Asn
  Variant (16)..(18): xaa in position 16 to 18 is any amino acid
  Variant (19)..(19): xaa in position 19 is Ala, Ser, Gly or Ile
  Variant (20)..(21): xaa in position 20 to 21 is any amino acid
  Variant (22)..(22): xaa in position 22 is Gly or Trp
  Variant (23)..(25): xaa in position 23 to 25 is any amino acid
  Variant (26)..(26): xaa in position 26 is Ser, Thr, Ala or Gly
  Variant (27)..(33): xaa in position 27 to 33 is any amino acid
  Variant (34)..(34): xaa in position 34 is Trp, Met, Ala or Cys
  Variant (35)..(39): xaa in position 35 to 39 is any amino acid
  Variant (40)..(40): xaa in position 40 is Ser, Thr or Ala
  Variant (41)..(41): xaa in position 41 is Gly, Ala or Ser
  Variant (42)..(44): xaa in position 42 to 44 is any amino acid
  Variant (45)..(45): xaa in position 45 is Leu, Val or Met
  Variant (46)..(46): xaa in position 46 is Glu or Asn
  Variant (47)..(58): xaa in position 47 to 58 is any amino acid
  Variant (59)..(61): xaa in position 59 to 61 is any or no amino acid
  Variant (62)..(62): xaa in position 62 is Thr, Ser, Ala, Gln, Asp or Asn
  Variant (63)..(63): xaa in position 63 is Leu, Ile, Met, Val or Phe
  Variant (64)..(64): xaa in position 64 is Ala, Thr, Val or Ser
  Variant (65)..(67): xaa in position 65 to 67 is any amino acid
  Variant (68)..(68): xaa in position 68 is Leu, Phe, Met or Ile
  Variant (69)..(69): xaa in position 69 is Gly, Ala or Pro
  Variant (70)..(82): xaa in position 70 to 82 is any amino acid
  Variant (83)..(83): xaa in position 83 is Leu, Val, Ile, Phe or Asn
  Variant (84)..(84): xaa in position 84 is any amino acid
  Variant (85)..(85): xaa in position 85 is Tyr, Gly, Val or Phe
  Variant (86)..(86): xaa in position 86 is any amino acid
  Variant (87)..(87): xaa in position 87 is Leu, Ser or Ile
  Variant (88)..(89): xaa in position 88 to 89 is any amino acid
  Variant (92)..(95): xaa in position 92 to 95 is any amino acid
  Variant (96)..(96): xaa in position 96 is Gly, Ser or Thr
XXXXXXXGXGXXXXPXXXXXXXXXXXXXXXXXXXXXXXXXXXXXXXXXXXXXXXXXXXXXXXXXXXXXXXXXXXXXXXXXXXXXXXXXXAYXXXXX

SEQ ID NO: 106770 - protein, 54 aa, Artificial sequence
  Variant (1)..(1): xaa in position 1 is Pro, Ser or Met
  Variant (2)..(5): xaa in position 2 to 5 is any amino acid
  Variant (6)..(6): xaa in position 6 is Ser, Ala or Thr
  Variant (7)..(7): xaa in position 7 is Phe, Met or Tyr
  Variant (8)..(8): xaa in position 8 is Gly, Ser, Ala or Cys
  Variant (9)..(9): xaa in position 9 is Phe or Tyr
  Variant (10)..(10): xaa in position 10 is His, Gln, Met or Ala
  Variant (11)..(12): xaa in position 11 to 12 is any amino acid
  Variant (13)..(13): xaa in position 13 is Val, Ile, Met or Leu
  Variant (14)..(14): xaa in position 14 is Pro, Ser, Ala or Cys
  Variant (15)..(15): xaa in position 15 is any amino acid
  Variant (16)..(16): xaa in position 16 is Leu, Ile, Met or Val
  Variant (17)..(18): xaa in position 17 to 18 is any amino acid
  Variant (19)..(19): xaa in position 19 is Tyr, Leu, His or Cys
  Variant (20)..(25): xaa in position 20 to 25 is any amino acid
  Variant (26)..(27): xaa in position 26 to 27 is any or no amino acid
  Variant (28)..(28): xaa in position 28 is Leu, Ile, Val or Ala
  Variant (29)..(34): xaa in position 29 to 34 is any amino acid
  Variant (36)..(36): xaa in position 36 is Ser, Thr, Gly, Ile or Cys
  Variant (37)..(37): xaa in position 37 is any amino acid
  Variant (38)..(38): xaa in position 38 is Ile, Leu, Met, Phe or Thr
  Variant (39)..(39): xaa in position 39 is any amino acid
  Variant (40)..(40): xaa in position 40 is Leu, Phe or Ser
  Variant (41)..(42): xaa in position 41 to 42 is any amino acid
  Variant (44)..(45): xaa in position 44 to 45 is any amino acid
  Variant (47)..(51): xaa in position 47 to 51 is any amino acid
  Variant (53)..(53): xaa in position 53 is any amino acid
  Variant (54)..(54): xaa in position 54 is Leu, Val, Ile, Phe or Gln
XXXXXXXXXXXXXXXXXXXXXXXXXXXXXXXXXXGXXXXXXXYXXWXXXXXGXX

SEQ ID NO: 106771 - protein, 85 aa, Artificial sequence
  Variant (2)..(4): xaa in position 2 to 4 is any amino acid
  Variant (5)..(5): xaa in position 5 is Ala or Cys
  Variant (6)..(6): xaa in position 6 is Leu, Ile or Val
  Variant (7)..(7): xaa in position 7 is any amino acid
  Variant (8)..(8): xaa in position 8 is Thr, Ser or Cys
  Variant (10)..(10): xaa in position 10 is Phe or Leu
  Variant (11)..(11): xaa in position 11 is Leu, Ile, Val or Phe
  Variant (12)..(12): xaa in position 12 is Gly, Ser or Ala
  Variant (13)..(13): xaa in position 13 is Val, Ala or Ile
  Variant (14)..(14): xaa in position 14 is Ala, Thr, Ser or Gly
  Variant (15)..(15): xaa in position 15 is Leu, Met, Ile or Lys
  Variant (16)..(16): xaa in position 16 is Gly, Ser, Ala or Cys
  Variant (17)..(17): xaa in position 17 is Leu, Val, Ile, Phe or Thr
  Variant (18)..(18): xaa in position 18 is any amino acid
  Variant (19)..(19): xaa in position 19 is Asp or Glu
  Variant (20)..(20): xaa in position 20 is Tyr, Phe, Cys or Gln
  Variant (21)..(22): xaa in position 21 to 22 is any amino acid
  Variant (23)..(23): xaa in position 23 is Asp, Ala or Glu
  Variant (24)..(27): xaa in position 24 to 27 is any amino acid
  Variant (28)..(34): xaa in position 28 to 34 is any or no amino acid
  Variant (35)..(35): xaa in position 35 is Arg, Lys, Ser or Ala
  Variant (36)..(39): xaa in position 36 to 39 is any amino acid
  Variant (40)..(41): xaa in position 40 to 41 is any or no amino acid
  Variant (42)..(42): xaa in position 42 is Thr, Val, Ile or Cys
  Variant (43)..(43): xaa in position 43 is Phe, Tyr, Val, Leu or Ile
  Variant (44)..(44): xaa in position 44 is any amino acid
  Variant (45)..(45): xaa in position 45 is Pro, Phe, Ile or Leu
  Variant (46)..(46): xaa in position 46 is Pro or Thr
  Variant (47)..(53): xaa in position 47 to 53 is any amino acid
  Variant (54)..(54): xaa in position 54 is Pro, Ala or Glu
  Variant (55)..(55): xaa in position 55 is any amino acid
  Variant (56)..(56): xaa in position 56 is any or no amino acid
  Variant (57)..(57): xaa in position 57 is Phe or Val
  Variant (58)..(58): xaa in position 58 is Leu, Ile or Val
  Variant (59)..(60): xaa in position 59 to 60 is any amino acid
  Variant (61)..(61): xaa in position 61 is Leu or Ile
  Variant (62)..(62): xaa in position 62 is any amino acid
  Variant (63)..(63): xaa in position 63 is Tyr, Phe, Gly, Cys or Thr
  Variant (64)..(64): xaa in position 64 is Ala, Ser, Thr or Val
  Variant (65)..(65): xaa in position 65 is Gly or Ala
  Variant (66)..(73): xaa in position 66 to 73 is any amino acid
  Variant (74)..(74): xaa in position 74 is any or no amino acid
  Variant (75)..(75): xaa in position 75 is Ile, Phe, Val or Leu
  Variant (76)..(76): xaa in position 76 is any amino acid
  Variant (78)..(79): xaa in position 78 to 79 is any amino acid
  Variant (80)..(80): xaa in position 80 is Leu, Met or Ile
  Variant (81)..(84): xaa in position 81 to 84 is any amino acid
FXXXXXXXSXXXXXXXXXXXXXXXXXXXXXXXXXXXXXXXXXXXXXXXXXXXXXXXXXXXXXXXXXXXXXXXXXXXPXXXXXXXR

SEQ ID NO: 106772 - DNA, 1023 bp, Escherichia coli K12
  CDS (1)..(1023): transl_table=11
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatgcgctcagtcgcgctccacgccatcgttgattttttcaacaggcataactcacccagcggaaaccgctctacagaggtttaa

SEQ ID NO: 106773 - protein, 340 aa, Escherichia coli K12
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRMHDRFCELRTAAGHPVEGGRPLVIKGAYHEILFEKDAMRSVALHAIVDFFNRHNSPSGNRSTEV

SEQ ID NO: 106774 - DNA, 942 bp, Homo sapiens
  CDS (1)..(942)
atggaaacaggacctgaagacccttccagcatgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctga

SEQ ID NO: 106775 - protein, 313 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 106776 - DNA, 978 bp, Mesorhizobium loti MAFF303099
  CDS (1)..(978): transl_table=11
atgacggaccttctccacgacacgccgcttttccatgaaactgagggcaatccgcgaccggaaaacgctaccggcggctttttcattacgcgcgaccgcaagaagatccgctatggcctcttcgcggcggtggcgcgcccgatgcggggcaccgtggtgctcctgtccggccgcaacgagtgcatcgagaaatatttcgaaaccatccgcgaccttgccgcccgcggctttggtgtcgccacgctcgattggcgcggccagggcgattccgaccggctgatccgcgatcgccagcgcggctatgtcaggtccttccgcgactacacggccgatctggagcagttcttcgaggagatcgtgctgcccgattgccgcgggccgtattacatcctcgcccattcagccggagcggtgatcgcgctgcttgccgcgccgtcgatggtgaaccgcgtgcggcgcatggtgctgatcgcgccattcctgacgttgcccgacctgccggtctcgatccgaacggtccgccgcgtctgttcggtcttctgcgctttggggctcggccggctctatgccgcctggggtccacggcccagacacacgctgccgttcgaggccaacaaggtaacgtcggatccgcggcgctaccgccgcaacacgcgcatctacgaagagtatccgcgaatggcgcttggcggtccgacgatccgctggctgcaggcggcggcgaaggcgtcggaagccatcagcgaccccgacttcatggcccgcatacaggtgcctctgctgatcatcgccgccggcgccgaccgggtcgtctcgaccagggcggtggaagcctatgccagaagcctgaggctcggttcgctgctgatgatcgacggctccaagcacgaaatcctgcaagaggtcgatctctaccgcgaacaattccttgccgccttcgacgccttcatccccggctcggacgacccgacggcctga

SEQ ID NO: 106777 - protein, 325 aa, Mesorhizobium loti MAFF303099
MTDLLHDTPLFHETEGNPRPENATGGFFITRDRKKIRYGLFAAVARPMRGTVVLLSGRNECIEKYFETIRDLAARGFGVATLDWRGQGDSDRLIRDRQRGYVRSFRDYTADLEQFFEEIVLPDCRGPYYILAHSAGAVIALLAAPSMVNRVRRMVLIAPFLTLPDLPVSIRTVRRVCSVFCALGLGRLYAAWGPRPRHTLPFEANKVTSDPRRYRRNTRIYEEYPRMALGGPTIRWLQAAAKASEAISDPDFMARIQVPLLIIAAGADRVVSTRAVEAYARSLRLGSLLMIDGSKHEILQEVDLYREQFLAAFDAFIPGSDDPTA

SEQ ID NO: 106778 - DNA, 954 bp, Arabidopsis thaliana
  CDS (1)..(954)
atggcaagtgaaacagagaacatcaagtatgaagagagtttcatcaagaacactcgaggaatgaaactgttcacgtgcaaatgggtaccagcaaagcaagagccaaaggctttagtctttatttgccatggatatgcaatggaatgtagcatcaccatgaacagtactgcgaggaggctggtgaaagcaggatttgcggtatatggaattgattacgaagggcatggaaaatctgatgggcttagtgcttatgtcccaaactttgaccatctcgttgatgatgtctctactcactacacaagcatttgcgagaaagaagagaataaagggaagatgaggttcttgttaggagaatcaatgggaggagcagtgcttttgttgttacacagaaagaagcctcagttttgggatggggctgtcttggttgctccaatgtgtaagattgctgaagaaatgaaaccaagccctttggtaatttcgatattggccaaacttagtggagtgataccttcgtggaaaatcatccctggccaagatatcattgagactgcttttaagcagccagaaatcaggaaacaggttagggaaaatccctactgctacaagggacgtccacgtttgaagactgcttatgagcttttgagggttagcaccgatctcgagaagaggcttaatgaggtttcattaccgttcatagttttgcacggtgaagacgataaagtcacagataaagcggtgagtcgacaactgtatgaagttgcatctagttcggacaagactttcaagttgtaccctgggatgtggcatggtttactctatggagagacaccagagaatatcgagactgtttttgctgacatcattggctggttggataagaaagttgctgatgaaagtggaggctttgaatccgagcttaaacgtaaaaatgatggtattcctttgaaagggtag

SEQ ID NO: 106779 - protein, 317 aa, Arabidopsis thaliana
MASETENIKYEESFIKNTRGMKLFTCKWVPAKQEPKALVFICHGYAMECSITMNSTARRLVKAGFAVYGIDYEGHGKSDGLSAYVPNFDHLVDDVSTHYTSICEKEENKGKMRFLLGESMGGAVLLLLHRKKPQFWDGAVLVAPMCKIAEEMKPSPLVISILAKLSGVIPSWKIIPGQDIIETAFKQPEIRKQVRENPYCYKGRPRLKTAYELLRVSTDLEKRLNEVSLPFIVLHGEDDKVTDKAVSRQLYEVASSSDKTFKLYPGMWHGLLYGETPENIETVFADIIGWLDKKVADESGGFESELKRKNDGIPLKG

SEQ ID NO: 106780 - DNA, 939 bp, Arabidopsis thaliana
  CDS (1)..(939)
atggttatgtacaaagaggattatgtttcgaactcacgagggatacaacttttcacgtgttcatggaaacaagaggagcagcaagaaccaaaggctttaatctttctctgtcatggctacgccatggaatcaagcatcaccatgagcagcactgcagtgaggttggccaatgcgggtttctcggtctatggaatggactatgaagggcatggtaaatccgggggattaaatggttacgtcaaaaagtttgatgatcttgttcaagacgtctcttctcattactcttcaatttgcgagttggaagagaataaggggaagatgaggtttctaatgggagaatccatgggaggagcagttgtgttactcttggagagaaagaagcccaatttttgggacggtgccgttttagtcgctcccatgtgtaagttagcagaagacataaagccacatccaatggtgatctcatttctcacaaagctaactcggtttattccaacttggaagatagttcctagcaacgatattattgacgtagcatttaaagaaacccacataagaaaacaggtaagggacaatgagtattgctacaagggccgtcctcgcttgaaaaccgctcaccaacttttaatggttagcttggatcttgagaagaatcttgatcaggtatcgatgccatttattgtccttcacggtgaagatgataaagttacagacaaaaacgtaagcaaactattatacgaggtagcttcaagttcggacaagacttttaagttatacccgaacatgtggcatgggctcttatacggagaatctcctgagaatttggagattgtgtttagtgatatcataagctggttaaaggagagagcttctgtcacaaaccaaaagttggagactgagttaaagcatgtagatgatggtttttctatgcaaaaatga

SEQ ID NO: 106781 - protein, 312 aa, Arabidopsis thaliana
MVMYKEDYVSNSRGIQLFTCSWKQEEQQEPKALIFLCHGYAMESSITMSSTAVRLANAGFSVYGMDYEGHGKSGGLNGYVKKFDDLVQDVSSHYSSICELEENKGKMRFLMGESMGGAVVLLLERKKPNFWDGAVLVAPMCKLAEDIKPHPMVISFLTKLTRFIPTWKIVPSNDIIDVAFKETHIRKQVRDNEYCYKGRPRLKTAHQLLMVSLDLEKNLDQVSMPFIVLHGEDDKVTDKNVSKLLYEVASSSDKTFKLYPNMWHGLLYGESPENLEIVFSDIISWLKERASVTNQKLETELKHVDDGFSMQK

SEQ ID NO: 106782 - DNA, 840 bp, Mycobacterium tuberculosis H37Rv
  CDS (1)..(840): transl_table=11
atgactaccacccggactgaacggaatttcgcgggcatcggcgatgtgcgcatcgtctacgacgtctggacgccggacaccgcgccgcaagcggtggtcgtgctggcccatggtctgggcgagcatgcccgccgctacgaccatgtcgcgcagcggctcggcgcggccggcctggtcacctatgcgcttgaccaccgcgggcatggccgctcgggtggcaaacgggtgctagtgagagacatctccgagtacaccgctgacttcgacaccctcgttgggatcgccacccgggaatatcccgggtgcaagcgcatcgtgctcgggcacagcatgggcggcggcattgtgttcgcttacggtgtcgaacgtccagacaactacgacctgatggtgctttcggcgccggcggtggcggcacaggacctggtgagcccggtagtggcggttgccgccaagcttctgggcgtcgtggtgcccggcctgccggtgcaggaactggattttactgccatctctcgcgaccctgaggtggtccaggcttacaacaccgacccactcgtgcaccacggacgggttccggccgggattggccgcgcgctgctgcaggtgggcgagaccatgccgcggcgagcaccggcattgaccgcgccgctgctagtgctgcacggcaccgatgaccggctgatccccatcgagggcagccgtcgcctggtcgaatgtgtgggatcggccgacgtgcagctgaaggagtatcccgggctgtaccacgaggtgttcaacgagccggagcgcaaccaggtgctcgacgatgtggtcgcctggctcaccgagcggttgtag

SEQ ID NO: 106783 - protein, 279 aa, Mycobacterium tuberculosis H37Rv
MTTTRTERNFAGIGDVRIVYDVWTPDTAPQAVVVLAHGLGEHARRYDHVAQRLGAAGLVTYALDHRGHGRSGGKRVLVRDISEYTADFDTLVGIATREYPGCKRIVLGHSMGGGIVFAYGVERPDNYDLMVLSAPAVAAQDLVSPVVAVAAKLLGVVVPGLPVQELDFTAISRDPEVVQAYNTDPLVHHGRVPAGIGRALLQVGETMPRRAPALTAPLLVLHGTDDRLIPIEGSRRLVECVGSADVQLKEYPGLYHEVFNEPERNQVLDDVVAWLTERL

SEQ ID NO: 106784 - DNA, 1017 bp, Vibrio cholerae O1 biovar eltor str. N16961
  CDS (1)..(1017): transl_table=11
atgaaccctgaaaaaaatctttatccttatacgcaagagtcgagtttggagcaagctctcaactttgagatagctcaagtgtggcacactcgaagcgaaggaacctatcgcagttttgataaaacgcacatttattggtgtagtctcaagcatcctgagcatcaaaaagccgtagtgattgtgaatggcaggattgaatctgcgtggaaatatcaagagctgtgttatgacctattccgccaaggttttgatgtttatacctatgatcaccgtggtcaaggacggtcagaacgtctgactgaagatagacaaataggccatgtacatgagtttcaagattacgtgactgacttaaaagccttagtcgagcatttcgatctcggtcactaccaagagcgctttttattagcccattctatgggtggcgcgattgctacgcgctatatccagaccactccagcgcacccctttagcgcactggccctgagtgctccgatgtttggcgtgaatatgccttggtatttaaggccatgggctttgctcatcactcaaattatggctgccgttaccctaaaacccagttacgctccgggttatggcccttatcacgctaaaccctttcatctcaacctgctcacccacagtgaaacccgctatcagttgtttcgtgaactgtatgaagcgcaccctgaactgcaaattggagggccgagtcaccgctgggtttggcagagcttaatggcgaccaaacagtgtttgcagttaacccgacaaatcaaaatccccatgctgatcttacaagctggcgaagaagcgattgtgtgtaatcgggcgcaaatccggctcttcaaaaagctgtctcgcacccaaaaacgtgccgctttatgccgcatagcaggagccagacatgaactgctttttgaacaagatgcctaccgaaatcagacgttagaccatattttgcgttttttcgccgacagtactatcgaccataaaagacagcaccatcgaccatag

SEQ ID NO: 106785 - protein, 338 aa, Vibrio cholerae O1 biovar eltor str. N16961
MNPEKNLYPYTQESSLEQALNFEIAQVWHTRSEGTYRSFDKTHIYWCSLKHPEHQKAVVIVNGRIESAWKYQELCYDLFRQGFDVYTYDHRGQGRSERLTEDRQIGHVHEFQDYVTDLKALVEHFDLGHYQERFLLAHSMGGAIATRYIQTTPAHPFSALALSAPMFGVNMPWYLRPWALLITQIMAAVTLKPSYAPGYGPYHAKPFHLNLLTHSETRYQLFRELYEAHPELQIGGPSHRWVWQSLMATKQCLQLTRQIKIPMLILQAGEEAIVCNRAQIRLFKKLSRTQKRAALCRIAGARHELLFEQDAYRNQTLDHILRFFADSTIDHKRQHHRP

SEQ ID NO: 106786 - DNA, 954 bp, Pasteurella multocida subsp. multocida str. Pm70
  CDS (1)..(954): transl_table=11
atgatccgtgaaccccattttactcactttgccttggctgaattacatccttttgcagcacaatttccgttgcaagacgtacaagggaaaaaaggggtacgtattacctatcggcattttgtacaagacaatcccgtacagcgtaatttggtgattttagtcaatggacgtgcagaaaacttattgaaatggactgaactggcttatgatttctatcaacaaggctacgacgtcttggtatttgatcatcgtgggcaaggctattcacagcgtttattgccagatcatgagaaaggttatattgatgagtttcgtttttatgcggacgatatggcgattttattagcgaaaatcagcgcactttatccttatgaaaatcaacatattctcgcccattccttaggtgcattgattagtacttattaccttgccaattacgatcatcaggtgaaaagtgcggtcttttctgcgccattttatggcattcctctcaaacattctttccgagatgagctcattattaatctaatgatgttattaggtcagggttcacgctatgtgtttggcaaaggacgttatcaaccggcggatttggataataatgatttaagttgttgtcgaactcgtatgcgctggatgaatcgaattaatcgtcggtatccgcatattcatttagggggaccgaccttccgttgggtgcatttatgttttagtgccattaaaaaattaccgactattttgccgcgtattgagattcctgtgctgattctacaatcggagaaagaaaagattgtggaaaataaaaatctgcgcaaactcaccgcacttttaccacgaggagagttaacacaaattgcgcaaagtaaacacgaaattttatttgagcgtgatcttatccgctccgaggcactcaagaaaattagccaattttttactgccaatagcgccaaataa

SEQ ID NO: 106787 - protein, 317 aa, Pasteurella multocida subsp. multocida str. Pm70
MIREPHFTHFALAELHPFAAQFPLQDVQGKKGVRITYRHFVQDNPVQRNLVILVNGRAENLLKWTELAYDFYQQGYDVLVFDHRGQGYSQRLLPDHEKGYIDEFRFYADDMAILLAKISALYPYENQHILAHSLGALISTYYLANYDHQVKSAVFSAPFYGIPLKHSFRDELIINLMMLLGQGSRYVFGKGRYQPADLDNNDLSCCRTRMRWMNRINRRYPHIHLGGPTFRWVHLCFSAIKKLPTILPRIEIPVLILQSEKEKIVENKNLRKLTALLPRGELTQIAQSKHEILFERDLIRSEALKKISQFFTANSAK

SEQ ID NO: 106788 - DNA, 1092 bp, Clostridium acetobutylicum ATCC 824
  CDS (1)..(1092): transl_table=11
atgaggaagttaagtaagaaggtttttttgatttttgctgtaacaacaatttttattcttggaaattcagcttgggataggaccatagcatctgaagaggataattctatgattgatggaaaacctaaagagtattatataagtgaaaaaaactataaaagagaaataaagcaagttgaaaattatcttagtgctaggcgagaatcagggcattttattggaaaggaaaatatagatatttactacgaaaaatatgttataccaaattcaaagaattcaattgtaatatcccatgggtttagggagagtatggtaaagtataatgaaacaatatattattttttgaaaaatggatattccgtatatggattggaacatagaggccatgcaagatcaggtagattaggaaaagattcaacacaaacaagtgtagataattttgattattatgtagatgattttaaaaaatatgttgatactatagtagaaccggataatagagggaaaaatttattcttatatgcacattctatgggaggagcaattggaggcttatttctagaaaggtatcctaaatatttcaaagccgcagttttaagttctccaatgtttgaggtagatacgggaagataccctgaatttttgtcaagagctgttgcaagtgtatttaactttgtgaatttaggagatacatatgctcctggtcaccatgagtattcttgtgaatcggattttgaaaattcctgcacaacaagtaatattagatatgattattatttagataaaactaacaagagtagaaaaattgaaaatggtggagcttcgtttaagtgggtaaaggaatctttaaaggcaacagatgaggttacagacggaaaaaatgcatcaaaagtaactattccagtgttgttatttcaagccgaaaatgatgatatagtaaggccaggaggacaagataagtttgcaaaagaagctaagaagtgtaaactaatagtgattaagaattcaaagcatgaaatatatagagaaaaggatagtataatggttccatatttcaataaggtatttacttttcttaataacaataagtag

SEQ ID NO: 106789 - protein, 363 aa, Clostridium acetobutylicum ATCC 824
MRKLSKKVFLIFAVTTIFILGNSAWDRTIASEEDNSMIDGKPKEYYISEKNYKREIKQVENYLSARRESGHFIGKENIDIYYEKYVIPNSKNSIVISHGFRESMVKYNETIYYFLKNGYSVYGLEHRGHARSGRLGKDSTQTSVDNFDYYVDDFKKYVDTIVEPDNRGKNLFLYAHSMGGAIGGLFLERYPKYFKAAVLSSPMFEVDTGRYPEFLSRAVASVFNFVNLGDTYAPGHHEYSCESDFENSCTTSNIRYDYYLDKTNKSRKIENGGASFKWVKESLKATDEVTDGKNASKVTIPVLLFQAENDDIVRPGGQDKFAKEAKKCKLIVIKNSKHEIYREKDSIMVPYFNKVFTFLNNNK

SEQ ID NO: 106790 - DNA, 984 bp, Sinorhizobium meliloti 1021
  CDS (1)..(984): transl_table=11
atgaccacgctccttcactcgatgccggaaaatccgatgccgggcgatccggtggttggctttttcgacggagcccgcaaccgcaagatccgctacgcggtgttcaggtcgaaggccccggtcattcgcggcaccatcgtcctgctgcagggtcgcaacgagtcgatcgagaaatacttcgaaacgatcggcgatctcatggcggccggtttctgggtcgcgaccttcgactggcgcggacagggcggctccgagcggctgtcgccgcaatggacccacggccatgtggaggatttcaccgattacgagcgcgacctgacgatttttctcgatgagatcgtccttcccgacacccgcctgcccttctcgatcgtcgcccattcgatgggggcgctcgtcgccctgtcgctcgctcccatgctcgcaagccgcatcgaccggatggtgctgcttgcccccttcgtcggtctggggggccaggcgatcggcgaacggggtatcgcagcgatcgcgacggtcatgcgctggatcggcctcgggaggctggcgctgagttccgacaaaggcaacggtaccccttttaggggcaatgttctgaccgcggacgaccggcgctacgcccgcaacctggcgctcatcgatgcgcgtccgcaactgcgggtcggaccgcccacggcccgctggctgagcgaggccttccgaacgatccggcgcgtcctcaagcacgaacatctgacgaggatcaccataccggccgtcatactcgccccgacggccgataagctcgtgccgtatctcccggtcgagcggttggccagcaatttccgtgcggggcatctgatcccgatcgacggcgcgcggcacgaactcctgcaggaggccgaccgctatcgcgcccaggcgatggccgcgatcctggcctttctgccgggcgccgatgcggaggaccccgcgtccctgccgcgacagttggaagaggcttaa

SEQ ID NO: 106791 - protein, 327 aa, Sinorhizobium meliloti 1021
MTTLLHSMPENPMPGDPVVGFFDGARNRKIRYAVFRSKAPVIRGTIVLLQGRNESIEKYFETIGDLMAAGFWVATFDWRGQGGSERLSPQWTHGHVEDFTDYERDLTIFLDEIVLPDTRLPFSIVAHSMGALVALSLAPMLASRIDRMVLLAPFVGLGGQAIGERGIAAIATVMRWIGLGRLALSSDKGNGTPFRGNVLTADDRRYARNLALIDARPQLRVGPPTARWLSEAFRTIRRVLKHEHLTRITIPAVILAPTADKLVPYLPVERLASNFRAGHLIPIDGARHELLQEADRYRAQAMAAILAFLPGADAEDPASLPRQLEEA

SEQ ID NO: 106792 - DNA, 1077 bp, Caulobacter crescentus CB15
  CDS (1)..(1077): transl_table=11
atgcgtcgccgtctcctcgcagccgtcccggctatcgcgctcagcctggccgtctccgcttgcggcgacggggcctcccgcgcgccgtttgcagagagtcgaacaccacccgccctgaccgcccgcttctatccgccgcagggatgggcctggggatacatccagtccggcggcggtccagtgcagcgctacggcgtcgccgcgccgccggtgtcgccccgaggaacgatcctgatcctcaccggttatggcgaaacagctgaaaagtggttcgaaaccgtgtcggacctcacgcggcgcggctttaccgtctgggtcctagaacgtcagggacagggcgggtctgaacgactgacgccgtggcgtgatcttggccacatcgacagcttcgatcctgacgtggcggtcgtcaaagcgctggtcaatactgtgatccgccccaagggcgggacacgcttcgttgtgctgggacatggtgaaggcggtttagtcgcgctgcgagcggcgcagacaggtctgccgatggacgcccttgtgctctcatccccggcgttcggcctgagcgccctaccccggccccgctccgatttcgccagatttacgccggcgctgagaaccctccgactgggctgggtccgctcttcggaccagaggggctggcgtcgagacggtccagacggcaaggctgctggcctcacccacgacgccgaccgtggcaaggttcaggccgcctggatgctggccaaccccgatcttcgcatgggcgggcggagcctgggatggttcgccgcgttcttcgacgcgtcagaggccgccgcgcgcgatattggcaaggcgaccgtccccgtcctgatgctcaacgccggccgtgaccgcgtcgtcaccgcaaagcctcaaacgcgcctctgcagagaaatgaaggcctgccgcgagatccactacgccgaaggcgcacacgacctgcacatggaatcggacgccgttcgcgtcccttggctcaccgaagttgcgaagctcgcagcgcccgatgcgccgccaaaacccagtccgacgaaggatcaaggtcacggattgtga

SEQ ID NO: 106793 - protein, 358 aa, Caulobacter crescentus CB15
MRRRLLAAVPAIALSLAVSACGDGASRAPFAESRTPPALTARFYPPQGWAWGYIQSGGGPVQRYGVAAPPVSPRGTILILTGYGETAEKWFETVSDLTRRGFTVWVLERQGQGGSERLTPWRDLGHIDSFDPDVAVVKALVNTVIRPKGGTRFVVLGHGEGGLVALRAAQTGLPMDALVLSSPAFGLSALPRPRSDFARFTPALRTLRLGWVRSSDQRGWRRDGPDGKAAGLTHDADRGKVQAAWMLANPDLRMGGRSLGWFAAFFDASEAAARDIGKATVPVLMLNAGRDRVVTAKPQTRLCREMKACREIHYAEGAHDLHMESDAVRVPWLTEVAKLAAPDAPPKPSPTKDQGHGL

SEQ ID NO: 106794 - DNA, 981 bp, Caulobacter crescentus CB15
  CDS (1)..(981): transl_table=11
atggaggaaccggcgcctctggtctcgattcccgaggccccggttcccgaccacggcaaggctgaatggttccgcggcgcggatggggcgaccctccgcgccgcgacgtttttcccggcaggccccgcccggggttcggtggtgctcagccccggacgcagcgagccgcttgagaagtatttcgaggtcgtcgacgaccttttggcgcgcgatttcgccgtcttgctgcatgactggcgagggcaggggctgtcggcccgcgccttgccggaccgcctgaagggtcacgcgcgcggcttcaagaccttcgtttccgactacgaggcgctgctcgatgcgttcgagacgcggatgcctaagccctggatcgcggtcagccattcgatgggcggttgcctgacgaccctggccctggcccagggcgagacacgtttcgccgccgccgtgttgtcggcgccgatgctgggcctcaacaccgccggcgtgccgccgtggctggcgcggcctctggctttcgtgatgtcgcgggtgggtttggccggcgagtacgtgcagacgccgtatgacccgctgacccagaccttccagggcgacggtctgacccacgatgagacgcgctatgatcgctaccaggcgcaactgcgcgcccaccccgagatcgctctggggggcatgacctggggctgggctgatttcgccatctcagcgtgcgcgtggctcaggcgcagcaagtcggtcgaagcgatcgcgattccggtgatcattctcggcgctgaactcgacaaccgcgtgctgaacgccgactccgagtcgatcgcacgacgtatcccgaaggggcgctatgtcgaggtccccggggccttccacgagattctggtcgagaccgacgcccgccgcgcgctgttctggcaggccttcgacgagacggtcgatccgatcgctgcgcgcgaaccgcttatttcgccgaacgtctcagactga

SEQ ID NO: 106795 - protein, 326 aa, Caulobacter crescentus CB15
MEEPAPLVSIPEAPVPDHGKAEWFRGADGATLRAATFFPAGPARGSVVLSPGRSEPLEKYFEVVDDLLARDFAVLLHDWRGQGLSARALPDRLKGHARGFKTFVSDYEALLDAFETRMPKPWIAVSHSMGGCLTTLALAQGETRFAAAVLSAPMLGLNTAGVPPWLARPLAFVMSRVGLAGEYVQTPYDPLTQTFQGDGLTHDETRYDRYQAQLRAHPEIALGGMTWGWADFAISACAWLRRSKSVEAIAIPVIILGAELDNRVLNADSESIARRIPKGRYVEVPGAFHEILVETDARRALFWQAFDETVDPIAAREPLISPNVSD

SEQ ID NO: 106796 - DNA, 942 bp, Agrobacterium tumefaciens str. C58
  CDS (1)..(942): transl_table=11
atgatcgaagccacattgcgcgccagtgaagacaacccggttcccggcaaccagaccgtcggatattttaccggccacggcggcaaacagcttcgttatgcgatctttcgcgccacccgctccattgcccgcggaacagtggttctgctgcacggcaggaacgaatgtatcgagaaatatttcgaaacggtcgccgatctgacggccatgggcttctgggtcgcgacattcgacacgcgcgggcagggcggttccgaaaggctcctgaaaaagcccggcgtcgggcatgtgcggcgcttttccgattatcagcgcgatatcagcctgtttctcgagcaggttgtcctgccggatacgcggctgcccttcttcatgatcgcccattccaccggcgcgcttgcggccctcgcggccgcgcccggcctgtcgaaccggatcgaccgtctggcgctgtgttcgcctttcatcgagctggatagtcagcaatcggttccacggtccgtcatccggctggttgcgacggccttgagccttgtcggcctgggcagggttcagctcggcagggaccagcgcgagcgggatttcgacggcaatccattgacctcggacgccagacgttttgcaaggaatctgaccctgcaccgacagtttccggaactgttcatcggcgcgccgacggcgcgctgggtctatgaagcgctgaagaccatggggcgagtgacccgccaggatcacctgacgaacatcaccgttccgaccctcattctggcgccgatgctggatacgattacgccctataaggcgcaggaagagctttcgcgcaatttccgggcagcacagcttcttccgataaccggcgcgcgccacgaattgctgcatgagcgcgacgttttccgcaaacaggcgctggcggccatcgacgcgtttttcgcgccggagtga

SEQ ID NO: 106797 - protein, 313 aa, Agrobacterium tumefaciens str. C58
MIEATLRASEDNPVPGNQTVGYFTGHGGKQLRYAIFRATRSIARGTVVLLHGRNECIEKYFETVADLTAMGFWVATFDTRGQGGSERLLKKPGVGHVRRFSDYQRDISLFLEQVVLPDTRLPFFMIAHSTGALAALAAAPGLSNRIDRLALCSPFIELDSQQSVPRSVIRLVATALSLVGLGRVQLGRDQRERDFDGNPLTSDARRFARNLTLHRQFPELFIGAPTARWVYEALKTMGRVTRQDHLTNITVPTLILAPMLDTITPYKAQEELSRNFRAAQLLPITGARHELLHERDVFRKQALAAIDAFFAPE

SEQ ID NO: 106798 - DNA, 996 bp, Brucella melitensis 16M
  CDS (1)..(996): transl_table=11
atgtcggaactgctttttgaaaccgatgcaaatccgatcccgagccgaataagaggcggtcttttccatgcgccggacgggaaggccctgcgctactccctgctgaaagccgaaagccggccgtgccggggcacggtcatcgtgcttcagggccgcaacgaattcatcgaaaattattatgaaaccatgtccgacctcgccgggcgcggttttaccgttgccaccttcgactggcgcggccagggcggctcgcatcgcctgctgcgcgaccgcctgcgcggctatgtgcgcagcttcaacgattatgccgacgatctcgaccatttcctgaccggaatcgtgctgcccgactgcccgccgccatttttcattctcgctcactcggcaggtgcgctggtcgcgctttcctcactggaacggctctcctcccgcatcacccgcatggtgctttgcgcgcccctgatggggcttggcggacagaaaatcagcgatgacaatgtgcgccgcattaccgccgcgctgcgctggatcggcctggggagaatctatgcggcaggcgggcgcaccctgtcggcggcgcgcgcctttgccgacaatccactgaccagtgatccgttacggttcatgcgcaatgtggaaatcacacggacttatacggacctcgcgcttggcggccccaccgtgcgctgggtctggagcgcactggaaaccgcatggcgcatcaaccagccggatttttacaaaagccccatcgcgccggttctgattatcgcggctggtgctgaccgcgttgtttcaacagcggtgatcgagcgtttcgtggcgcgcacgcgaaacatctcgctcgccgttattgacggtgcgcgccacgaaatgctccaggaagcagatttctaccgcgaacaggtgctggcggctttcgacgccttcatccccggctcatcgccggtggaatccatgccccaaagtcttgaacccgacctctctcaaatctaa

SEQ ID NO: 106799 - protein, 331 aa, Brucella melitensis 16M
MSELLFETDANPIPSRIRGGLFHAPDGKALRYSLLKAESRPCRGTVIVLQGRNEFIENYYETMSDLAGRGFTVATFDWRGQGGSHRLLRDRLRGYVRSFNDYADDLDHFLTGIVLPDCPPPFFILAHSAGALVALSSLERLSSRITRMVLCAPLMGLGGQKISDDNVRRITAALRWIGLGRIYAAGGRTLSAARAFADNPLTSDPLRFMRNVEITRTYTDLALGGPTVRWVWSALETAWRINQPDFYKSPIAPVLIIAAGADRVVSTAVIERFVARTRNISLAVIDGARHEMLQEADFYREQVLAAFDAFIPGSSPVESMPQSLEPDLSQI

SEQ ID NO: 106800 - DNA, 990 bp, Clostridium perfringens str. 13
  CDS (1)..(990): transl_table=11
atgtgtaaaactttaaatagaaaatatatttataaatatggggagaaaaaagaggatgtagaaatagttgaaaatatgctaaataggatgagaaatagtggaacttttaaaggagagaattttgctaatatatattatgaaaaatacatagtggaagaatcggataaagcaatagttatatgtcatgggttttcggaatgtatagagaagtatcatgaaataatatactattttctaaatgaaggtttttcagtttatataatggaacatagaggtcatgggagatcaggctgtttaagtaaatcttgtaatacacaggtggaagtagaatcctttgattactatgttaaagatctaaagacatttttaaatgaggttgtattaaaagataagaggtttaataataatttatatttatttgcacattctatggggggagctataggtactatatttttagaaaataatcatgggtattttaagaaggtaattttaaattctccaatgtttagaataaatacaagagaatactctcatataaaatgcaaattaatagctaaatttttaattcttatgggaaaaggagagaattttatttttggacaaaaaccctttgaggaagaggagaatttagaggcatcaggaacatcagataaacttagacatggcttataccataaatttctcctagaaaatcctattttgagaagaggtggaggctctattcattggtataaagaagctgcaagggcaactgattgtttaatgaaaaagagaaatatagagagaattgacacgcctattttattatttaaaagtgagtttgattcctatgttgacacaaaatttcatgatgagtttaaaaaggtagctaagtattgtgagcttattgaagttaagggaagtaaacatgagggattttttgaaaaagatgaaattctttatgattatttagataagatatttaaatttttagaggaaaataattag

SEQ ID NO: 106801 - protein, 329 aa, Clostridium perfringens str. 13
MCKTLNRKYIYKYGEKKEDVEIVENMLNRMRNSGTFKGENFANIYYEKYIVEESDKAIVICHGFSECIEKYHEIIYYFLNEGFSVYIMEHRGHGRSGCLSKSCNTQVEVESFDYYVKDLKTFLNEVVLKDKRFNNNLYLFAHSMGGAIGTIFLENNHGYFKKVILNSPMFRINTREYSHIKCKLIAKFLILMGKGENFIFGQKPFEEEENLEASGTSDKLRHGLYHKFLLENPILRRGGGSIHWYKEAARATDCLMKKRNIERIDTPILLFKSEFDSYVDTKFHDEFKKVAKYCELIEVKGSKHEGFFEKDEILYDYLDKIFKFLEENN

SEQ ID NO: 106802 - DNA, 936 bp, Arabidopsis thaliana
  CDS (1)..(936)
atggttatgtatgaagaggattttgtgttgaactcacgaggcatgaagttgttcacttgtgtatggaaaccagtgaagcaagaaccaaaggcattgctcttcctctgccatggctacgctatggagtccagcatcaccatgaacagcgcagccacgaggttagccaatgccggttttgccgtatatggaatggactatgaaggacatggaaaatctgagggtctaaatggttacatcagtaactttgatgatctcgttgatgatgtctctaatcattattctacaatttgtgagagggaagagaacaaggggaagatgaggttcctacttggagaatccatgggaggagcagttgtgttgctcttagccagaaagaagcctgatttttgggacggtgccgttttggtagcacccatgtgtaagttagcagacgagataaagccacatccagtagtgatctcaatccttatcaagttagccaagtttattccaacgtggaaaatagttccaggaaatgatattattgacattgcaattaaagaacctcacatcagaaatcaggtgagggagaacaagtattgctataaaggccggcctcgcctcaacaccgcctaccaactcttgttggttagcttagatcttgagaagaatcttcaccaggtatcaattcctttcattgttcttcacggagaagatgataaagtgacggataaaagcataagcaaaatgttatacgaagtggcttcaagctcggacaagacattcaagctgtaccccaaaatgtggcatgctttgttgtatggggaaactaatgaaaattcagaaattgtgtttggtgatatcataaactggttggaagatagagccacagattcgaacggagggttagagagtcagctaaaacataagcatgatggattcttgaagcataaataa

SEQ ID NO: 106803 - protein, 311 aa, Arabidopsis thaliana
MVMYEEDFVLNSRGMKLFTCVWKPVKQEPKALLFLCHGYAMESSITMNSAATRLANAGFAVYGMDYEGHGKSEGLNGYISNFDDLVDDVSNHYSTICEREENKGKMRFLLGESMGGAVVLLLARKKPDFWDGAVLVAPMCKLADEIKPHPVVISILIKLAKFIPTWKIVPGNDIIDIAIKEPHIRNQVRENKYCYKGRPRLNTAYQLLLVSLDLEKNLHQVSIPFIVLHGEDDKVTDKSISKMLYEVASSSDKTFKLYPKMWHALLYGETNENSEIVFGDIINWLEDRATDSNGGLESQLKHKHDGFLKHK

SEQ ID NO: 106804 - DNA, 939 bp, Leptospira interrogans serovar Lai str. 56601
  CDS (1)..(939): transl_table=11
atgacctttcatcataaagaatttcatattctatccagttccgataaatctaaattatattgtcaatcttggacgaagtctaactccaatcgattgttgatctttcatcacggttttggagaacatagtggacgttatacgaatttgattcgttatttttcgaaaagtgatattaatttctattcttttgatatgagaggtcatggaaattcggatggaaaaagaggtcattcggattcttttgatttatatgtaagggatcttgccgattttgtttcagaagttcttaaaagagaacaaaaggaacgtttttttctattgggacattctctgggaggagcgattactcttcgatattctcaggaaggaatcaatcaggataatattctaggtttgattcttggttctcctgcgcttagggtaagaatggattttagaaagaagttaaaaaaatttgctgctggtattttaagtaaaatttctccttcttctgttgtggacgcggagttgaatcttcaatatctttctcatgatccagaggtgatcgaatcttataaacaagatcctcttgttcacggtaaagtttccctaaaaatggggaccgaacttttgaagatcggaccccaattgatcaaaaaggcgaatgtacttcgttgtcctgtattgattttgcacggtcaagaagatggacttgtggatgtaaatggttctacagaactttataaaaatctaatttatagaaataaaagaattaaaatttaccccggtttttatcatgaactgatgaatgaatttccagaacatagggaaatagtgttaaatgatattcaaacttttttagaaaccattcagagggaaaaaatcgattttgagtctttaaaattacaaagaaaagaagtggtttcaaggaaaaaaagaaatccggtttctaatccttaa

SEQ ID NO: 106805 - protein, 312 aa, Leptospira interrogans serovar Lai str. 56601
MTFHHKEFHILSSSDKSKLYCQSWTKSNSNRLLIFHHGFGEHSGRYTNLIRYFSKSDINFYSFDMRGHGNSDGKRGHSDSFDLYVRDLADFVSEVLKREQKERFFLLGHSLGGAITLRYSQEGINQDNILGLILGSPALRVRMDFRKKLKKFAAGILSKISPSSVVDAELNLQYLSHDPEVIESYKQDPLVHGKVSLKMGTELLKIGPQLIKKANVLRCPVLILHGQEDGLVDVNGSTELYKNLIYRNKRIKIYPGFYHELMNEFPEHREIVLNDIQTFLETIQREKIDFESLKLQRKEVVSRKKRNPVSNP

SEQ ID NO: 106806 - DNA, 930 bp, Leptospira interrogans serovar Lai str. 56601
  CDS (1)..(930): transl_table=11
atgaaatttttttctctttgcaaaggatcatttgcatttataacacgtttcgctatgtcatggataaattcttataatttaaaagacgatacctttgcgggaagcgggggatctaaaattttctatcgaacctaccaacccaaagaaggcagaaaaggaaaccgagttatcgtagtacaacacggaatcggagaacacagcggtcgttatgaatttttagtggaagcactttccggaaccggaacggcgttctatctcatcgattctcaagggcatgggcgctctgaaggcaaacgaggcgcgatagattctttttctgatttccttttcgatttggatcaattgatttcaatcgcaaaagaaaaagaaaaagttcctaaagtaacactactcggtcattctatgggagccgcaatttctacattctatgcggaagaaggcactaatcaaggaaatctaaatgctcttatgatctccgctcttccgattcgggtaaaaacagatctagttatgaaagtcaaaaagggaattgctcctttaatgtccgatcttttacccaatctaactcttcctacaggactcaacattcactttttaagtcatgataagtcggtagtagaagcttacagaaaagatccactggttcatggaatggcttctgcttatttaggaaatatgcttttgaacagcgaagaaccgattcttgcaaatgcaggtaagatcaaaattccgatttatatcttccacggaaaagaagatcagatcgcagactatactggaagtgaagccttcttcgaagttgtaggttccacagataagtccatgaaaatttacgaaggactttatcacgaaacgatgaacgaacgtatagaagacagaactaaggttttaaccgatttaaagaaatggtttgaatctcactcaaattaa

SEQ ID NO: 106807 - protein, 309 aa, Leptospira interrogans serovar Lai str. 56601
MKFFSLCKGSFAFITRFAMSWINSYNLKDDTFAGSGGSKIFYRTYQPKEGRKGNRVIVVQHGIGEHSGRYEFLVEALSGTGTAFYLIDSQGHGRSEGKRGAIDSFSDFLFDLDQLISIAKEKEKVPKVTLLGHSMGAAISTFYAEEGTNQGNLNALMISALPIRVKTDLVMKVKKGIAPLMSDLLPNLTLPTGLNIHFLSHDKSVVEAYRKDPLVHGMASAYLGNMLLNSEEPILANAGKIKIPIYIFHGKEDQIADYTGSEAFFEVVGSTDKSMKIYEGLYHETMNERIEDRTKVLTDLKKWFESHSN

SEQ ID NO: 106808 - DNA, 990 bp, Shewanella oneidensis MR-1
  CDS (1)..(990): transl_table=11
atgagccaaacgccatcagttttttcaacggaacacgatttaaatacctctgaacagcaagccttttggcaaaccgttgtccaagacacactcaacacgcccgatggattaaccttggcctatatgatggttaagcatcctaaagcccatgccagcatagtcatcagcagtggccgcgtggaatcctacctaaagtatcaagagttgatttttgacttgtatcagcaaggctactcggtgtttgctatcgaccaccgcggtcaaggattatcgagtcgaatgaccgcaaatccccatcaaggacatgtacggagatttaatgactacattgatgattttgcgctgtttatgcaaacggttgtgcttaaacacgccacctcaccactgttcttacttgggcactctatgggcggtgccatcggcaccttgtatctaaaacagcatcccgatgtctttaccgctgccgtattttcagcacctatgtatggcatcaagttacccatgcctaaagggtttgtccgttggttagccagtaaactcgataccagtctcaacggtggagagcctaattatgtgctaagtggtcaaaactataaggcagtcccagtcccctttaagggaaatgatctcacccattgccagagccgttaccaagcctaccgagaattgtatgaggcggcgccaaagctgcagctaggttctccgactaaccgttggcttactgaatccttagatgcagccgatgcttgtgtattggcaacaacgcatatacgtacacctattctgatcctacaggccggtgaggataaaattgtcgacaatgcagcgcaaaatctcgcagtgagctctaattgccaattaaaggtgattgcaggagcagcccatgagatatttatggagaaagatagctatcgcaatcaagcgctgaattacgcactcgatttttttaaacgctacgcaacaagggacgtggacaaacaagctgtttaa

SEQ ID NO: 106809 - protein, 329 aa, Shewanella oneidensis MR-1
MSQTPSVFSTEHDLNTSEQQAFWQTVVQDTLNTPDGLTLAYMMVKHPKAHASIVISSGRVESYLKYQELIFDLYQQGYSVFAIDHRGQGLSSRMTANPHQGHVRRFNDYIDDFALFMQTVVLKHATSPLFLLGHSMGGAIGTLYLKQHPDVFTAAVFSAPMYGIKLPMPKGFVRWLASKLDTSLNGGEPNYVLSGQNYKAVPVPFKGNDLTHCQSRYQAYRELYEAAPKLQLGSPTNRWLTESLDAADACVLATTHIRTPILILQAGEDKIVDNAAQNLAVSSNCQLKVIAGAAHEIFMEKDSYRNQALNYALDFFKRYATRDVDKQAV

SEQ ID NO: 106810 - DNA, 948 bp, Bradyrhizobium japonicum USDA 110
  CDS (1)..(948): transl_table=11
atgacgctgatctcgattccgtccaatcccgttcccgaagacgtcgtcagcggcaccatcaagacacccgatggcgccgagctgcgctttgcgcgctgggcgccgccggcgaaccgcaagggcacggtctgcgtcttcaccggacgcagcgagcagatcgagaaatatttcgagaccgtgcgcgacctgcgcgaccgcggctttgcggtggcgatgatcgactggcgcgggcagggccactcctcgcgccgcctgcgcgatccgcgcaagggctatgtgcgcgacttcgccgatttcgaaatcgacgtcgagaccttcgtgcagcaggtggtgctgccggattgcccgccgcccttcttcgcgctcgcccactccatgggcggtacggtgttgctgcgcgttgcgcatgcgggcaagcgctggttcgaccgcatggtgctgtcggcgccgatgatcgacctgccaggccgcaccacctcgtttccgtcgcgggcgcttctgaagacgatgcgcctgatggggatgggcggccgctatgttcccggcggcagcgaccgcatcaccgggctcgatcccttcatcaacaatcccctgaccagcgatcccgtgcgttatgcgcgcaacgccgcgatcctggaggaggatccgacgctcgggctggcgtcaccgacggtcgcctgggccgatagcgccttccgcgccatgcacaccttcaagggcatgaactacccctccgagatccgccagccgatcctgatgctggcggcctccagcgacaccgtggtttcgaccgccgcgatcgaggagttcgcctaccatttgcgcgccggctcccatctcgtgatcgccggctcgaagcacgagatcctccaggagcaggaccgctaccgctcccagttctgggccgccttcgacgccttcgtgccgggcacgccgctgttcaagtga

SEQ ID NO: 106811 - protein, 315 aa, Bradyrhizobium japonicum USDA 110
MTLISIPSNPVPEDVVSGTIKTPDGAELRFARWAPPANRKGTVCVFTGRSEQIEKYFETVRDLRDRGFAVAMIDWRGQGHSSRRLRDPRKGYVRDFADFEIDVETFVQQVVLPDCPPPFFALAHSMGGTVLLRVAHAGKRWFDRMVLSAPMIDLPGRTTSFPSRALLKTMRLMGMGGRYVPGGSDRITGLDPFINNPLTSDPVRYARNAAILEEDPTLGLASPTVAWADSAFRAMHTFKGMNYPSEIRQPILMLAASSDTVVSTAAIEEFAYHLRAGSHLVIAGSKHEILQEQDRYRSQFWAAFDAFVPGTPLFK

SEQ ID NO: 106812 - DNA, 1011 bp, Vibrio parahaemolyticus RIMD 2210633
  CDS (1)..(1011): transl_table=11
atggctactaaccattcacctttgacttatactcaagagactttatttgagcaagcaattggtggtccgatcgcagcactttggcaaactcgccaagagggctttgttaaagggacagagaaaaagaaaatctactggtgcaaactcaccaaccctgaacacaaaaaagccgtgctgatcgtcaatggccgcatcgaatcttcctggaagtaccaagagctgttttacgatctctaccgccaaggttacgatgtgtattcctttgaccaccgaggacaaggtttatcagatcgcctattatctgactctgatatgggtcacgtctatgactttactgactatattgatgatatggacgtggtgatcaaacaacacgaccttaaacaatatcagcagtgctttatcatcgcgcactccatgggcggtgctatcgcgacgcgctatctgcaaacccacccagagcacccattcactggtttgattttaagcgcccccatgtttggcattaacttgccgtggtacttatcgcctatcgctatcccagtgacgcaaattctttctgccgtgtcaccactgccgcgttatgcgccgggccacaagccgtactttcccaagccttttgaggacaatcctctcagccaaagcgcaggccgctaccagtggtttcgcaatctctatacagaaaaaccggaactgcaagtcggcggaccaagcacgcgctgggtatggcaaggactcatggcagcgaaacagtgctttttgttaactcgccaagtaaaagtgcctgtgctactggttcaagcaggcaatgatcgtatcgtcagcaatctcgcacaaaaacgctttatcgagaagctgcgtaaaaccaatcctcatgcggcattgctttctattgaaggcgcacagcatgaaatcttgttcgaaacagaccagtaccgcaatcaagcgctcgatgcgatcttccgctttatggatgaccctacttcgtcgtcagacgaaaaaatgcaataa

SEQ ID NO: 106813 - protein, 336 aa, Vibrio parahaemolyticus RIMD 2210633
MATNHSPLTYTQETLFEQAIGGPIAALWQTRQEGFVKGTEKKKIYWCKLTNPEHKKAVLIVNGRIESSWKYQELFYDLYRQGYDVYSFDHRGQGLSDRLLSDSDMGHVYDFTDYIDDMDVVIKQHDLKQYQQCFIIAHSMGGAIATRYLQTHPEHPFTGLILSAPMFGINLPWYLSPIAIPVTQILSAVSPLPRYAPGHKPYFPKPFEDNPLSQSAGRYQWFRNLYTEKPELQVGGPSTRWVWQGLMAAKQCFLLTRQVKVPVLLVQAGNDRIVSNLAQKRFIEKLRKTNPHAALLSIEGAQHEILFETDQYRNQALDAIFRFMDDPTSSSDEKMQ

SEQ ID NO: 106814 - DNA, 954 bp, Arabidopsis thaliana
  CDS (1)..(954)
atggcgattgaaacagaggacatcaagtacgaagagagtttcataaagaacactcgaggatttaagttgttcacatgcagatggctaccaacaaacagagagccaagggctttagttttcctttgccatggatatggcatggaatgcagtatcaccatgaatagtactgctagaaggcttgtgaaggcaggatttgcggtatatggaatggattatgaaggacatggaaaatctgatgggcttagcgcttatatctcaaactttgatcgtcttgttgatgatgtctcaactcactacacagctatttgcgagagggaagaaaacaagtggaagatgaggtttatgttaggagagtcaatgggaggagcagttgttttgttgctaggcaggaagaaccctgacttttgggatggagctatcttggtcgctccaatgtgtaagatcgcagaagaaatgaagccaagtccttttgttatttcgatattaacaaagcttatttcgattatacccaaatggaaaatcattcctagtcaagatatcatcgagatttcatataaagagccagaaattagaaaacaggttagagaaaatcctttatgctcgaaaggacgaccacgcttgaaaactgcgtatgagctcttaaggatcagcaacgacttggagaagagacttcaagaggtttcattgccgtttttggtattacacggagatgatgataaagtaacagataaagcagtgagccaagaactgtacaaggttgcgttgagcgctgacaagaccttaaagttgtaccctgggatgtggcacggtttgctcaccggcgagacaccagagaacatcgaaattgtctttgccgacgtcatcagttggttggaaaaaagaagtgattatggaaatgataggtttgagtcagagcttaaacagcgtaatgatcgtttaaatttcaagaaatag

SEQ ID NO: 106815 - protein, 317 aa, Arabidopsis thaliana
MAIETEDIKYEESFIKNTRGFKLFTCRWLPTNREPRALVFLCHGYGMECSITMNSTARRLVKAGFAVYGMDYEGHGKSDGLSAYISNFDRLVDDVSTHYTAICEREENKWKMRFMLGESMGGAVVLLLGRKNPDFWDGAILVAPMCKIAEEMKPSPFVISILTKLISIIPKWKIIPSQDIIEISYKEPEIRKQVRENPLCSKGRPRLKTAYELLRISNDLEKRLQEVSLPFLVLHGDDDKVTDKAVSQELYKVALSADKTLKLYPGMWHGLLTGETPENIEIVFADVISWLEKRSDYGNDRFESELKQRNDRLNFKK

SEQ ID NO: 106816 - DNA, 999 bp, Photorhabdus luminescens subsp. laumondii TTO1
  CDS (1)..(999): transl_table=11
atgacgccagaaatgttgaaagaaagttggttcaatcgtgaggtgcagttctctgtttttgccaatgggcctctgttagatttttggcaagctagggaagagtgtgaatttatcggcgtcgataatgtactgatacgttatgttcgtttttgcacaacaataaaaaatgatagagcggttgttatctttcctggccgtagtgaaagttatgtcaaatactcggaagtagcatttgatttttatcaccttggttacgacatttttattattgatcatcgtgggcaggggcgatccagcaggatacttgcagatccacaaaaagggcatgtagaaaaatttgatgattatattgatgacgttgaaatattaatagaaagagaaattcttcctcgtcattattctcattgttatgcgttagctcattcaatgggagcggcaatattagggggatttttattacgtcacagccaggtatttgatgcagcagccctttgtgctcctatgtttggtattaactttcctatgccacgttggttggcaactttcctggtaaatcgggctgaaaagcggccggatatgcgcaaccattatgcggtatttactgggaaatggcgtccgttgccttatttgataaaccttctgacacacagttatgaacgttatagccgttacctccgttattacgcggattatccggaattacatatcgggggaccgacatatcgttgggtgcgggaaagtatctggattggcgatatgctgatagaaaaagccggagaaattgagacgccattgataattttaaaagccagtgaagataaggttgttaataattgccgattacgggctttttgtgaatcacgtaataaagtgagggctttcatcaaagaacgttcacctttgattattcaaggggcgcatcatgagatcctgtttgaaaaagataaattacgtagccaggcactcaacgccatttgtgatttttttgaccagaattga

SEQ ID NO: 106817 - protein, 332 aa, Photorhabdus luminescens subsp. laumondii TTO1
MTPEMLKESWFNREVQFSVFANGPLLDFWQAREECEFIGVDNVLIRYVRFCTTIKNDRAVVIFPGRSESYVKYSEVAFDFYHLGYDIFIIDHRGQGRSSRILADPQKGHVEKFDDYIDDVEILIEREILPRHYSHCYALAHSMGAAILGGFLLRHSQVFDAAALCAPMFGINFPMPRWLATFLVNRAEKRPDMRNHYAVFTGKWRPLPYLINLLTHSYERYSRYLRYYADYPELHIGGPTYRWVRESIWIGDMLIEKAGEIETPLIILKASEDKVVNNCRLRAFCESRNKVRAFIKERSPLIIQGAHHEILFEKDKLRSQALNAICDFFDQN

SEQ ID NO: 106818 - DNA, 999 bp, Vibrio vulnificus YJ016
  CDS (1)..(999): transl_table=11
atggttaataacagctcacctctctcttatacgcaagaggctttatttgagcaagcaataggtggtccgatcgctgccctatggcagcagcgacaagagggtttcctaaaaacgcgcgataagatgcagttgtattggtgtaagctgaccaacccgcaacacaaaaaggcggtgctggtagtgaatggcagaatcgaatctgcttggaagtaccaagaacttctgtttgatctctaccgtcaaggctatgacgtctacagctacgatcatcgaggccaaggtttatcagatcgcctggtgaaagactctgatattggtcacgtctacgagtttgatgattacattctcgacatggaagccgtgattgcgcattttgatttctctccttatcagcagcgacacattgtttctcattcgatgggcggtgccgtcgccacgcgctacttacaaacccacccacaacatggttttgataagttggtgctcagtgcgccgatgtttggtatcgatctcccttggtatttgagtccagtggccatggcggtcagccaaattctcaccgccgtgtacccaacgcctacttatgcgccgggacacaaaagttattatgagaagccctttgaagataacccgctcagccagagccaagcgcgttatcaatggtttagacagttgtatcgtgacaagcccgagctgcaagtgggtggcccgagcacccgttgggtgtggcaaggcttaatggccgccaaacagtgcattttgctgacgcgccaactcaccattccggtgttgctgttgcaggcagggggcgatcgcatcgtcagcaatcaagcacagtcgcagtttttcaaaaagctgcacaaaaccaataagcgcagcgaaatggtgacgattgaaggtgcgcaacatgaattgttgtttgagaaagaccactaccgtaatcaagcactcagcgcgatgttccgctttttgcagaaagaggaaagcaaccaagcttaa

SEQ ID NO: 106819 - protein, 332 aa, Vibrio vulnificus YJ016
MVNNSSPLSYTQEALFEQAIGGPIAALWQQRQEGFLKTRDKMQLYWCKLTNPQHKKAVLVVNGRIESAWKYQELLFDLYRQGYDVYSYDHRGQGLSDRLVKDSDIGHVYEFDDYILDMEAVIAHFDFSPYQQRHIVSHSMGGAVATRYLQTHPQHGFDKLVLSAPMFGIDLPWYLSPVAMAVSQILTAVYPTPTYAPGHKSYYEKPFEDNPLSQSQARYQWFRQLYRDKPELQVGGPSTRWVWQGLMAAKQCILLTRQLTIPVLLLQAGGDRIVSNQAQSQFFKKLHKTNKRSEMVTIEGAQHELLFEKDHYRNQALSAMFRFLQKEESNQA

SEQ ID NO: 106820 - DNA, 1047 bp, Rhodopseudomonas palustris CGA009
  CDS (1)..(1047): transl_table=11
atgggaggggtgtttcggggttcaagagggggcccgaagctgttcgcgcccgccgctttcatccagattttccaggcattttctcccctccggactcggtccatgacgctcgtctcgactcctgccaatccggtgcccgaagacgccgtctccggcttcatcaagacgcccgacggcgtgcaactccgctttgcgcgatgggagccgccggggcaccgcaaaggcaccgtatgcgtcttcaccggacgcaccgaacagatcgagaagtacttcgagacggtgcgcgatctgcgcgatcgcggctttgcagtcgcggcgctcgactggcgcggccagggccattcggagcgccggctgcgcgactatcgcaagggctatgtgcgcaacttcgccgacttcgaggtcgacgtcgaaaccttcgtgcgtgaagtcgtgctgccggactgcccgccgccgcatttcgcactggcgcattcgatgggcggggcggtgatgctgcggatcgcccgctccggcaagcgctggttcgaccgcatggtgctgtcggccccgatgatcgaccttgcgggcaacaccaccgcgctgccgatcaggctattgctgcgggcgatgcggctggccggccaaggcggccgttacgttcccggcggcaacgacgtgctcgccaacaccgagccgttcgtcggaaacaagctgacctcggatccggtacgctacgcccgcaacgccgcaatcgtcgccgaagatccgaccctgggcctcgcctcgccgaccgtcgcctgggctgacaccgctttccgcgccatgcacgccttcaaggcgaccaactatccgtcgcaaatccggcagccgatcctgatgatcgcggccggtatggacggcgtggtgtcgacgccggcgatcgaagagttcgcttatcatttgcgggccggctcgcatctggtgatccccggcgccaagcacgaaatcctccaggagcaggatcgctaccgccagcaattctgggcggcgttcgatgctttcgtaccggggacgccgcttttctga

SEQ ID NO: 106821 - protein, 348 aa, Rhodopseudomonas palustris CGA009
MGGVFRGSRGGPKLFAPAAFIQIFQAFSPLRTRSMTLVSTPANPVPEDAVSGFIKTPDGVQLRFARWEPPGHRKGTVCVFTGRTEQIEKYFETVRDLRDRGFAVAALDWRGQGHSERRLRDYRKGYVRNFADFEVDVETFVREVVLPDCPPPHFALAHSMGGAVMLRIARSGKRWFDRMVLSAPMIDLAGNTTALPIRLLLRAMRLAGQGGRYVPGGNDVLANTEPFVGNKLTSDPVRYARNAAIVAEDPTLGLASPTVAWADTAFRAMHAFKATNYPSQIRQPILMIAAGMDGVVSTPAIEEFAYHLRAGSHLVIPGAKHEILQEQDRYRQQFWAAFDAFVPGTPLF

SEQ ID NO: 106822 - DNA, 804 bp, Bacillus cereus ATCC 10987
  CDS (1)..(804): transl_table=11
atgtggaattacgaagcggaggaagcaaaggctgtaatcgttattgtgcacggcgcgatggaatatcacggacgttatgaagccgttgcggaaatgtggaatcataacggctaccacgtcgtgatgggagaccttccgtcacatggaacgacttcaagaaatagaggacatattgattcatttgatgaatacatagaggaagttaaattatgggtgaaagaggcaagaaagtataggttacctatttttatattcggtcatagtatgggtggtcttatcgtcattcgtatgatgcaagaaacgaagagagaagatgtagacggtattattttaagttcgccatgtttaggtgtattagctggaccttctgcaccgctgcaagctgcctcaaaaatattaaatattatcgctccaaaattgcaatttgcaacgaatcttacagtggaaatgtcaactcgtaatcatgaagtgagagatgcgatggagaatgattcattgttcttgcgcaaagtatcagtacgttggtatagtgaattgattaagtctatcgaaattgcccataagaaaatagatgattttccagatgttccgctcttgctaatgcaagcatgtgaggataaacttgtagataaaacacgtgtccgcacttggtttgataatgttaaaataagtgataaggcttttaaagaatggccgaattgttaccatgagttattaaatgagtatgagcgtgatgaaattttgaattatattcagtcatttactgaaatacgcatcaataacataatagaaacaaataagtaa

SEQ ID NO: 106823 - protein, 267 aa, Bacillus cereus ATCC 10987
MWNYEAEEAKAVIVIVHGAMEYHGRYEAVAEMWNHNGYHVVMGDLPSHGTTSRNRGHIDSFDEYIEEVKLWVKEARKYRLPIFIFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFDNVKISDKAFKEWPNCYHELLNEYERDEILNYIQSFTEIRINNIIETNK

SEQ ID NO: 106824 - DNA, 930 bp, Leptospira interrogans serovar Copenhageni str. Fiocruz L1-130
  CDS (1)..(930): transl_table=11
atgaaatttttttctctttgcaaaggatcatttgcatttataacacgtttcgctatgtcatggataaattcttataatttaaaagacgatacctttgcgggaagcgggggatctaaaattttctatcgaacctaccaacccaaagaaggcagaaaaggaaaccgagttatcgtagtacaacacggaatcggagaacacagcggtcgttatgaatttttagtggaagcactttccggaaccggaacggcgttctatctcatcgattctcaagggcatgggcgctctgaaggcaaacgaggcgcgatagattctttttctgatttccttttcgatttggatcaattgatttcgatcgcaaaagaaaaagaaaaagttcctaaagtaacactactcggtcattctatgggagccgcaatttctacattctatgcggaagaaggtactaatcaaggaaatctaaatgctcttatgatctccgctcttccgattcgggtaaaaacagatctagttatgaaagtcaaaaagggaattgctcctttaatgtccgatcttttacccaacctaactcttcctacaggactcaacattcactttttaagtcatgataagtcggtagtagaagcttacagaaaagatccactggttcatggaatggcttctgcttatttaggaaatatgcttttgaacagcgaagaaccaattcttgcaaatgcaggtaagatcaaaattccgatttatatcttccacggaaaagaagatcagatcgcagactatactggaagcgaaaccttcttcgaagttgtaggttccgcagataagtccatgaaaatttacgaaggactttatcacgaaacgatgaacgaacgtatagaagacagaactaaggttttaaccgatttaaagaaatggtttgaatctcactcaaattaa

SEQ ID NO: 106825 - protein, 309 aa, Leptospira interrogans serovar Copenhageni str. Fiocruz L1-130
MKFFSLCKGSFAFITRFAMSWINSYNLKDDTFAGSGGSKIFYRTYQPKEGRKGNRVIVVQHGIGEHSGRYEFLVEALSGTGTAFYLIDSQGHGRSEGKRGAIDSFSDFLFDLDQLISIAKEKEKVPKVTLLGHSMGAAISTFYAEEGTNQGNLNALMISALPIRVKTDLVMKVKKGIAPLMSDLLPNLTLPTGLNIHFLSHDKSVVEAYRKDPLVHGMASAYLGNMLLNSEEPILANAGKIKIPIYIFHGKEDQIADYTGSETFFEVVGSADKSMKIYEGLYHETMNERIEDRTKVLTDLKKWFESHSN

SEQ ID NO: 106826 - DNA, 939 bp, Leptospira interrogans serovar Copenhageni str. Fiocruz L1-130
  CDS (1)..(939): transl_table=11
atgacctttcatcataaagaatttcatattctatccagttccgataaatctaaattatattgtcaatcttggacgaagtctaactccaatcgattgttgatctttcatcacggttttggagaacatagtggacgttatacgaatttgattcgttatttttcgaaaagtgatattaatttctattcttttgatatgagaggtcatggaaattcggatggaaaaagaggtcattcggattcttttgatttatatgtaagggatcttgccgattttgtttcagaagttcttaaaagagaacaaaaggaacgtttttttctattgggacattctctgggaggagcgattactcttcgatattctcaggaaggaatcaatcaggataatattctaggtttgattcttggttctcctgcgcttagggtaagaatggattttagaaagaagttaaaaaaatttgctgctggtattttaagtaaaatttctccttcttctgttgtggacgcggagttggatcttcaatatctttctcatgatccagaggtgatcgaatcttataaacaagatcctcttgttcacggtaaagtttccctaaaaatggggaccgaacttttggagatcggaccccaattgatcaaaaaggcgaatgtacttcgttgtcctgtattgattttgcacggtcaagaagatggacttgtggatgtaaatggttctacagaactttataaaaatctaatttatagaaataaaagaattaaaatttaccccggtttttatcatgaactgatgaatgaatttccagaacatagggaaatagtgttaaatgatattcaaacttttttagaaaccattcagagggaaaaaatcgattttgagtctttaaaattacaaagaaaagaagtggtttcaaggaaaaaaagaaatccggtttctaatccttaa

SEQ ID NO: 106827 - protein, 312 aa, Leptospira interrogans serovar Copenhageni str. Fiocruz L1-130
MTFHHKEFHILSSSDKSKLYCQSWTKSNSNRLLIFHHGFGEHSGRYTNLIRYFSKSDINFYSFDMRGHGNSDGKRGHSDSFDLYVRDLADFVSEVLKREQKERFFLLGHSLGGAITLRYSQEGINQDNILGLILGSPALRVRMDFRKKLKKFAAGILSKISPSSVVDAELDLQYLSHDPEVIESYKQDPLVHGKVSLKMGTELLEIGPQLIKKANVLRCPVLILHGQEDGLVDVNGSTELYKNLIYRNKRIKIYPGFYHELMNEFPEHREIVLNDIQTFLETIQREKIDFESLKLQRKEVVSRKKRNPVSNP

SEQ ID NO: 106828 - DNA, 804 bp, Bacillus anthracis str. 'Ames Ancestor'
  CDS (1)..(804): transl_table=11
atgtggaattatgaagctgaagaagcaaaggctgtaatcgttatcgtgcacggcgcaatggaatatcacggacgctatgaagccgttgcggaaatgtggaatcatatcggctaccatgtcgtgatgggggaccttccgtcacatggaacgacttcaagaaatagaggacatattgattcgtttgatgaatacatagaggaagttaaattatgggtgaaagaggcaagaaagtatcggttacctatttttctatttggtcatagtatgggtggtcttattgtcattcgtatgatgcaagaaacgaagagagaagatgtagacggcattattttaagttcgccatgtttaggtgtattagctggaccttctgcaccgcttcaagctgcctcaaaaatattaaatattatcgctccgaagttacaatttgcaacgaatcttacagtggaaatgtcaacgcgtaatcatgaagtgagagatgcgatggagaacgattcattgttcttgcgcaaagtatcagtacgttggtatagtgaattgattaagtctattgaaatcgctcataaaaaaatagatgattttccagatgttccgctcttgctaatgcaagcatgtgaggataaacttgtagataaaacacgtgtccgcacttggtttaataatgttaaaataagtgataaggcttttaaagaatggccgaattgttatcatgagttattaaatgagtatgagcgtgatgaaattttgaattatattcagtcatttactgaaatacgcatcaataacataatagaaacaaataagtaa

SEQ ID NO: 106829 - protein, 267 aa, Bacillus anthracis str. 'Ames Ancestor'
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFNNVKISDKAFKEWPNCYHELLNEYERDEILNYIQSFTEIRINNIIETNK

SEQ ID NO: 106830 - DNA, 819 bp, Bacillus anthracis str. Sterne
  CDS (1)..(819): transl_table=11
atggaggagagccgtatgtggaattatgaagctgaagaagcaaaggctgtaatcgttatcgtgcacggcgcaatggaatatcacggacgctatgaagccgttgcggaaatgtggaatcatatcggctaccatgtcgtgatgggggaccttccgtcacatggaacgacttcaagaaatagaggacatattgattcgtttgatgaatacatagaggaagttaaattatgggtgaaagaggcaagaaagtatcggttacctatttttctatttggtcatagtatgggtggtcttattgtcattcgtatgatgcaagaaacgaagagagaagatgtagacggcattattttaagttcgccatgtttaggtgtattagctggaccttctgcaccgcttcaagctgcctcaaaaatattaaatattatcgctccgaagttacaatttgcaacgaatcttacagtggaaatgtcaacgcgtaatcatgaagtgagagatgcgatggagaacgattcattgttcttgcgcaaagtatcagtacgttggtatagtgaattgattaagtctattgaaatcgctcataaaaaaatagatgattttccagatgttccgctcttgctaatgcaagcatgtgaggataaacttgtagataaaacacgtgtccgcacttggtttaataatgttaaaataagtgataaggcttttaaagaatggccgaattgttatcatgagttattaaatgagtatgagcgtgatgaaattttgaattatattcagtcatttactgaaatacgcatcaataacataatagaaacaaataagtaa

SEQ ID NO: 106831 - protein, 272 aa, Bacillus anthracis str. Sterne
MEESRMWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFNNVKISDKAFKEWPNCYHELLNEYERDEILNYIQSFTEIRINNIIETNK

SEQ ID NO: 106832 - DNA, 804 bp, Bacillus thuringiensis serovar konkukian str. 97-27
  CDS (1)..(804): transl_table=11
atgtggaattatgaagcggaggaagcaaaggctgtaatcgttattgtacacggcgcaatggaatatcacgggcgttatgaagccgttgcggaaatgtggaatcatatcggctaccacgttgtgatgggggaccttccgtcacatggaacgacttcaagaaatagaggacatattgattcatttgatgaatacatagaggaagttaaattatgggtgaaagaggcaagaaagtataggttgcctatctttttatttggtcatagtatgggtggtcttatcgtcattcgtatgatgcaagaaacgaaaagagaagatgtagatggcattattttaagttcgccatgtttaggcgtattagctggaccttctgcaccgctgcaagctgcctcaaaaatattaaatattattgctccaaaattgcaatttgcaacgaatcttacagtggaaatgtcaactcgtaatcatgaagtgagagatgcgatggagaatgattcattgttcttgcgcaaagtatcagtacgttggtatagtgaattgattaagtctatcgaaatggctcataagaaaataaacgattttccagatgttccgctcttgctaatgcaagcatgtgaggataaacttgtagataaaacacgtgtccgcacttggtttgataatgttaaaataagtgataaggcttttaaagaatggccgaattgttatcatgagttattaaatgagtatgagcgcgacgaaattttgaattatattcagtcatttactgaaatacgcatcaataacataatagaaacaaataagtaa

SEQ ID NO: 106833 - protein, 267 aa, Bacillus thuringiensis serovar konkukian str. 97-27
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEMAHKKINDFPDVPLLLMQACEDKLVDKTRVRTWFDNVKISDKAFKEWPNCYHELLNEYERDEILNYIQSFTEIRINNIIETNK

SEQ ID NO: 106834 - DNA, 1038 bp, Erwinia carotovora subsp. atroseptica SCRI1043
  CDS (1)..(1038): transl_table=11
atgattcaacgccacaatacgttgtttacgtcggaacggttaacacctgaatcgttaacggcagatctgttaacgcgagaagcgcagtttgccgcttttgctaccggagaattactgaatttctggcgtcagcgcgaagagggcgaattctctggtgtggatgatgtgccgatccggtttgttcgctttaccgcgccgcaacacgacaagattgtcgtggttttttctggccgcatcgaaagttacgtcaaatatagcgaagtggcgtatgacctctttcatcgcggctatgatgtgctcatcatggatcaccgtgggcaagggcggtctgggcgggtgctgcaagatggccaccgcggacacgtgcaacgcttcagtgattatgtcgatgatgctgaaacactgtgccagcagcacattgaacctacgcgatatacccgtcggtttgcgctggcgcattcaatgggcggcgcgattctggcacagcttttggttcgtcaacctgcgatgtttgatgcggcggcgctgtgtgcgccgatgtttggcattcgtttaccgcttcctcattgcgttgccgagtggatcgtcgattgggcggagcgtcacccagcgatacgtgattattacgctataggcacgggacagtggcgtcctctgccttatcgaatgaatgtgctgacgcacagccgcgaacgctaccagcgtagtattcgattttacgcggattcgcctgatttgcgcgtaggcggccctacttaccactgggtgcgtgaggcgatactggcggggaagtacctgctgacacaggccagcgccgtgacaacgccgcttctgctgctacaagcggaagaggagcgcgtggtggataatcgcagtcagaatgtgttttgccagacactgacgcagagcggtgatgccaattcgaacggcgttttgcaggttatccacggcgcgcggcatgaaattctctttgagacggatcgtctccgcgctcaggcatttgcgctgatttttacgcactttgcgcgctatcattaa

SEQ ID NO: 106835 - protein, 345 aa, Erwinia carotovora subsp. atroseptica SCRI1043
MIQRHNTLFTSERLTPESLTADLLTREAQFAAFATGELLNFWRQREEGEFSGVDDVPIRFVRFTAPQHDKIVVVFSGRIESYVKYSEVAYDLFHRGYDVLIMDHRGQGRSGRVLQDGHRGHVQRFSDYVDDAETLCQQHIEPTRYTRRFALAHSMGGAILAQLLVRQPAMFDAAALCAPMFGIRLPLPHCVAEWIVDWAERHPAIRDYYAIGTGQWRPLPYRMNVLTHSRERYQRSIRFYADSPDLRVGGPTYHWVREAILAGKYLLTQASAVTTPLLLLQAEEERVVDNRSQNVFCQTLTQSGDANSNGVLQVIHGARHEILFETDRLRAQAFALIFTHFARYH

SEQ ID NO: 106836 - DNA, 1014 bp, Yersinia pseudotuberculosis IP 32953
  CDS (1)..(1014): transl_table=11
atgctgttaggtcatcacatgaataattggttaacccgagaagagcaatttgctgcttttattaatgggccattgttggatttctggcagcaacgagacgaacagacgtttatgggcgtcgataatatccccattcgctatgtccgttttcgtgcgccgcatcatacccaagtcgtggtggtagtgccggggcgtatcgaaagttacgtcaaataccctgaagttgcttatgacctgttccagcagggctatgatgtgatagtgctggatcatcgcgggcaagggcgttctgggcgtatgctggatgatcataaccgtggtcacgtgattaagttcgatgactatattgaggattttgcacaactggtgcagatcgaaattaccggtagccattatcagcagcgttttgcgctggcccactcaatggggggcgcgattctgacgcgttttctagccagagagcctgatgtatttaatgccgttgcgttatgtgcgcccatgtttggtattcatttacccctgccgggctggttggcacgccgtattgttaactgggccgaagggcaccaaaagctacgggattattacgcgattggtactgggcattggcggccactgccgtatttggtcaatatgctgactcacagccgcgagcgttatcgccgctatttgcgccaatattcagacacaccagaaatccgcgtgggtggccccacttaccattggctacgtgaaagtttgctggtgggggagcaaattattgctgaagcggagaaaatcaccactccggtattattgttacaggccagtgaggatcgggtggttcataacccagcccacgatgctttttctcaggcaatgacattggcagggcacccctgtgaaggggggcgtcctcaggtcattcaaggcgcacgccatgagatcctgtttgagcgggacacgctgcgtgccgaggcgcttagcgccatattgcgctttttcgcgcaacatcaatcatcagtcggccattag

SEQ ID NO: 106837 - protein, 337 aa, Yersinia pseudotuberculosis IP 32953
MLLGHHMNNWLTREEQFAAFINGPLLDFWQQRDEQTFMGVDNIPIRYVRFRAPHHTQVVVVVPGRIESYVKYPEVAYDLFQQGYDVIVLDHRGQGRSGRMLDDHNRGHVIKFDDYIEDFAQLVQIEITGSHYQQRFALAHSMGGAILTRFLAREPDVFNAVALCAPMFGIHLPLPGWLARRIVNWAEGHQKLRDYYAIGTGHWRPLPYLVNMLTHSRERYRRYLRQYSDTPEIRVGGPTYHWLRESLLVGEQIIAEAEKITTPVLLLQASEDRVVHNPAHDAFSQAMTLAGHPCEGGRPQVIQGARHEILFERDTLRAEALSAILRFFAQHQSSVGH

SEQ ID NO: 106838 - DNA, 834 bp, Bacillus cereus E33L
  CDS (1)..(834): transl_table=11
atgaaaaagagtgaaatggaggaaagccgtatgtggaattatgaagctgaagaagcaaaggctgtaatcgttatcgtgcacggcgcaatggaatatcacgggcgttatgaagctgttgcggaaatgtggaatcatatcggctatcacgtcgtgatgggggaccttccgtcacatggaacgacttcaagaaatagaggacatattgattcgtttgatgaatacatagaggaagttaaattatgggtgaaagaggcaagaaagtatcggttacctatttttctatttggtcatagtatgggtggtcttattgtcattcgtatgatgcaagagacgaagagagaagatgtagacggcattattttaagttcgccatgtttaggtgtattagctggaccttctgcaccgcttcaagctgcctcaaaaatattaaatattatcgctccgaagttacaatttgcaacgaatcttacagtggaaatgtcaacgcgtaatcatgaagtgagagatgcgatggagaacgattcattgttcttgcgcaaagtatcagtacgttggtatagtgaattgactaagtctattgaaatcgctcataaaaaaatagatgattttccagatgttccgctcttgctaatgcaagcatgtgaggataaacttgtagataaaacacgtgtccgcacttggtttgataatgttaaaataagtgataaggcttttaaagaatggccgaattgttatcatgagttattaaatgagtatgagcgtgatgaaattttgaattatattcagtcatttactgaaatacgcatcaataacataatagaaacaaataagtaa

SEQ ID NO: 106839 - protein, 277 aa, Bacillus cereus E33L
MKKSEMEESRMWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELTKSIEIAHKKIDDFPDVPLLLMQACEDKLVDKTRVRTWFDNVKISDKAFKEWPNCYHELLNEYERDEILNYIQSFTEIRINNIIETNK

SEQ ID NO: 106840 - DNA, 951 bp, Mannheimia succiniciproducens MBEL55E
  CDS (1)..(951): transl_table=11
atgctaaacagagaacctaaatttagcaattttgcattaaccgaactgcttccctttgcggaacgctgtccgctaaattatatcaagggcaaaaacaacataaaaatcgcttatcgccattttaaacatgaacatgacggtaatgacaggttattggtgttagtaaacggacgtgcggaaaatttgctgaaatggactgaagtggcttatgatttttatcgccagggttatgatgtgctgagtttcgatcatcgagggcaaggttattccgatcggctattaaaaaatagagataaaggttacattgatgaattccgctattatacggacgatatggcggcggttatcgctgaggcttattcctatcgtcaatacagctcctgccacctagtggctcattcattaggggcgttaatcagcacctattatcttgctaactatgatcaccatataaaaagtgccgtgttatccgcacctttttacggtttacagttacgtcgcccgtttatcgatcaaattatcattaatttgatgatactattcggacaaggaaaacgttatgtaccgggaaaagaaggctataagccggctaatttaaacaataacgatctcagtttctgcaaaacccgcatgaaatggatgaacagaattaatcgcaatcatccggcaattcatcttggcggaccgacattccgttgggttcatttatgcttaaacgcgataaaaggtctgcctaaaattattccccgcattgaaatacctattttaattttgcattccgataaagagaaaatcgtaaataacaaaaatctacaaaaattaaccgcactttttcaacatgttcaagtggaagaaatacaaaatgcaaaacatgaaattctgtttgagcgtgatgcattaagggctcgggcgattcaacgaatcagtaaatttttcacggacttcaaataa

SEQ ID NO: 106841 - protein, 316 aa, Mannheimia succiniciproducens MBEL55E
MLNREPKFSNFALTELLPFAERCPLNYIKGKNNIKIAYRHFKHEHDGNDRLLVLVNGRAENLLKWTEVAYDFYRQGYDVLSFDHRGQGYSDRLLKNRDKGYIDEFRYYTDDMAAVIAEAYSYRQYSSCHLVAHSLGALISTYYLANYDHHIKSAVLSAPFYGLQLRRPFIDQIIINLMILFGQGKRYVPGKEGYKPANLNNNDLSFCKTRMKWMNRINRNHPAIHLGGPTFRWVHLCLNAIKGLPKIIPRIEIPILILHSDKEKIVNNKNLQKLTALFQHVQVEEIQNAKHEILFERDALRARAIQRISKFFTDFK

SEQ ID NO: 106842 - DNA, 912 bp, Burkholderia mallei ATCC 23344
  CDS (1)..(912): transl_table=11
atggacgctgctgccccgacttcgccccgctcggccgacgcttcccgcgccgcccctcagcccacgcgcgtgcgtaccgccgacaggctcgagctcgcgtgctaccgttggccgtctaccgcgccttcgtgcgccgcgccgcgcgcgaccgtcgcgctcgtgcacgggctcgccgagcacgcgggacgctatcaggcgttcgccgagcggctgaacgcggcgggcatcgaagtcgtcgcgatcgatctgcgcggccacgggcgctcgcccggcgaacgcgcatgggccgagcgcttcgaccggtatctggacgacgcggacgcgctcgtcgcgagcgccgcgcgcgagaacacgccgctcttcctgatggggcacagcatgggcggcgcaatcgccgcgctctatgcgatcgagcgcgcggccgcgcgccacgcgaacctggcgggcctgatcctgtcgagccccgcgctcgcgccggggcgcgacgtgccgcaatggatgctcgcgatgagccgcttcatcagccgcgtgtggcctcgctttccggcgctcaagatcgacgccgcattgctgtcgcgcgatccggccgtggtcgccgcgaatcgcgccgatccgctcgtccatcacggctcggtgccggcgcgcacgggcgccgagattctcgacgcgatgcgacgaatcgcggccggccgcgcggcgctgcgcatccccgtcctcgtctatcacggcaccgccgacaagctgaccgagcccgacggcagccgcgacttcggcgcgcacgtcggctcgcccgatcgcacgctcacgctatacgaaggcaactatcacgagacgatgaacgatctggaacgcgagcgggtgatcggcgcgctgatcgactggatcgccgcgcgcgtgccggctcgcggttga

SEQ ID NO: 106843 - protein, 303 aa, Burkholderia mallei ATCC 23344
MDAAAPTSPRSADASRAAPQPTRVRTADRLELACYRWPSTAPSCAAPRATVALVHGLAEHAGRYQAFAERLNAAGIEVVAIDLRGHGRSPGERAWAERFDRYLDDADALVASAARENTPLFLMGHSMGGAIAALYAIERAAARHANLAGLILSSPALAPGRDVPQWMLAMSRFISRVWPRFPALKIDAALLSRDPAVVAANRADPLVHHGSVPARTGAEILDAMRRIAAGRAALRIPVLVYHGTADKLTEPDGSRDFGAHVGSPDRTLTLYEGNYHETMNDLERERVIGALIDWIAARVPARG

SEQ ID NO: 106844 - DNA, 843 bp, Burkholderia pseudomallei K96243
  CDS (1)..(843): transl_table=11
gtgcgtaccgccgacgggctcgagctcgcgtgctaccgttggccgtctaccgcgccttcgtgcgccgcgccgcgcgcgaccgtcgcgctcgtgcacgggctcgccgagcacgcgggacgctatcaggcgttcgccgagcggctgaacgcggcgggcatcgaagtcgtcgcgatcgatctgcgcggccacgggcgctcgcccggcgaacgcgcatgggccgagcgcttcgaccggtatctggacgacgcggacgcgctcgtcgcgagcgccgcgcgcgagaacacgccgctcttcctgatggggcacagcatgggcggcgcaatcgccgcgctctatgcgatcgagcgcgcggccgcgcgccacgcgagcctggcgggcctgatcctgtcgagccccgcgctcgcgccggggcgcgacgtgccgcaatggatgctcgcgatgagccgcttcatcagccgcgtgtggcctcgctttccggcgctcaagatcgacgccgcattgctgtcgcgcgatccggccgtggtcgccgcgaatcgcgccgatccgctcgtccatcacggctcggtgccggcgcgcacgggcgccgagatcctcgacgcgatgcggcgaatcgaggccggccgcgcggcgctgcgcctccccgtcctcgtctatcacggcaccgccgacaagctgaccgagcccgacggcagccgcgacttcggcgcgcacgtcggctcgcccgatcgcacgctcacgctatacgaaggcaactatcacgagacgatgaacgatctggaacgcgagcgggtgatcggcgcgctgatcgactggatcgccgcgcgcgtgccggctcgcggttga

SEQ ID NO: 106845 - protein, 280 aa, Burkholderia pseudomallei K96243
MRTADGLELACYRWPSTAPSCAAPRATVALVHGLAEHAGRYQAFAERLNAAGIEVVAIDLRGHGRSPGERAWAERFDRYLDDADALVASAARENTPLFLMGHSMGGAIAALYAIERAAARHASLAGLILSSPALAPGRDVPQWMLAMSRFISRVWPRFPALKIDAALLSRDPAVVAANRADPLVHHGSVPARTGAEILDAMRRIEAGRAALRLPVLVYHGTADKLTEPDGSRDFGAHVGSPDRTLTLYEGNYHETMNDLERERVIGALIDWIAARVPARG

SEQ ID NO: 106846 - DNA, 1005 bp, Photobacterium profundum SS9
  CDS (1)..(1005): transl_table=11
atgacagctcaacctttacattattttgatttttcacaagaagacagatacgccgagacaatgtctgggccagtagctgaaatgtggaaacaacgccaggaaggcacattcaaaggtgtcgatgatctcaatattggttgggtaagcctgacgggttacaaccatgataaagcaattattgtggtgaatggtcgtatcgaaagctattggaaataccaagaacttttctacgatttagtcaaacaagggtacgatgtatatgccattgaccatcgcggtcagggtatctcggatcgtttagccaaagataacgaattagggcacgttgaagaatttgatgattatgttaccgatctaaaaaccttctttgataccgtggtaacccctaaaaagtatcaacaacactttctgcttggtcattctatggggggaaccatttcaaccctatttttggcaaaatacccctcactgattaagcgggcggtactcagtgcaccgatgcatggtattcaactgtctaactggatgaagccaatcgcttccccttttgcacgtgtcgttgagcaattacaacgccaacctaattatgcaccagggcaagtaccttattatcccaagcctttcctcaataataaattgtgccaaagccagatacgttatcaatggtttcgcgacttatatgaacacaaaccagcattaaaaattggcggacccagtgctcgctgggtatggcaaggtatggcagctgcgaatcgctgcattacacaagcggcgaatatcgctacccctatactgctcattcagggtagcgatgataatattgttgataatcaagcacaccatcgtttttgccaagccatgaaccaagccaatcgttcgtgtgaattaaaaaccattaatggcgcacgtcacgaattattgttcgaaaaagatgcttatcgtaatacagtgttggccgcgactttttctcatctgaaccaagacaacagcacgccatcaacataa

SEQ ID NO: 106847 - protein, 334 aa, Photobacterium profundum SS9
MTAQPLHYFDFSQEDRYAETMSGPVAEMWKQRQEGTFKGVDDLNIGWVSLTGYNHDKAIIVVNGRIESYWKYQELFYDLVKQGYDVYAIDHRGQGISDRLAKDNELGHVEEFDDYVTDLKTFFDTVVTPKKYQQHFLLGHSMGGTISTLFLAKYPSLIKRAVLSAPMHGIQLSNWMKPIASPFARVVEQLQRQPNYAPGQVPYYPKPFLNNKLCQSQIRYQWFRDLYEHKPALKIGGPSARWVWQGMAAANRCITQAANIATPILLIQGSDDNIVDNQAHHRFCQAMNQANRSCELKTINGARHELLFEKDAYRNTVLAATFSHLNQDNSTPST

SEQ ID NO: 106848 - DNA, 996 bp, Photobacterium profundum SS9
  CDS (1)..(996): transl_table=11
atgatccaagtatgcataacggaacttgtcacgaaggaatcgagctttaccacgctaatgacacatgaaattcatcaaatgtggcaacaacggcagcaagatacatttatgggggtaaataatataccgatccgttggataagtattacccatcagaagaatacacagtgtgttgttattgttaatggtcgcaatgaaagtttttggaaataccaagaagtattctatgaatttagtcgtcgtggttttgatgtgtttgcgtttgatcaccgtgggcaaggtgcttcagggcgtataaccaccgatcctgaagtcgggcatgttgatagttttaatgactatgttgaagacctacatcaatttgtagatggcatcgtaaagccaagtcattacaaacatgcattcattctggcgcattcaatgggtggtgcaataacaacgctatacctagaacaacacccttatgtattcgatgcagcagtgttaaatgcccctatgtttggcattcgcatgcctgctattctacaccgtatcgcgccatttatggcgaagatgttgactaaagttgcagctaaatatcaacaacaaccttcttatttatttggacagaaggcatattatgaagcctctttcgaaaataatgaccaatgccaaagtttgctacgttacgtatgggcgaagcatttatatcaggttcaccctgagctgcgcattggaggtcctagtgctcgctggttgtggcaagctttaaccgcggcaaatgattgtattcgagatgcggaaaaattgaagacccctgttttgttattacaggcgggtaacgacacaatagtcgataataaagcgcagcgtcgtttcaattgcgtgagtgagcaatgccagatcaaagtgatagagcaagctaggcatgaactattgatggagaaagatgaactacgcaaccaagtactaatggaaactgtctccttttttgaccgttttacagtgatcaattaa

SEQ ID NO: 106849 - protein, 331 aa, Photobacterium profundum SS9
MIQVCITELVTKESSFTTLMTHEIHQMWQQRQQDTFMGVNNIPIRWISITHQKNTQCVVIVNGRNESFWKYQEVFYEFSRRGFDVFAFDHRGQGASGRITTDPEVGHVDSFNDYVEDLHQFVDGIVKPSHYKHAFILAHSMGGAITTLYLEQHPYVFDAAVLNAPMFGIRMPAILHRIAPFMAKMLTKVAAKYQQQPSYLFGQKAYYEASFENNDQCQSLLRYVWAKHLYQVHPELRIGGPSARWLWQALTAANDCIRDAEKLKTPVLLLQAGNDTIVDNKAQRRFNCVSEQCQIKVIEQARHELLMEKDELRNQVLMETVSFFDRFTVIN

SEQ ID NO: 106850 - DNA, 1005 bp, Idiomarina loihiensis L2TR
  CDS (1)..(1005): transl_table=11
atgaagcaaccgcctactacacaacaacgccctgcagacgacacgcccgaatggctggagttttttaaggctcaagtcgaagtcttttgggaacaacaagttacctctgagtattttgctgcgtttgatggtctcaaattacattttgcctattaccgacatagtgactccgcacccttagtggttattgctccggggcgaatagagtcggcactgaagtatcaggaactgttttgggagctggcacagcagggcttttctgttgcggcactggatcaccgtgggcagggattgtcggggcgcctgacggcgaaccctcatcagggacatgtcgaaaactttaatgactttgtacgtgacttttcggactttaccaacctgttagtggcacgatttggcgatgtacccaaaacactgttttctcactcgatgggcggaacaatagcgaccatttactgtgccacttaccagcatccttataaaaaactcatactctctgctcctatgttttctatagaaacaggaatagtgccttattggttcgcgcgttggatagtttttgcgggagcctggttaaaccgctggctggcaaaaccgtggtattttctcggtatgggaaattataagccggtgccttttgaagagaacgttctgacacatagccgacagcgatataaggcgtttcgggatgcttatgataatgtttcggatgttcagctaggcgggcccacatttaattggctgtatgaggccatcagtgccgctatcaacgcgcagaaactggcaaatgacattaccatttcggtcattctgtttcaggcagggaatgataaagtggtttccgcgtcaggacaaaagaaagtagctgctgcggttacccgggaccactttaggtttgagaccattaaaggtgcatcgcacgagcttatgatggaaactgacaagtttcgtcaacctgtgctggacgctcttattgaagaaacccggaaacttgctaacgcttaa

SEQ ID NO: 106851 - protein, 334 aa, Idiomarina loihiensis L2TR
MKQPPTTQQRPADDTPEWLEFFKAQVEVFWEQQVTSEYFAAFDGLKLHFAYYRHSDSAPLVVIAPGRIESALKYQELFWELAQQGFSVAALDHRGQGLSGRLTANPHQGHVENFNDFVRDFSDFTNLLVARFGDVPKTLFSHSMGGTIATIYCATYQHPYKKLILSAPMFSIETGIVPYWFARWIVFAGAWLNRWLAKPWYFLGMGNYKPVPFEENVLTHSRQRYKAFRDAYDNVSDVQLGGPTFNWLYEAISAAINAQKLANDITISVILFQAGNDKVVSASGQKKVAAAVTRDHFRFETIKGASHELMMETDKFRQPVLDALIEETRKLANA

SEQ ID NO: 106852 - DNA, 963 bp, Silicibacter pomeroyi DSS-3
  CDS (1)..(963): transl_table=11
atgaccctgacgccggcccccctgttcgaagatgtggccggcggccccgccggtggcgcggcccattggatgcagaccagcgacgggctgcgcatccgtgccggtcactggcgccccgagggcgaggtacgcggcaccgtgctgatgtttcccgggcgcaccgaatatgtcgagaaatacggcaatgcggcgcaggcctttgtgacgcgcggctttgccatgctggcggtggactggcgcggccagggcctggccgaccggctgctggaggaccggcgcctgggccatgtgctggagttcaccgattaccagcgcgacgtggcggcagtggtggaactggccaccacgctggacctgcccagaccctggttcgtggtcggccattccatgggcggcgccatcgggctgcgcgcggtgatggaggggctgccggtggcggcctgcgcctttaccggcccgatgtggggcattttctttaccccggtgatgaagccgctgagctggatcaccgccaacctcgctccggcgatcggaatggggcacaaacatcccgccaccaccacgctggaaccctatgtgcaggcgcaggagttcgagggcaattcgctgacccgcgacccggcgatgtacgagatgatgcgcagccagctggccgcgcatccggaactggcacttggggcgcccaccaatatctggctgcgcgaggcgctggccgaatgccgtgcactcagcgatcgcccctcgcccgatctgccctgcctgacctttctgggcagccatgagcagatcgtcgaccgcaaggcggtgcgcgcccgcatggcgcgctggccgcgcggcgagctggtcgagatcccggacggcgaacacgaggtgctgatggaggcccccgaggtgcgtgacccggcctatgaccggatggcggccctgttctcggcccccgaccagttgcaacgcagcgcctga

SEQ ID NO: 106853 - protein, 320 aa, Silicibacter pomeroyi DSS-3
MTLTPAPLFEDVAGGPAGGAAHWMQTSDGLRIRAGHWRPEGEVRGTVLMFPGRTEYVEKYGNAAQAFVTRGFAMLAVDWRGQGLADRLLEDRRLGHVLEFTDYQRDVAAVVELATTLDLPRPWFVVGHSMGGAIGLRAVMEGLPVAACAFTGPMWGIFFTPVMKPLSWITANLAPAIGMGHKHPATTTLEPYVQAQEFEGNSLTRDPAMYEMMRSQLAAHPELALGAPTNIWLREALAECRALSDRPSPDLPCLTFLGSHEQIVDRKAVRARMARWPRGELVEIPDGEHEVLMEAPEVRDPAYDRMAALFSAPDQLQRSA

SEQ ID NO: 106854 - DNA, 834 bp, Dehalococcoides ethenogenes 195
  CDS (1)..(834): transl_table=11
atgaggtttacagaagggcattttaaaggctgtcaggactacaattgctactatcaggccttactgccaaacggcagccccaaggccattgtactggtggtacacggcctgggagagcattccggccgttacagtgagctggcccattatctggcagaccgcagttatgccgtttatgcttatgaccatttcggtcacggcaaaacagacggcaaagccggttatgtatccagttacgatgtatatatttatgaccttatcagcgcttttagcatggtgcaggccaaacatcccacttccaaaatattcatcttcggccacagcatgggcggcctggttaccgcagcctatgccagcaagcaccagtatgacgccagcggccttatcttttccagcatagccctcaagccgtataccggtatgccgggcattttaaatcagctggttaaacccatttccaaaatagcccccatgctgggaatacgtaaaattgacgccgctactatcagccataataaagaaatagttaaggcttatgatgaagacccgctggtgcttcaccagcggatgagcgcccaaatggccgccgaatttctgcgtatctgccaggatttgcctgattttctgaagaatatcagcctgcccagtttgattatccacggtgaggaagaccacctggtaagcataagcggcagccgtgagctggtccagaaaataagctccaaagataagaccctgataacctaccccggcatgtaccacgaggtatttaacgagcctgactgccctcaggtttggaatgacctgtttttctggcttgaaaaccatctctaa

SEQ ID NO: 106855 - protein, 277 aa, Dehalococcoides ethenogenes 195
MRFTEGHFKGCQDYNCYYQALLPNGSPKAIVLVVHGLGEHSGRYSELAHYLADRSYAVYAYDHFGHGKTDGKAGYVSSYDVYIYDLISAFSMVQAKHPTSKIFIFGHSMGGLVTAAYASKHQYDASGLIFSSIALKPYTGMPGILNQLVKPISKIAPMLGIRKIDAATISHNKEIVKAYDEDPLVLHQRMSAQMAAEFLRICQDLPDFLKNISLPSLIIHGEEDHLVSISGSRELVQKISSKDKTLITYPGMYHEVFNEPDCPQVWNDLFFWLENHL

SEQ ID NO: 106856 - DNA, 969 bp, Vibrio fischeri ES114
  CDS (1)..(969): transl_table=11
atgaaagcagcgacctttactcaagaaacgcattaccttgaaaccatgaaaaaccaagtagcccctttttgggagaaacgccaacacggtttttatcaaggagagaaggaaacacaacttcattgggtaagttttacgagccctgctcacaccaaagcgatcatggttgttaacggacgaattgaaagtgtctataaataccaagagctattttatgatttattctgccaaggctatgatatttattctttcgatcaccgtggccaaggtctgtccgatcgcctaacggataataatgatattggtcatattgaagactttaatgattacgttctcgatttaaatagcctaactcaatcattaatcacacctgagcattaccaagactgctatctactcggtcattcaatgggaggggcaattgcaactcaatacattgaaactcactctcacccctacaccgctttagcattaagtgctccaatgcatggtattcatatgcaaccttggctaaagcccattgcaaacccaattagtcgctacttaagcttatggtcaaaacagccttcttacgccttaggccaagcgccatatcatgcaaaaccatttttagataatgcgctcactacttgtgaaattcgctatcagtggtttagagaactctatgacaccaaaccagaattgcagatcggtggtccaagcaatcattgggttaatcagggattaaaaggggcaaagctatgtgttgaccaagcagcacaatgcacacttccaaccttattacttcaaggtgaaaaagaccaaatcgttgataataatgcgcatgtgaagtttcagaaaaaagcaccagattgccaattaataaccatttctgatgcgaaacatgaattgctgtttgagacggatgaatgccgcaaccaagcattagttgctatcattgattttttccagcaacactctcacgtgtga

SEQ ID NO: 106857 - protein, 322 aa, Vibrio fischeri ES114
MKAATFTQETHYLETMKNQVAPFWEKRQHGFYQGEKETQLHWVSFTSPAHTKAIMVVNGRIESVYKYQELFYDLFCQGYDIYSFDHRGQGLSDRLTDNNDIGHIEDFNDYVLDLNSLTQSLITPEHYQDCYLLGHSMGGAIATQYIETHSHPYTALALSAPMHGIHMQPWLKPIANPISRYLSLWSKQPSYALGQAPYHAKPFLDNALTTCEIRYQWFRELYDTKPELQIGGPSNHWVNQGLKGAKLCVDQAAQCTLPTLLLQGEKDQIVDNNAHVKFQKKAPDCQLITISDAKHELLFETDECRNQALVAIIDFFQQHSHV

SEQ ID NO: 106858 - DNA, 1113 bp, Salmonella enterica subsp. enterica serovar Choleraesuis str
  CDS (1)..(1113): transl_table=11
ttgtctgtttttgtgccacaatacgctactgccgctgtgttgtgtcaggcacgacgcaaaaaacgattttacctggtaaacgaggccgaaaacccgatgtttcagcagcaaaatgactgggaaacaagagaaaatgcgtttgccgcttttgctatggggccgctgaccgatttctggcgtcagcgggaagaggcggagtttatcggcgtgggtaacattccggtgcgctttgtccgttttcgaaatgattccaacgatcggacgatcgtcatttgtcctggccgcattgagagttatgtaaaatacgctgaactggcgtatgacctttttcatctcggttttgatatcttcatcatcgaccaccgtggtcaagggcgctccgggcggatgttatcggacccgcatcggggtcatgtcgatcattttaacgattatgttgaggacttagcggcgttctggcagcaggaaattgagccggggccgtggcgtaagcgttatatcctggcgcactcaatggggggcgcgatagccaccctgttcctgcaacgccatcgtgtgcggtgcgacgctattgcgctcaccgcgccgatgtttggtattgtgatacgcttgccttcctttatggtgcgccatattctcgactgggccgaagggcaccagcgtatccgtgaagattacgctattggtaccggtcagtggcgggcgttgccgtttgggatgaatgcgctgacccacagccgccagcgttatcagcgcaacttacgattttatgccgacgagccgcagctgcgcgttggcggccccacttggcattgggtacgcgaaggcattctggcgggtgagcaggtactggctggggcgagcgatgacacgacgcctacgctactgattcaggcggaagaagagcgggtagtggataaccgcacccacgatcgtttttgtgaaattcgcgccgcggcgggatacccttgtgaagggggaaaaccgctggttatcaaaggcgcgtaccatgagatcctttttgaaaaggacgccatgcgctcagtcgcgcttaacgccattgttgaatttttcaacaagcctaatttatccagcggaaatcgctttgcttag

SEQ ID NO: 106859 - protein, 370 aa, Salmonella enterica subsp. enterica serovar Choleraesuis str
MSVFVPQYATAAVLCQARRKKRFYLVNEAENPMFQQQNDWETRENAFAAFAMGPLTDFWRQREEAEFIGVGNIPVRFVRFRNDSNDRTIVICPGRIESYVKYAELAYDLFHLGFDIFIIDHRGQGRSGRMLSDPHRGHVDHFNDYVEDLAAFWQQEIEPGPWRKRYILAHSMGGAIATLFLQRHRVRCDAIALTAPMFGIVIRLPSFMVRHILDWAEGHQRIREDYAIGTGQWRALPFGMNALTHSRQRYQRNLRFYADEPQLRVGGPTWHWVREGILAGEQVLAGASDDTTPTLLIQAEEERVVDNRTHDRFCEIRAAAGYPCEGGKPLVIKGAYHEILFEKDAMRSVALNAIVEFFNKPNLSSGNRFA

SEQ ID NO: 106860 - DNA, 996 bp, Brucella abortus biovar 1 str. 9-941
  CDS (1)..(996): transl_table=11
atgtcggaactgctttttgaaaccgatgcaaatccgatcccgagccgaataagaggcggtcttttccatgcgccggacgggaaggccctgcgctacgccctgctgaaagccgaaagccggccgtgccggggcacggtcatcgtgcttcagggccgcaacgaattcatcgaaaattattatgaaaccatgtccgacctcgccgggcgcggttttaccgttgccaccttcgactggcgcggccagggcggctcgcatcgcctgctgcgcgaccgcctgcgcggctatgtgcgcagcttcaacgattatgccgacgatctcgaccatttcctgaccggaatcgtgctgcccgactgcccgccgccatttttcattctcgctcactcggcaggtgcgctggtcgcgctttcctcactggaacggctctcctcccgcatcacccgcatggtgctttgcgcgcccctgatggggcttggcggacagaaaatcagcgatgacaatgtgcgccgcattaccgccgcgctgcgctggatcggcctggggagaatctatgcggcaggcgggcgcaccctgtcggcggcgcgcgcctttgccgacaatccactgaccagtgatccgttacggttcatgcgcaatgtggaaatcacacggacttatacggacctcgcgcttggcggccccaccgtgcgctgggtctggagcgcactggaaaccgcatggcgcatcaaccagccggatttttacaaaagccccatcgcgccggttctgattatcgcggctggtgctgaccgcgttgtttcaacagcggtgatcgagcgtttcgtggcgcgcacgcgaaacatctcgctcgccgttattgacggtgcgcgccacgaaatgctccaggaagcagatttctaccgcgaacaggtgctggcggctttcgacgccttcatccccggctcatcgccggtggaatccatgccccaaagtcttgaacccgacctctctcaaatctaa

SEQ ID NO: 106861 - protein, 331 aa, Brucella abortus biovar 1 str. 9-941
MSELLFETDANPIPSRIRGGLFHAPDGKALRYALLKAESRPCRGTVIVLQGRNEFIENYYETMSDLAGRGFTVATFDWRGQGGSHRLLRDRLRGYVRSFNDYADDLDHFLTGIVLPDCPPPFFILAHSAGALVALSSLERLSSRITRMVLCAPLMGLGGQKISDDNVRRITAALRWIGLGRIYAAGGRTLSAARAFADNPLTSDPLRFMRNVEITRTYTDLALGGPTVRWVWSALETAWRINQPDFYKSPIAPVLIIAAGADRVVSTAVIERFVARTRNISLAVIDGARHEMLQEADFYREQVLAAFDAFIPGSSPVESMPQSLEPDLSQI

SEQ ID NO: 106862 - DNA, 936 bp, Haemophilus influenzae 86-028NP
  CDS (1)..(936): transl_table=11
atgatcagagaaccttattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgtgcagaaaatatgttgaaatggtcagagctcgcttatgatttttatcatcaaggttatgatgtattgctatttgatcatcgcggtcaaggctattcacagcgtattattcctcaaaaagggcatttagacgaatttcgtttctatgttgatgatatggcgaaaatcatcgaaaaagtaaccgcacttttcagctattcaacgcagcatttgcttgctcattcgatgggcgcattgattgcaacctattatttggcaaattatgatcatcacattaataaagcggtactttcttcgcctttttacggtattcttttaaaacatcccattagagatgaactgattattgccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttgtgtttgaacgcaattaaacgcttgccgaaagttattcctaagattgaaattccaatcctaattttacaagccgaaaaagaaaaaatagtagataacaacaatcttgaaaaattaaccgtactttttccgaatgctagatgtgaagttgtattcaatgctaaacacgaaattctatttgaacaggacaaattaagaaaggaaacaatctttaaaatattagaatttttaaataattag

SEQ ID NO: 106863 - protein, 311 aa, Haemophilus influenzae 86-028NP
MIREPYFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKVTALFSYSTQHLLAHSMGALIATYYLANYDHHINKAVLSSPFYGILLKHPIRDELIIALMNILGQGERYVFGKGPYQQAHLEYNELTFCKTRMKWMNRVNRKNPAINLGGPTFRWVHLCLNAIKRLPKVIPKIEIPILILQAEKEKIVDNNNLEKLTVLFPNARCEVVFNAKHEILFEQDKLRKETIFKILEFLNN

SEQ ID NO: 106864 - DNA, 1005 bp, Colwellia psychrerythraea 34H
  CDS (1)..(1005): transl_table=11
ttgagtaaataccactcctttaattcagagaaaaacatcaaatacaaactaccaaatgagattaccttattttggaataaaggcctatttgactcatttatagggatagataaagtaaacatacactatgcgcaatttattcaagagcaagtagagtgtcctacgatagtcatagtgccagggcgctgtgagagctacttaaagtaccaagagctgtcatttgatttataccagcaagggtataacatttttatcatagatcatcgaggtcagggactatcaggacgaatgctgctaaacgtaaacaaaggttatgttacaaaatttcaagactatgtggatgacttacggtatttcattgaaaatatcgtgacacccaaatcttcagaaaaaccatacctcttagcgcactcaatgggtgggactattgccacccgttttatgcaagactctccaaatgcaattaaagccgccgtgatatcttcacctatgttgggcttttattctggtttgttaccaaagagcatagctaaaatactggtagccattaagctgaaattcaataatattatcagcaatacgccatggtattttttaggacaaaaagactactcccctgtcaattttactgataataaattaactcattcaataccgcgctatcaatactttgttgatttgtataaaaagaataaaatcatccaacttggtggtgttaccactcactggttagcacaaagtatcgcggctcaaaaagagcttttctctaagattgttcagcttaagacgcctatattattgcttcaagctagcggtgatactgtcgtttgccaacaagcacaagatgatttttgccagcaattacatacattgcaaccacaatcatgtccaaatggcgtaccgagtaacattgataacgccttccatgagctattttttgagaccgatgatcttagaaataaagcaataacacaaagccttgcttggtttgaacaacatacttaa

SEQ ID NO: 106865 - protein, 334 aa, Colwellia psychrerythraea 34H
MSKYHSFNSEKNIKYKLPNEITLFWNKGLFDSFIGIDKVNIHYAQFIQEQVECPTIVIVPGRCESYLKYQELSFDLYQQGYNIFIIDHRGQGLSGRMLLNVNKGYVTKFQDYVDDLRYFIENIVTPKSSEKPYLLAHSMGGTIATRFMQDSPNAIKAAVISSPMLGFYSGLLPKSIAKILVAIKLKFNNIISNTPWYFLGQKDYSPVNFTDNKLTHSIPRYQYFVDLYKKNKIIQLGGVTTHWLAQSIAAQKELFSKIVQLKTPILLLQASGDTVVCQQAQDDFCQQLHTLQPQSCPNGVPSNIDNAFHELFFETDDLRNKAITQSLAWFEQHT

SEQ ID NO: 106866 - DNA, 942 bp, Ralstonia eutropha JMP134
  CDS (1)..(942): transl_table=11
atggacaagcccatgacggaaaaccccgttcatcctgctgaagcaggcccatccggtcctgcggacgcggctggcaaagcgcccggtcttgcagcagtagaaagccgccagcgtatgcgcgacggcaccgaactgctgctgcgcacctgggaaccggatccgtgcatgttccccgaaacggtcggctgcgtgttgctcgtccatgggctggctgagcactgcggccgctaccagcatgtggccgaggtgctgtgcggattgggcctgcgtgtgcgcgcatacgaccagcgcggccatggtgcgagcggtggggcgcgcatggtcgcggaacatcccgatgcctacctcaatgaccttgtcgaaatccatgacgcggcagtgcgggtctggaaggaactgccgatcctgctcggccacagcatgggagggctggtcgccgcgcgcttcgccactgcgcgcttgcgcccggtgcgtgcgctggtgctgtcgtcgccggcgctggcattgcggttgtctccgacgatgctgacgatccaccgcgtacttcttacgctggcgccgcgcttgcgcgtgcccaacccgatcgatgcgcgcatgctgtcgcacgacgcgcatgtcgtggcgcgctatcgcgctgatccgctggtacagaccacgattacggccggcgtacttgagagcttcatccggggcatggcgcaagcgcagaccgatgcgccgcggctggaggcaccgatgctgatgctagtcggcggcgcggacaagatcgtcgatccgggcggaagccggaccttcttcgatcatgcgccggcagatctccgcgaagaagtgtggttcggcgagggctaccatgagatcttcaacgaggccgagccgttgcgcagcaaggtatttgcggcgctgacggactggctgcggcggcatctggcgcagccagtctag

SEQ ID NO: 106867 - protein, 313 aa, Ralstonia eutropha JMP134
MDKPMTENPVHPAEAGPSGPADAAGKAPGLAAVESRQRMRDGTELLLRTWEPDPCMFPETVGCVLLVHGLAEHCGRYQHVAEVLCGLGLRVRAYDQRGHGASGGARMVAEHPDAYLNDLVEIHDAAVRVWKELPILLGHSMGGLVAARFATARLRPVRALVLSSPALALRLSPTMLTIHRVLLTLAPRLRVPNPIDARMLSHDAHVVARYRADPLVQTTITAGVLESFIRGMAQAQTDAPRLEAPMLMLVGGADKIVDPGGSRTFFDHAPADLREEVWFGEGYHEIFNEAEPLRSKVFAALTDWLRRHLAQPV

SEQ ID NO: 106868 - DNA, 834 bp, Dehalococcoides sp. CBDB1
  CDS (1)..(834): transl_table=11
atgaggttcactgaagggcatttcaaaggctgtcaggaatacaattgttactatcaggctttactgccaaacggcagtcccaaggcaattgtgctggtagttcacggtctgggtgaacattcaggccgttacagtgaactggcccattatctggcagacagaagttatgccgtttatgcttatgatcatttcggccatggcaaaacagacggcaaagccggttatgtatccagttacgatgtatatatttatgaccttatcagcgccttcagtatggtgcaggccaagcaccctacctctaaaatattcatctttggccacagcatgggcggcctgattaccgcagcctatgccagcaagaaccagtatgatgccgccgggcttatcttctccagcattgccctaaagccgaataccggcatgccgggcgttattaaccagcttattaaacccctgtccaaaattgcaccgatgctgggagtacgtaagattaacgcatccactatcagccataacaaagatgtagtcaaagcttacaatgaagaccctctggtgcttcaccaccgtatgagtgcccaaatggcggccgaatttctgcgcatttgccaagacctgcccgattttctgaagaatatcagtctgcccagcctgattattcacggcgaggaagaccatctggtaaatataaaaggcagccgtgagctggtccaacggataaggtctaaagataaaaccctgataacttaccccggtatgtaccatgaggtattgaacgaacctgactgcccgcaggtctggaatgacctgtttttctggcttgaaaatcatatctga

SEQ ID NO: 106869 - protein, 277 aa, Dehalococcoides sp. CBDB1
MRFTEGHFKGCQEYNCYYQALLPNGSPKAIVLVVHGLGEHSGRYSELAHYLADRSYAVYAYDHFGHGKTDGKAGYVSSYDVYIYDLISAFSMVQAKHPTSKIFIFGHSMGGLITAAYASKNQYDAAGLIFSSIALKPNTGMPGVINQLIKPLSKIAPMLGVRKINASTISHNKDVVKAYNEDPLVLHHRMSAQMAAEFLRICQDLPDFLKNISLPSLIIHGEEDHLVNIKGSRELVQRIRSKDKTLITYPGMYHEVLNEPDCPQVWNDLFFWLENHI

SEQ ID NO: 106870 - DNA, 909 bp, Nostoc punctiforme PCC 73102
  CDS (1)..(909)
atgattgaccatagcgatcgcatcgcgtctcgtaaagaaggcacattccaaggtgttggaggacttgacctgtattatcaaagctggcatccagagggtaaagtacggggaatattagccattgtgcatggactcggagcccacagcgatcgctacagtaatgtaattcagcatttgattcccaaacaatatgctgtctatgccttagacttacgtggtcatggacgctcaccaggtcagcgaggctatatcaacgcttggagtgagtttcgagaagatttgggagcttttttacagttaattcagactcagaatcctggctgcccaatttttcttttgggtcatagcttaggcggggtgattgtcttagattacattctgcgctatccccaacaagcatcagttttgcaaggtgcgatcgctctcgcgccaaccttggggaaagttgggatttcaccgattcgggtgcttttaggaaaaatgctctcacgggtgtggccgcgtttcacattgaatacaggcattgacatcagtgctggttcacgagacccgcaggttttagctgcgatcgctcaggatacactgcgacatacccttggtactgcccgtctagctacagaattctttgcaacagttgattggattaatgctaaagcaggtgattggcaattaccattattgattctccacggtggtgcagaccgagtggctttacctgcgggaagcgacatcttttatcaacggataaattatacagataagctgagaattgagtacccagaagcctatcatgaaattcagcgtgacctcaattatcgagaggtaatggcagatttagagaattggttggagcgacacctatcatctgaggtggtgcagttaggacggggaagcgctgagttagagtaa

SEQ ID NO: 106871 - protein, 302 aa, Nostoc punctiforme PCC 73102
MIDHSDRIASRKEGTFQGVGGLDLYYQSWHPEGKVRGILAIVHGLGAHSDRYSNVIQHLIPKQYAVYALDLRGHGRSPGQRGYINAWSEFREDLGAFLQLIQTQNPGCPIFLLGHSLGGVIVLDYILRYPQQASVLQGAIALAPTLGKVGISPIRVLLGKMLSRVWPRFTLNTGIDISAGSRDPQVLAAIAQDTLRHTLGTARLATEFFATVDWINAKAGDWQLPLLILHGGADRVALPAGSDIFYQRINYTDKLRIEYPEAYHEIQRDLNYREVMADLENWLERHLSSEVVQLGRGSAELE

SEQ ID NO: 106872 - DNA, 1101 bp, Bifidobacterium longum DJO10A
  CDS (1)..(1101)
atgggagccatgcaggtgacgatgatcgacgaaaacaagtacgccgaaacgatgaccgacgtggtgctgcccgcgctcgaacaatgctgcgaggagggctggttcgatccgtccgccgccgaacgttcggccgggatcgagccgctgtccggcattatggacaccggcggccgctcgggccagctgcactacctgtgctacgactccgccaaattcgacgcgattcgcgagcaaggcgccaccgccaccttccgcggggccatcgtcatcagccacggcttcaccgagttcgccgaaaagtacgacgagctcgtctggtacttcctgcttgccggctactcggtgtgtgtactcgagcatcgcggccacggcaagtccgcgcgcgacgtggacaaccgctgcatggtgtggattgatgactggcagcgctacgtggccgatctggccggcttcgccgaaaccatcggccagcagtacgcggccggcatgccgctgaacctgttctgccattcgatgggcggcggcatcggcgcggccgtgttggagcgataccccaccctgttcgacaaagcggtgctctctgccccgatgatcgcccccgccaccggcatgccgctgggcgtggcccgtgtgctggtcggcgcgctgtgcggactcggcttcggcaagaagcgcgtgttcgggcagtcgggcttcacgccggaattctcgatggaaggcaacgagggcgcttccgaagcgcgtgaacgctggtacttcaagctgcgttgcgagaatagcgaataccagacctactgcgcggcgttcgaatgggtgcgccaagcgttgaagctcaaccgggccatactgaatccgtccgcctgcgccgaagtggagacgccggtgctgctcttccagtccggacgcgacatctgggtactcaataagccgcagaatcacttcgtccaactggtcaaggacggcggcggcgaggcgaacatcgtgcgcttccccgaatcgcgccacgaaatcttctccatgcccaacagcacttacaagccctacctcgaaaagatcctcggcttctacgacgaccccatgattgcctgcgccgcgtactga

SEQ ID NO: 106873 - protein, 366 aa, Bifidobacterium longum DJO10A
MGAMQVTMIDENKYAETMTDVVLPALEQCCEEGWFDPSAAERSAGIEPLSGIMDTGGRSGQLHYLCYDSAKFDAIREQGATATFRGAIVISHGFTEFAEKYDELVWYFLLAGYSVCVLEHRGHGKSARDVDNRCMVWIDDWQRYVADLAGFAETIGQQYAAGMPLNLFCHSMGGGIGAAVLERYPTLFDKAVLSAPMIAPATGMPLGVARVLVGALCGLGFGKKRVFGQSGFTPEFSMEGNEGASEARERWYFKLRCENSEYQTYCAAFEWVRQALKLNRAILNPSACAEVETPVLLFQSGRDIWVLNKPQNHFVQLVKDGGGEANIVRFPESRHEIFSMPNSTYKPYLEKILGFYDDPMIACAAY

SEQ ID NO: 106874 - DNA, 957 bp, Haemophilus somnus 129PT
  CDS (1)..(957)
atgagtcaacatgaatctcacttcaatcattttgccttagccgaactttatccttttgctacacaatttcctttgcaaaatataataggaaaaaaaggaatacgaatcgtctatcgccattttgttcaagaacattgtgctgaacgcagattagtgattttggtcaatggacgtgcagaaaacttgttgaaatggacagagttggcttataacttttatcgacaaggctatgatgttttagcgtttgatcatcgtggacaaggctattctcagcgtttattaaaagaccatgacaaaggctatattgatgagtttcgtttttatgcggatgatcttactttgttagtggaaaaaattacttcgttgtatcactatcgcagccaacatattttggcacattctttaggcgctttaatcagcacttattatcttgccaatgataatcaccaaataaaaagtgcggtattttctgcaccattttatggtattccactacagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggtatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataa

SEQ ID NO: 106875 - protein, 318 aa, Haemophilus somnus 129PT
MSQHESHFNHFALAELYPFATQFPLQNIIGKKGIRIVYRHFVQEHCAERRLVILVNGRAENLLKWTELAYNFYRQGYDVLAFDHRGQGYSQRLLKDHDKGYIDEFRFYADDLTLLVEKITSLYHYRSQHILAHSLGALISTYYLANDNHQIKSAVFSAPFYGIPLQHSLRDEFIINLMMLLGQGSRYVFGKGEYKPADLDKNDLSLCRTRMKWMNRINRRYPHIHLGGPTFRWVYECMYAIKKLPVVLPRIEIPVLVLQSEREKIVDNQNLQKLTALLPQAQLVQIEHSRHEILFERDRIRDLALAKINQFFTENNAK

SEQ ID NO: 106876 - DNA, 957 bp, Haemophilus somnus 2336
  CDS (1)..(957)
atgagtcaacatgaatctcacttcaatcattttgccttagccgaactgtatccttttgctacacaatttcctttgcaaaatataataggaaaaaaaggaatacgaatcgtctatcgccattttgttcaagaacattgtgctgaacgtagattagtgattttggtcaatggacgtgcagaaaacttgttgaaatggacagagttggcttatgacttttatcgacaaggctatgatgttttagcgtttgatcatcgtggacaaggctattctcagcgtttattaaaagaccatgacaaaggctatattgatgagtttcgtttttatgcggatgatcttactttgttagtggaaaaaattacttcgttgtatcactatcgtagccaacatattttggcacattctttaggcactttaatcagcacttattatcttgccaatgataatcaccaaataaaaagtgcggtattttctgcaccattttatggtattccactgcagcattcattacgagatgaattcattattaatttaatgatgttgcttgggcagggctcacgctatgtatttggcaaaggtgagtataaacccgctgatttagataagaatgatttgagtctttgtcgtactagaatgaaatggatgaatcgtattaatcgtcgatacccacatattcatttaggcggaccaacttttcgttgggtatatgagtgtatgtatgccattaaaaaattacccgttgtcttaccccgaattgaaattccggtactagttttacaatcagaaagagaaaaaattgtggataaccaaaatctgcaaaaattgaccgcacttttgcctcaagctcaactagtgcagattgaacatagtaggcatgagattttatttgaacgtgatcgaattcgagatttagcactagcaaaaatcaatcagttttttactgaaaataacgccaaataa

SEQ ID NO: 106877 - protein, 318 aa, Haemophilus somnus 2336
MSQHESHFNHFALAELYPFATQFPLQNIIGKKGIRIVYRHFVQEHCAERRLVILVNGRAENLLKWTELAYDFYRQGYDVLAFDHRGQGYSQRLLKDHDKGYIDEFRFYADDLTLLVEKITSLYHYRSQHILAHSLGTLISTYYLANDNHQIKSAVFSAPFYGIPLQHSLRDEFIINLMMLLGQGSRYVFGKGEYKPADLDKNDLSLCRTRMKWMNRINRRYPHIHLGGPTFRWVYECMYAIKKLPVVLPRIEIPVLVLQSEREKIVDNQNLQKLTALLPQAQLVQIEHSRHEILFERDRIRDLALAKINQFFTENNAK

SEQ ID NO: 106878 - DNA, 942 bp, Haemophilus influenzae R2846
  CDS (1)..(942)
atgatcagagaacctcattttcatcaatttgctcttgcagaattattgcctttttttgagcaatttcctacccaatatctttctggtaaacgaaatataaaattagcttatcgtcatttgattcaacctgaaagtgcggtcagaaaattgatgattttagtaaatggtcgagcagaaaatatgctgaaatggtcagagctcgcttatgatttttatcatcaaggttatgatgtattgctatttgatcatcgcggtcaaggctattcacagcgtattattcctcaaaaagggcatttagacgaatttcgtttctatgtcgatgatatggcaaaaatcattgaaaaagcgaccgcactttatgcttatcaagcgcaatatattctcgcacattccctcggcgctttgatttccacctattatctagcaaattatgatcatcacattaataaagcggtactttcttcgcctttttacggtattcttttaaaacatccaattagagatgaactgattattaccctaatgaatattttaggacaaggcgagcgttatgtttttggtaaagggccttatcaacaagcccacttggaatacaatgaattaactttctgtaaaaccagaatgaaatggatgaatcgtgtaaatcgtaaaaatccagcaattaatcttggcgggccaacattccgttgggtacatttatgtttgaacgcaattaaacgcttgccgaaagttattcctaagattgaaattccaatcctaattttacaagccgaaaaagaaaaaatagtagataacaacaatcttgaaaaattaaccgcactttttccgaatgctcaatgtaaagttgtattgaacgctaaacatgaggtgttatttgaaaaagataatgttcgaagaaatgtacttaaaagtgttaatcattttctaaatgtgcaaagttga

SEQ ID NO: 106879 - protein, 313 aa, Haemophilus influenzae R2846
MIREPHFHQFALAELLPFFEQFPTQYLSGKRNIKLAYRHLIQPESAVRKLMILVNGRAENMLKWSELAYDFYHQGYDVLLFDHRGQGYSQRIIPQKGHLDEFRFYVDDMAKIIEKATALYAYQAQYILAHSLGALISTYYLANYDHHINKAVLSSPFYGILLKHPIRDELIITLMNILGQGERYVFGKGPYQQAHLEYNELTFCKTRMKWMNRVNRKNPAINLGGPTFRWVHLCLNAIKRLPKVIPKIEIPILILQAEKEKIVDNNNLEKLTALFPNAQCKVVLNAKHEVLFEKDNVRRNVLKSVNHFLNVQS

SEQ ID NO: 106880 - DNA, 873 bp, Rhodobacter sphaeroides 2.4.1
  CDS (1)..(873)
atgcggctgcgcaccgtggtctggcccgagggggcggcgggaaccgtcctcatcttctcgggccgcaccgaatatgccgagaaatacggccccgcggccgaggcgctgcgccggcgcggctttgcctcagccaccctcgactggcgcggacaggggctgtcggaccggtcgctccgcgatccgctcgtgggccatgtcgacgatttcgcctcctatcagcaggatgtgacggccttcgtcgcggcgctgcgcgcgcaggggctgcccgagcccttccatcttctggcccattccatgggcggctgcatcgggctccgcgcgctgcacgaggggctgcccgtgcgcgccgcctgcttctcggcgccgatgtggggcatccgcgtccatgccgcgctgcggatcgtagcggcggcactcggggcgctcgcccgcgcgacggggctcgggcaccgctatgtccccggcaccggcacgcgcagctatgtcgccaccgccgccttcgacacgaacgtcctcacccgcgacccggagatgttcgcctggatgcaggagcagctggtgcaggcgccggaactgggtcttgccggcccgagcctcgactggctgcgcgcggccttcgaggagacggcgcggctgaagcggctgcccgcgccggatctgcccgcgctctgcatcgtgggctcggccgagaaggtggtcgatctcgaggagatccagcgccggatggagggctggggccggggcgaactgcagatcgtgcccggggccgagcacgaggtgatgatggaccgccccgaggtgcgcgacgccttcttcgacgccgccgcggcgctgttccgggcgagcgcggacccggacgccgtcagatcctga

SEQ ID NO: 106881 - protein, 290 aa, Rhodobacter sphaeroides 2.4.1
MRLRTVVWPEGAAGTVLIFSGRTEYAEKYGPAAEALRRRGFASATLDWRGQGLSDRSLRDPLVGHVDDFASYQQDVTAFVAALRAQGLPEPFHLLAHSMGGCIGLRALHEGLPVRAACFSAPMWGIRVHAALRIVAAALGALARATGLGHRYVPGTGTRSYVATAAFDTNVLTRDPEMFAWMQEQLVQAPELGLAGPSLDWLRAAFEETARLKRLPAPDLPALCIVGSAEKVVDLEEIQRRMEGWGRGELQIVPGAEHEVMMDRPEVRDAFFDAAAALFRASADPDAVRS

SEQ ID NO: 106882 - DNA, 846 bp, Burkholderia cepacia R18194
  CDS (1)..(846)
atgggccggctccgtaccgtggacgggctcgaactggcgtcgtaccggtggcccgccggaggcggcaccgcgccaccgcgcgcgacgatcgcgctcgtgcacggcctcgccgaacacgcgggccgctatgccgcactcgccggccggttgaatgcggccggcatcgacgtgctcgcgatcgacctgcgcggccatggccagtcacccggcaagcgcgcctgggtcgagcgtttcgacggctacctgaacgatgcggatgcgctggtcgcggaagccgcacgcggcaattcgccgctgttcctgatggggcacagcatgggtggcgcggtcgcggcgctgtacgcaatcgagcgcgcgccgacacgtggccacgcattgacgggcctcgtgctgtcgagcccggcgctcgcgccggggcgcgacgtgccgcgctggatgctcgcggtgagccgcgtcatcagccgcgtatggccgaccttccctgccatcaagatcgatgcggcgctgctgtcgcgcgatccggccatcgtcgcggccaatcgcgccgatccgctcgtgcatcacggcgcggtgcccgcacgcaccggtgcggagattctcgacgcgatggcacgcatcgaaagcggccgtggtgggttgcgcgttccggtgctcgtctatcacggcaccgaagacaagctgaccgagcccgacggcagccgggcgttcggcgcgcgcgtcggctcgcccgatcgcacgctgacgctgtacgaaggcggctttcacgaaacgatgaacgatctcgaacgcgaccgcgtgatcgacgcgctgatcgcgtggattcacgcacgcgcgccggcgcgctga

SEQ ID NO: 106883 - protein, 281 aa, Burkholderia cepacia R18194
MGRLRTVDGLELASYRWPAGGGTAPPRATIALVHGLAEHAGRYAALAGRLNAAGIDVLAIDLRGHGQSPGKRAWVERFDGYLNDADALVAEAARGNSPLFLMGHSMGGAVAALYAIERAPTRGHALTGLVLSSPALAPGRDVPRWMLAVSRVISRVWPTFPAIKIDAALLSRDPAIVAANRADPLVHHGAVPARTGAEILDAMARIESGRGGLRVPVLVYHGTEDKLTEPDGSRAFGARVGSPDRTLTLYEGGFHETMNDLERDRVIDALIAWIHARAPAR

SEQ ID NO: 106884 - DNA, 804 bp, Bacillus cereus G9241
  CDS (1)..(804): transl_table=11
atgtggaattatgaagcggaggaagcaaaggctgtaatcgttattgtacacggcgcaatggaatatcacgggcgttatgaagccgttgcggaaatgtggaatcatatcggctaccacgttgtgatgggggaccttccgtcacatggaacgacttcaagaaatagaggacatattgattcgtttgatgaatacatagaggaagttaaattatgggtgaaagaggcaagaaagtataggttgcctatctttttatttggtcatagtatgggtggtcttatcgtcattcgtatgatgcaagaaacgaaaagagaagatgtagatggcattattttaagttcgccatgtttaggcgtattagctggaccttcagcaccgctgcaagctgcctcaaaaatattaaatattattgctccaaaattgcaatttgcaacgaatcttacagtggaaatgtcaactcgtaatcatgaagtgagagatgcgatggagaatgattcattgttcttgcgcaaagtatcagtacgttggtatagtgaattgattaagtctatcgaaatggctcataagaaaataaacgattttccagatgttccgttcttgctaatgcaagcatgtgaggataaacttgtagataaaatacgtgtccgcacttggtttgataatgttaaaataagtgataaggcttttaaagaatggccgaattgttatcatgagttattaaatgagtatgagcgcgacgaaattttgaattatattcagtcatttactgaaatacgcatcaataacataatagaaacaaataagtaa

SEQ ID NO: 106885 - protein, 267 aa, Bacillus cereus G9241
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEMAHKKINDFPDVPFLLMQACEDKLVDKIRVRTWFDNVKISDKAFKEWPNCYHELLNEYERDEILNYIQSFTEIRINNIIETNK

SEQ ID NO: 106886 - DNA, 948 bp, Erythrobacter litoralis HTCC2594
  CDS (1)..(948): transl_table=11
atgacccgtttcgatcgccgcgccattccgtcatcagcgaaggaagattggtggggcctgcccgatgggcacagggtgcgccgtatcgattgggcgagcgaggccgagcctccgcgcggctccatcctgttcatgccggggcgcggcgatcactacgagaaatacctcgaaagtctggatgaatggcatcgcgccggctggcaggtgacggcagccgactggcgcggccaaggtgcctccggacggctcgggaccgacgaggtgactggccatgtcgacgactttgcgatctggatcgacgatttggcggcgctgtgggccgactggaaagcgcagacgccaggaccgcatgtgctggtcgcgcattccatgggcggacatctgggcttgcgggcggtggccgaagaacgggtcgatcccggcgcggtggtgctttccgcgcccatgctcggctttgtcggcaacctccccgtcagcctgacgcacggcgtagcgcggctgatgtcccgggtgggcgaccccaggcggccggcgtggaagtggagcgaaaagcccggagaaattcctgcgggccgcctcaagctcctgacccacgacgacgagcgctatcaggacgaactatggtggcgtgaaaagcggcccgaactcgtcatgggccccggaagctggggctgggtggagcgcgcttatgcctcgatgcgcggcttgttcgcggaaggcgtgctcgaaagcgttacgacaccgatcttgctgctgtcgacctcgaacgacaaactcgtgagccaccgcaaggtggtcgacgctgcggaacgcctgcccaacagcgagctcttggctttcggacgcgaatgtcatcacgaaatccttcgcgaagtcgatgccgttcgcgatcgcgcgatggagggtatcgccaatttcctcgaccgcaaggcgcccgcgagagactga

SEQ ID NO: 106887 - protein, 315 aa, Erythrobacter litoralis HTCC2594
MTRFDRRAIPSSAKEDWWGLPDGHRVRRIDWASEAEPPRGSILFMPGRGDHYEKYLESLDEWHRAGWQVTAADWRGQGASGRLGTDEVTGHVDDFAIWIDDLAALWADWKAQTPGPHVLVAHSMGGHLGLRAVAEERVDPGAVVLSAPMLGFVGNLPVSLTHGVARLMSRVGDPRRPAWKWSEKPGEIPAGRLKLLTHDDERYQDELWWREKRPELVMGPGSWGWVERAYASMRGLFAEGVLESVTTPILLLSTSNDKLVSHRKVVDAAERLPNSELLAFGRECHHEILREVDAVRDRAMEGIANFLDRKAPARD

SEQ ID NO: 106888 - DNA, 834 bp, Bacillus anthracis str. A2012
  CDS (1)..(834)
atgaaaaagagtgaaatggaggagagccgtatgtggaattatgaagctgaagaagcaaaggctgtaatcgttatcgtgcacggcgcaatggaatatcacggacgctatgaagccgttgcggaaatgtggaatcatatcggctaccatgtcgtgatgggggaccttccgtcacatggaacgacttcaagaaatagaggacatattgattcgtttgatgaatacatagaggaagttaaattatgggtgaaagaggcaagaaagtatcggttacctatttttctatttggtcatagtatgggtggtcttattgtcattcgtatgatgcaagaaacgaagagagaagatgtagacggcattattttaagttcgccatgtttaggtgtattagctggaccttctgcaccgcttcaagctgcctcaaaaatattaaatattatcgctccgaagttacaatttgcaacgaatcttacagtggaaatgtcaacgcgtaatcatgaagtgagagatgcgatggagaacgattcattgttcttgcgcaaagtatcagtacgttggtatagtgaattgattaagtctattgaaatcgctcataaaaaaatagatgattttccagatgttccgctcttgctaatgcaagcatgtgaggataaacttgtagataaaacacgtgtccgcacttggtttaataatgttaaaataagtgataaggcttttaaagaatggccgaattgttatcatgagttattaaatgagtatgagcgtgatgaaattttgaattatattcagtcatttactgaaatacgcatcaataacataatagaaacaaataagtaa

SEQ ID NO: 106889 - protein, 277 aa, Bacillus anthracis str. A2012
MKKSEMEESRMWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFNNVKISDKAFKEWPNCYHELLNEYERDEILNYIQSFTEIRINNIIETNK

SEQ ID NO: 106890 - DNA, 870 bp, Deinococcus geothermalis DSM 11300
  CDS (1)..(870): transl_table=11
atgcacagcacgggctgggaagcgtcagagtggaacctgtccaccggaagagagagggcaccggttcgtggctacgtatggcctgcccagcatccccgtgccgctgtgctgctcacgcacggactgggcgaatacgcgggccgctacgtggaacgctaccaccgtctgattccagcactggtggaggccggattcagcgtgtacgcctacgaccagcgcggccacggacactcggagggccgccgagccgtggtggacgcggcggtgctggtcgaagaccacctgcgcgcgcgcgaggcgctgcggggtcagccgcttccggtgtttgcctttgggcactcgctgggcggcctggtcacggcggcaagcgtcgcccgtgatccccgcggcctcagcggcgtcattctctccagcccggccctcctgattggggagaaccagcccagctggatcaaagctcttgcgcccgtgctggcgaggctcgcgcctgccgctcccgccgccgatctgggcaaggggggcctctcgcgcctcgcagaagaggtcgaggcttaccaagccgatccgaacatcttccaagggcaggtgcccgcgctgacggccgcctccatgctgcgcctcagcgagacgctgtggccgcagtacgcgcgctggacgctccccacgctggttcttcacggcaccgccgaccgcatcaccgacccgcacggctcgcgccgcttcgtggaggcgatcgcggcccccgacaagaccctgcgtctggtcgaaggcggctatcacgaactcctgaacgacgaggggcgcgaggaggtgcgaggctggattctggcctggctccaggaacgaaccgagcagccccaacgggcctag

SEQ ID NO: 106891 - protein, 289 aa, Deinococcus geothermalis DSM 11300
MHSTGWEASEWNLSTGRERAPVRGYVWPAQHPRAAVLLTHGLGEYAGRYVERYHRLIPALVEAGFSVYAYDQRGHGHSEGRRAVVDAAVLVEDHLRAREALRGQPLPVFAFGHSLGGLVTAASVARDPRGLSGVILSSPALLIGENQPSWIKALAPVLARLAPAAPAADLGKGGLSRLAEEVEAYQADPNIFQGQVPALTAASMLRLSETLWPQYARWTLPTLVLHGTADRITDPHGSRRFVEAIAAPDKTLRLVEGGYHELLNDEGREEVRGWILAWLQERTEQPQRA

SEQ ID NO: 106892 - DNA, 876 bp, Anaeromyxobacter dehalogenans 2CP-C
  CDS (1)..(876): transl_table=11
atgccgctccccaccttcccgtccgacgccgaggcgaggcacgaggaagggttcatcaactcggccgatcacctgcgcctgtactggcagcgcttcacgcccccggcgccgcgcgccaccgtggcggtgctgcacggcggcggcgatcactgcggccgctacgccgggatcaccgccgcgctggtgcgcgccgggttccaggtggcgctgctcgacttccgcggccacggccagtccgacggccggcgctggcacgtggacgcgttcgccgactacctcgccgacctcgacgcgctggtggcgaagctcgcccaggacggcgtcgccgccgagcggctcttcgtgctcgcccacagccagggggcgctcatcgcgacgctctgggggctgagcggccgcgggcgccacgtgagcgggttcgtgctcacctcgccgttctacgcgctcgccagccgcgcgccgctcgcgaagctcctcgccgcccgcaccctgggccggctcgtgccctggctgcccatctcgtccggcctcgacccggccgacctgacgtcggatcccgacctgcagaagtggaccgcccgcgacccgctctacgggcgggtgacgacgccgcgctggttcgaggaggcgcggcgcgcgcaggccgaggtggcgcggcgggcaggggagtggacggccccgctgctcgtgctcgcggccggcgccgaccgcgtggtggggctcgacgcgacgcgcgccttcgtctcggccgcgggagccaccgacaagcggctcgaggtgtacgaggggttccgacacgaggtgctgaacgaggtcgagcgggcgaggccgatcgccgaggcggtcgcctggctctcggcgcgcgcgccgcgttga

SEQ ID NO: 106893 - protein, 291 aa, Anaeromyxobacter dehalogenans 2CP-C
MPLPTFPSDAEARHEEGFINSADHLRLYWQRFTPPAPRATVAVLHGGGDHCGRYAGITAALVRAGFQVALLDFRGHGQSDGRRWHVDAFADYLADLDALVAKLAQDGVAAERLFVLAHSQGALIATLWGLSGRGRHVSGFVLTSPFYALASRAPLAKLLAARTLGRLVPWLPISSGLDPADLTSDPDLQKWTARDPLYGRVTTPRWFEEARRAQAEVARRAGEWTAPLLVLAAGADRVVGLDATRAFVSAAGATDKRLEVYEGFRHEVLNEVERARPIAEAVAWLSARAPR

SEQ ID NO: 106894 - DNA, 930 bp, Burkholderia vietnamiensis G4
  CDS (1)..(930): transl_table=11
atgagcgccatcacgccgcccgacgctgcagccgccgcagccgccatcgcagccggggatccggccgcgtgtcccccggcgcgaatgggccggctgcgcaccgcggacgggctcgaactggcgtcgtaccgctggccggccgcggacggcagcgcgccgccgcgcgcgtcggtcgcgctcgtacacggcctcgccgaacatgcggggcgctacgagcggctggcagcacggctgaacgcggcgggcatctcggtgctggcgatcgacctgcgcgggcacggccggtcgccgggcaagcgcgcgtgggtcgagcgcttcgacgattacctgaacgacgcggatgcgctggttgccgaagccgcgcgcggcaatacgccgctcttcctgatggggcacagcatgggcggcgccattgcggcgctgtatgcgatcgaacgcctgccggccagtggccacacgctcgctggcctcgtgctgtcgagcccggcgctcgcgccagggcgcgacgtgccgcgctggatgctggcgatgagccgcttcatcagccgcgtgtggccgagcttccccgcgatcaggatcgatgcggcgctgctgtcgcgcgatccggcgatcgtcgcggccaatcgggccgacccgctcgtgcaccacgacgcggtgcccgcgcgcaccggcgccgaactcctcgacgcgatggcgcgcatcgaacgcggccgcggctcgctgcgcgtgccggtgctcatctatcacggcaccagtgacaagctgacggaacccgacggcagccgcgcgttcggcgcgcacgtcggctcgcccgatcgcacgctgacgctctacgaaggcggattccacgaaacgatgaatgatctcgagcgcgagcgcgtgatcgatgcgctgatcgcgtggattcacgcgcacgcgccggccggctga

SEQ ID NO: 106895 - protein, 309 aa, Burkholderia vietnamiensis G4
MSAITPPDAAAAAAAIAAGDPAACPPARMGRLRTADGLELASYRWPAADGSAPPRASVALVHGLAEHAGRYERLAARLNAAGISVLAIDLRGHGRSPGKRAWVERFDDYLNDADALVAEAARGNTPLFLMGHSMGGAIAALYAIERLPASGHTLAGLVLSSPALAPGRDVPRWMLAMSRFISRVWPSFPAIRIDAALLSRDPAIVAANRADPLVHHDAVPARTGAELLDAMARIERGRGSLRVPVLIYHGTSDKLTEPDGSRAFGAHVGSPDRTLTLYEGGFHETMNDLERERVIDALIAWIHAHAPAG

SEQ ID NO: 106896 - DNA, 843 bp, Burkholderia mallei 10229
  CDS (1)..(843)
atgcgtaccgccgacaggctcgagctcgcgtgctaccgttggccgtctaccgcgccttcgtgcgccgcgccgcgcgcgaccgtcgcgctcgtgcacgggctcgccgagcacgcgggacgctatcaggcgttcgccgagcggctgaacgcggcgggcatcgaagtcgtcgcgatcgatctgcgcggccacgggcgctcgcccggcgaacgcgcatgggccgagcgcttcgaccggtatctggacgacgcggacgcgctcgtcgcgagcgccgcgcgcgagaacacgccgctcttcctgatggggcacagcatgggcggcgcaatcgccgcgctctatgcgatcgagcgcgcggccgcgcgccacgcgaacctggcgggcctgatcctgtcgagccccgcgctcgcgccggggcgcgacgtgccgcaatggatgctcgcgatgagccgcttcatcagccgcgtgtggcctcgctttccggcgctcaagatcgacgccgcattgctgtcgcgcgatccggccgtggtcgccgcgaatcgcgccgatccgctcgtccatcacggctcggtgccggcgcgcacgggcgccgagattctcgacgcgatgcgacgaatcgcggccggccgcgcggcgctgcgcatccccgtcctcgtctatcacggcaccgccgacaagctgaccgagcccgacggcagccgcgacttcggcgcgcacgtcggctcgcccgatcgcacgctcacgctatacgaaggcaactatcacgagacgatgaacgatctggaacgcgagcgggtgatcggcgcgctgatcgactggatcgccgcgcgcgtgccggctcgcggttga

SEQ ID NO: 106897 - protein, 280 aa, Burkholderia mallei 10229
MRTADRLELACYRWPSTAPSCAAPRATVALVHGLAEHAGRYQAFAERLNAAGIEVVAIDLRGHGRSPGERAWAERFDRYLDDADALVASAARENTPLFLMGHSMGGAIAALYAIERAAARHANLAGLILSSPALAPGRDVPQWMLAMSRFISRVWPRFPALKIDAALLSRDPAVVAANRADPLVHHGSVPARTGAEILDAMRRIAAGRAALRIPVLVYHGTADKLTEPDGSRDFGAHVGSPDRTLTLYEGNYHETMNDLERERVIGALIDWIAARVPARG

SEQ ID NO: 106898 - DNA, 909 bp, Burkholderia cenocepacia AU 1054
  CDS (1)..(909): transl_table=11
atgagcgccaccaccacaccggccgccgtgcccgccaccgccggatcggcgcccgcgccgcggatgggtcggttgcgtaccgcggacgggctcgaactggcgtcgtaccgctggccggcaagcgacggcaccgtgccgccgcgcgcgacgatcgcgctggtgcacggcctcgccgagcacgcgggccgctatgccacgctcgccggccggctgaacgcggccggcatcgacgtgctggcggtcgacctgcgcgggcatggccagtcgcccggcaagcgcgtgtgggtcgagcgtttcggcgactacctgaacgatgcggaggcgctggtcgccgaagccgcgcgcggcgcggcgccgctcttcctgatggggcacagcatgggcggcgcggtcgccgcgctctacgcgatcgaacgcgcgccggctcgcggccacgcgctggcgggcctcgtgctgtcgagcccggcgctggcacccgggcgcgacgtgccgcgctggatgcttgcgctcagccgcatcatcagccgtgtgtggcccactttccccgcgatcaggatcgatgcggccctgctgtcgcgcgatccagccatcgtcgcggccaatcgcgccgatccgctcgtgcatcacggcgcggtgcccgcacgcaccggcgcggagattctcgacgcgatgacgcgcatcgaaaacggccgcggcgcgctgcgcgtgccggtgctcgtctatcacggcaccgaggacaagctcaccgaacccgacggcagccgcgcgttcggcgcgcgtgtcggttcgcccgaccgtacgctgacgctgtacgaaggcggcttccatgaaacgatgaacgatctcgaacgcgaccgcgtgatcgacgcgctgatcgcgtggattcacgcgcgcgtgccggcgcgctga

SEQ ID NO: 106899 - protein, 302 aa, Burkholderia cenocepacia AU 1054
MSATTTPAAVPATAGSAPAPRMGRLRTADGLELASYRWPASDGTVPPRATIALVHGLAEHAGRYATLAGRLNAAGIDVLAVDLRGHGQSPGKRVWVERFGDYLNDAEALVAEAARGAAPLFLMGHSMGGAVAALYAIERAPARGHALAGLVLSSPALAPGRDVPRWMLALSRIISRVWPTFPAIRIDAALLSRDPAIVAANRADPLVHHGAVPARTGAEILDAMTRIENGRGALRVPVLVYHGTEDKLTEPDGSRAFGARVGSPDRTLTLYEGGFHETMNDLERDRVIDALIAWIHARVPAR

SEQ ID NO: 106900 - DNA, 843 bp, Burkholderia pseudomallei 1710a
  CDS (1)..(843)
atgcgtaccgccgacaggctcgagctcgcgtgctaccgttggccgtctaccgcgccttcgtgcgccgcgccgcgcgcgaccgtcgcgctcgtgcacgggctcgccgagcacgcgggacgctatcaggcgttcgccgagcggctgaacgcggcgggcatcgaagtcgtcgcgatcgatctgcgcggccacgggcgctcgcccggcgaacgcgcatgggccgagcgcttcgaccggtatctggacgacgcggacgcgctcgtcgcgagcgccgcgcgcgagaacacgccgctcttcctgatggggcacagcatgggcggcgcaatcgccgcgctctatgcgatcgagcgcgcggccgcgcgccacgcgagcctgacgggcctgatcctgtcgagccccgcgctcgcgccggggcgcgacgtgccgcaatggatgctcgcgatgagccgcttcatcagccgcgtgtggcctcgctttccggcgctcaagatcgacgccgcattgctgtcgcgcgatccggccgtggtcgccgcgaatcgcgccgatccgctcgtccatcacggctcggtgccggcgcgcacgggcgccgagattctcgacgcgatgcggcgaatcgcggccggccgcgcggcgctgcgcatccccgtcctcgtctatcacggcaccgccgacaagctgaccgagcccgacggcagccgcgacttcggcgcgcacgtcggctcgcccgatcgcacgctcacgctatacgaaggcaactatcacgagacgatgaacgatctggaacgcgagcgggtgatcggcgcgctgatcgactggatcgccgcgcgcgtgccggctcgcggttga

SEQ ID NO: 106901 - protein, 280 aa, Burkholderia pseudomallei 1710a
MRTADRLELACYRWPSTAPSCAAPRATVALVHGLAEHAGRYQAFAERLNAAGIEVVAIDLRGHGRSPGERAWAERFDRYLDDADALVASAARENTPLFLMGHSMGGAIAALYAIERAAARHASLTGLILSSPALAPGRDVPQWMLAMSRFISRVWPRFPALKIDAALLSRDPAVVAANRADPLVHHGSVPARTGAEILDAMRRIAAGRAALRIPVLVYHGTADKLTEPDGSRDFGAHVGSPDRTLTLYEGNYHETMNDLERERVIGALIDWIAARVPARG

SEQ ID NO: 106902 - DNA, 987 bp, Polaromonas sp. JS666
  CDS (1)..(987): transl_table=11
atggctgttttttctttcaacaagactgcgcccaaagtcgttttccccaaatcgaagcctcaccacacaccctccacggtggtcgtgcccttcactgcccgcgacggcgaaaacctggcgctgtacgagtggccgctggatgactgggccaatgaaatgggccggatcaggcggccaccccgcgcggtggtgctgatggttcacggtctgggcgagcacgccggccgctatgcgccggtggcccgccggctgctggaatggggttttgaagtacgggcctacgaccagcgcggccacgggcggtcgggtggcgcgcgcggtgtgctgcccgatgacacagccctgctcgaagacctggcagagatggtcgatgatatgcggctgcactgcaggcgcttgcggcctgccggcagcgcctcgcagccggagccgcagcccctgcccttgatcctgctggggcacagcctgggtggtcttgtcgtgagccgcttcgtcgcgctcaatatgcgcccggtggacggtctggtgatgtcgtccccggcgctggacccggggctcaatgcactgcagaaactgttgctggccgtgatgcccaggctggcgcccaatctgtgcgtcagcaatgggctggacccctatgccctttctcacgatgacctggtggttcaaaaatacctggctgaccgtcgggtgcacaacaagatatcttcccggttgggtgagttcattgccgtcggagggccggccaccgtggcggccgccgcccgctggagcacgcccaccttgctgatgtacgccggcgccgaccgcctcgtcaaccccgcaggcagccgcgcttttgcggaggctgccgccagctcatcggccgtggcgcccggcaccgtgactagcaagtgcttcgagggcttctatcacgagattttcaacgaggtggatgccgcgcaggtgtttgacacgctcaaggactggctggacgccaggttttag

SEQ ID NO: 106903 - protein, 328 aa, Polaromonas sp. JS666
MAVFSFNKTAPKVVFPKSKPHHTPSTVVVPFTARDGENLALYEWPLDDWANEMGRIRRPPRAVVLMVHGLGEHAGRYAPVARRLLEWGFEVRAYDQRGHGRSGGARGVLPDDTALLEDLAEMVDDMRLHCRRLRPAGSASQPEPQPLPLILLGHSLGGLVVSRFVALNMRPVDGLVMSSPALDPGLNALQKLLLAVMPRLAPNLCVSNGLDPYALSHDDLVVQKYLADRRVHNKISSRLGEFIAVGGPATVAAAARWSTPTLLMYAGADRLVNPAGSRAFAEAAASSSAVAPGTVTSKCFEGFYHEIFNEVDAAQVFDTLKDWLDARF

SEQ ID NO: 106904 - DNA, 963 bp, Jannaschia sp. CCS1
  CDS (1)..(963): transl_table=11
atgttgatgaccgctgacatcaccgagcccgcaccgttctacgaggctgtcgccgaggggccggccaatgtcgcggcctcctgggtgcgggcggcagatggcacgcgcctgcgcatggcggtctggcccaccccaaatcaagaaggcgggtccaacggcaccgtactgatgtttccgggccgcacggaatatgtcgagaaatatggccgcgttgccagtgatctggcagaaaacggctacggcatggtggcgttcgactggcgcggtcagggtctggcggatcgcccgccgcatcgccgcgacatgggccatgtgctcaccttcgatgaatatagacaggacgtgacggcattcctcaaggcgatggagccgatgaacctgcccaagccgtggttcctgatcggccattccatgggcggctgcatcgggttgcgcgcgctctatgatggtctggacgtggaggctgcgacctttaccggcccgatgtggggcctgcagatgagcaacctcctccgcacgctccagcccgcgatcaccaagctcgccgggccaatgggctttggcaagaccttcgcgcccaccaccggcccgtgggagccgctggaattcgaggacaattccctgaccactgaccgcgaccagtttgactacatgttccgccagaccgatgtgcatccggaactggccctgggcggcccttcgctcagctgggtcaaggccgcgctttgggaaacggaggatctgatggagaagacaccgctcgacctgcccgccctggccatcgtcggcaccggagagcagatcgtggacgtcgacgccgccaggacccgcatggccagctggcccaaaggcagctacctcagcatcgaaggcgggcgccatgaggtgttgatggaggcggatccactccgtgaccagtccctggacgccattctcgcactattccggaaagccgcgcgttaa

SEQ ID NO: 106905 - protein, 320 aa, Jannaschia sp. CCS1
MLMTADITEPAPFYEAVAEGPANVAASWVRAADGTRLRMAVWPTPNQEGGSNGTVLMFPGRTEYVEKYGRVASDLAENGYGMVAFDWRGQGLADRPPHRRDMGHVLTFDEYRQDVTAFLKAMEPMNLPKPWFLIGHSMGGCIGLRALYDGLDVEAATFTGPMWGLQMSNLLRTLQPAITKLAGPMGFGKTFAPTTGPWEPLEFEDNSLTTDRDQFDYMFRQTDVHPELALGGPSLSWVKAALWETEDLMEKTPLDLPALAIVGTGEQIVDVDAARTRMASWPKGSYLSIEGGRHEVLMEADPLRDQSLDAILALFRKAAR

SEQ ID NO: 106906 - DNA, 867 bp, Sphingopyxis alaskensis RB2256
  CDS (1)..(867): transl_table=11
gtgagcgccgacaacgaaccgctgacgctgccggcctggcagggcggcgacgggtcgaacctcaatgtcacccgctggttgccgcagggcgatccgaaggcggtggtgctgctcgcgcacggctatgccgaacatgccgggcgctatggccatgtcgcggcgcggctgaccgcggcgggctatgccgtttacgccgtcgaccattgggggcatggcaagtcgagcgggacgatggggttcgtcccggccttttcagtctacatcgacggaatggcggcgctgatcgcgcgggtgcgcgaggcgtggccgggcaagccacgactgctgctcgggcacagcatgggcgggctgatcgcggcattgctgctgctcgggcatcagcgggactttgccgcagcagcgctgtcggggccggcgatcctgaccgcgaaaccaccatcaaggctgaccatctggataagccgtttgctctcgcgatatttcccgcgtgccggggtgatggctctcgatcccaccggggtcagccgcgacccggcggtcgtcgccgcctatctcgccgaccccttcgtccatagtggcaagatgagcgcgcggctcgcggcggaaatgttcgacgcgatggcgacggcgcgcgaccgggcgccggagatcggcctgccgctgctgctccagcacggcgccgaggacaggctgaccgctcctgcgggctcgcgcttccttttcgatcatgtcgcctcgaccgacaagcgcctcgaaatctatgctggcctctttcacgaaatctacaacgaacccgaacgcgatgcggtgctggacgacctgatcggctggttcgatgcgcatgtgaaagtcgaggacgcgccatga

SEQ ID NO: 106907 - protein, 288 aa, Sphingopyxis alaskensis RB2256
MSADNEPLTLPAWQGGDGSNLNVTRWLPQGDPKAVVLLAHGYAEHAGRYGHVAARLTAAGYAVYAVDHWGHGKSSGTMGFVPAFSVYIDGMAALIARVREAWPGKPRLLLGHSMGGLIAALLLLGHQRDFAAAALSGPAILTAKPPSRLTIWISRLLSRYFPRAGVMALDPTGVSRDPAVVAAYLADPFVHSGKMSARLAAEMFDAMATARDRAPEIGLPLLLQHGAEDRLTAPAGSRFLFDHVASTDKRLEIYAGLFHEIYNEPERDAVLDDLIGWFDAHVKVEDAP

SEQ ID NO: 106908 - DNA, 984 bp, Shewanella baltica OS155
  CDS (1)..(984): transl_table=11
atgagccaagccaaagcgacattttcgactgaacacgatttaaatacctcagagcagcaagccttctggcaaagcgttgttcaagacacgctgatcacagctgatggcatcacgctggcctatatgatggtcaaacatccccaagcacataccgcaatcgttctcagtagtggccgagttgaatcctatttaaagtaccaagaattggtcttcgacttgtaccaacagggttactctgtttatgccatcgatcaccgtggccaaggattgtcggatcgtatgacaatcaatccgcacatgggccatgtgcgaagatttaatgattatattgatgattttgcactgtttatgcaaaagaaagtgttaccacaaaacgacaaacaactaatgctacttggccattcaatgggtggcgcgattggcactttgtatctcaaacagcatcccgatatttttaccgccgcggcattttcagcgcccatgtatggcatcaaattacctatgccaaaagcattcgtgcgctggttagccagtaagctcgataccactctcaatggcggcgaacctaactatgtgcttggaggacagaactataaaccggttcccttcaaaggaaatgagctaacccattgccaaagtagataccaagcctatcgagacttgtatgacgcggcccctaagttacaactcggttccccaactaaccgttggttgacagaatctttagatgcagcagacacttgcgtactggcaacggcgcaaattcgcacgccgatcctgatactgcaagcgagtgaagataagattgttgataatgcggcccagaatcttgcggtgagcactcattgtcaattgaaggtaatagcaggggctgcccatgagatttttatggaaaaagacgcctatcggaaccaagccttaaattatgccctcgacttctttaaacgcttcgcaataaaggacgaggacaaacaagctggataa

SEQ ID NO: 106909 - protein, 327 aa, Shewanella baltica OS155
MSQAKATFSTEHDLNTSEQQAFWQSVVQDTLITADGITLAYMMVKHPQAHTAIVLSSGRVESYLKYQELVFDLYQQGYSVYAIDHRGQGLSDRMTINPHMGHVRRFNDYIDDFALFMQKKVLPQNDKQLMLLGHSMGGAIGTLYLKQHPDIFTAAAFSAPMYGIKLPMPKAFVRWLASKLDTTLNGGEPNYVLGGQNYKPVPFKGNELTHCQSRYQAYRDLYDAAPKLQLGSPTNRWLTESLDAADTCVLATAQIRTPILILQASEDKIVDNAAQNLAVSTHCQLKVIAGAAHEIFMEKDAYRNQALNYALDFFKRFAIKDEDKQAG

SEQ ID NO: 106910 - DNA, 1083 bp, Shewanella amazonensis SB2B
  CDS (1)..(1083): transl_table=11
atgccgtgctggcccatggcagcgtgcccctgtcggtgctggagcagcaaatcaacgactttatcgccgccgccaaagcggcctgaacccagtccggggccgctggccccggcatttttatcagatcgcatgcatacaccagctttgaatacatctttgacaattccacctgcccttaaggcgctgtatcagcgctgtgagctgggcagcctcgccaccagccccggcgtcgacatcgcctggctggcactggaacaccccagtcctaagggcagcattgttttttccaatggccgggttgaggcctttctcaagtatctggagctgtaccaggatttttatgacgctggctacagtgtctacgcactggaccatcgcggtcagggtctatcgagccgtcttacgcccaaccgccatatgggccatgtggcgcacttcagtgactatgtcactgacttcaatcattttatagaccaggttgtgcgcccccgagccaaagcgccgctgtttctggctggccactccatgggcggcgccataggcaccctgtatttgcaggcgcattcgggcctcttcagtgccgcctgtttctcggcccccatgtacggcatctgcctgcccatgaacaaggtgtttgtgcgctggctggcgcaaaagctggatgccagcgctaaagggctacccaactacattctcgggggcaaggactatcatccggccccctttgccaaaaacgacctcaccaaaagcgaggcccgttatcaggcctaccgcgagctctatgagcaaaacccgcaattgcaactgggctcgcccaccaaccgctggctgctggaagcattggatgcctgtgacgaagcggtattggcggcgcgggagagcaaaatccctttgctggtgttgcaggcgagtgaagacaccatagttgacaacaaagcccagaacagggccatgggtggactgtgcgaatgcttgcagattaacgacgcccgccatgagattttgatggaatgcgacggcccacgcaccaaggcgatagaggcgatgctgggcttttttgccagccatgccaagcagcgctga

SEQ ID NO: 106911 - protein, 360 aa, Shewanella amazonensis SB2B
MPCWPMAACPCRCWSSKSTTLSPPPKRPEPSPGPLAPAFLSDRMHTPALNTSLTIPPALKALYQRCELGSLATSPGVDIAWLALEHPSPKGSIVFSNGRVEAFLKYLELYQDFYDAGYSVYALDHRGQGLSSRLTPNRHMGHVAHFSDYVTDFNHFIDQVVRPRAKAPLFLAGHSMGGAIGTLYLQAHSGLFSAACFSAPMYGICLPMNKVFVRWLAQKLDASAKGLPNYILGGKDYHPAPFAKNDLTKSEARYQAYRELYEQNPQLQLGSPTNRWLLEALDACDEAVLAARESKIPLLVLQASEDTIVDNKAQNRAMGGLCECLQINDARHEILMECDGPRTKAIEAMLGFFASHAKQR

SEQ ID NO: 106912 - DNA, 921 bp, Ralstonia metallidurans CH34
  CDS (1)..(921): transl_table=11
atgaatgaacctgtgaccgccgctggccttccaggcgcgcgcgaatccgccgtaaccggagccgtacccaccgaaacacgccaacgaatgcgcgatggcaccgaactgctgctgcgcacctggctgcctgatccccaacgctttgccgagccgcttggcacggtgctgctggtacatgggctggccgagcatagcgggcgctatggccacgttgctgcagcgctttgcgcgctcggcctgcgcgtgcgggcctacgaccatcgcggccacggcgcgagtggcgggccgcgcatggtggcgcccacgccggacagctatctcgacgatctggccgaaatctacgatggtgcaatgcggcaatggaacgaattgccgatcgtgctcgggcacagcatgggcggactcattgctgcgcgctttgccaccgcgcgcgtgcggccgatccgcgcgctggtgctgtcgtcgcccgcgctggcgcttcgtctgtccaattctatgcttacgatgcatcgagtgctacttgctttgatgcctcgtattcgtgtgccgaatcccattgatgcccggctgttgtcccacgatgtcgaagtggggcgcgcatatcgcaccgatccgctggtgcaggggacgatcagcgccagcgtgctggagacattcatccggggaatgccgcaggccctggctgatgcgccgcggctggaagcgcccatgctgatgctcgtgggtggcgcggaccgcatcgtcgatccggagggcagccgcatcttcttcgagagcgcgccagaggatctgcgcgagatggtctggttcgacactggctatcacgagatattcaatgaagctgagccgttgcgcggcgaggtgtttgcggcactgaccggctggctgcggcagcgcctggagactccggcaaagcactga

SEQ ID NO: 106913 - protein, 306 aa, Ralstonia metallidurans CH34
MNEPVTAAGLPGARESAVTGAVPTETRQRMRDGTELLLRTWLPDPQRFAEPLGTVLLVHGLAEHSGRYGHVAAALCALGLRVRAYDHRGHGASGGPRMVAPTPDSYLDDLAEIYDGAMRQWNELPIVLGHSMGGLIAARFATARVRPIRALVLSSPALALRLSNSMLTMHRVLLALMPRIRVPNPIDARLLSHDVEVGRAYRTDPLVQGTISASVLETFIRGMPQALADAPRLEAPMLMLVGGADRIVDPEGSRIFFESAPEDLREMVWFDTGYHEIFNEAEPLRGEVFAALTGWLRQRLETPAKH

SEQ ID NO: 106914 - DNA, 972 bp, Mesorhizobium sp. BNC1
  CDS (1)..(972): transl_table=11
atggccgacctgctccgcgaaattccggaaaaccccgtgccgcccggcgcaatatcgggcatgatgaccgcacgcgaccgtcggcgcatccgctacgctctattcccctcctccggcgagtacggaaccgtggtcatcctgcccgggcgcaacgaatgtatcgagaaatatttcgagacggtgcgcgacctgtcggagcgcggcttcgcggtggcaatgttggattggcgcggccaaggtggatcggaccgtcttctcaaggatcctcggcgtggacatgtgcggtccttcaaccaatacacctccgatctcgaccagttcttccgcgaggtcgtgctgccggattgccgcccccctttcaccgtgctcggccactcgaccggctcgcttgcggctttactcgccgcaccttatctcaccacccgcgttcgacgcatggtgctcgttgcgccgctgcttgaaatccagacctcgcttccgcttggcccggcgaaaatgcttgcaaaactgctctgcgccgtcggccttggccgcatctatattgccgggcgaagcaggcgcgggaaggaagtccctttccagcccaatgtattgacgagcgatcaggaacggcacagccgaaaccaggcgctcctccacgcctttccggagctttttgtgggaggccctacagctgcgtggctgaatgcggcctggtcggcgataaagcgcgtcaacgaccccgatttccaggcatcggttcgcattcccattctcttcctggcggccgggatggacagggtggtttcgacgcccgcgatcgagcgctatgcgcgctgcctgcgctcggcaagggtgttaaccatcgacggtgcgcggcatgaaattctgcaggaggtcgatatgtttcgggaacaggctctcgccgccttcgagaccttcgcaaagggccaccaggaaagagccgccgcaaacgagcctgtggggatgtag

SEQ ID NO: 106915 - protein, 323 aa, Mesorhizobium sp. BNC1
MADLLREIPENPVPPGAISGMMTARDRRRIRYALFPSSGEYGTVVILPGRNECIEKYFETVRDLSERGFAVAMLDWRGQGGSDRLLKDPRRGHVRSFNQYTSDLDQFFREVVLPDCRPPFTVLGHSTGSLAALLAAPYLTTRVRRMVLVAPLLEIQTSLPLGPAKMLAKLLCAVGLGRIYIAGRSRRGKEVPFQPNVLTSDQERHSRNQALLHAFPELFVGGPTAAWLNAAWSAIKRVNDPDFQASVRIPILFLAAGMDRVVSTPAIERYARCLRSARVLTIDGARHEILQEVDMFREQALAAFETFAKGHQERAAANEPVGM

SEQ ID NO: 106916 - DNA, 948 bp, Silicibacter sp. TM1040
  CDS (1)..(948): transl_table=11
atggcagaaaccgcccccgcgccctatttcagcgagattgcgcgcggcccggatcaggtcgaggcccattggctgaccactcaggatggtcagcgtatccgcgcaggcctctggcgtagccacggtccttctgcgggcacaatcctgctgtttcccggtcgcacagaatacatcgagaaatatggcccactggccattgacctgacggatcggggttttgacgtcctgaccgtggactggcgcggacaggggcttgcggatcgcagcctgagcgatggccgcctcgggcatgttgcagaatttggcgcgttccagctcgacgtggcggcgctggtggcgcatgccgaggccctcaacttgccacgcccgtggtatctgctgggacattccatgggcggcgccatcggcctgcgggctctccacgagggtctgccagttgcggcctgcgccttcactgccccgatgtgggcgatccgcattccctttgcgctgcgaccggctgcccggcttttggcgcggtttgggacggcgctgggtgtgagcgagaagctggtgcccacaaccaccatcgaacaatacgtccaggtcacaccctttgagggcaacacgctgacaaatgacccggaaatgtacgctttcttgcagatgcagatgacccagcaccccgaattggccctcggggggccgacggtacaatggttgtctcaggccatgctggagtgcgcagatctgcgcgcgcgcccctcacccgatgtgccttgcgtgacctttctgggggaaaacgaacagatcgtcgccacagaggccattcatgatcgcatggcacgctggccatcaggcaagctcgagatgatcccggacgcccagcacgaaatcctgatggaaatccctcagacacgcaggcagacctgcgccatcctgacggcgcacttcaaaaaacacgtctag

SEQ ID NO: 106917 - protein, 315 aa, Silicibacter sp. TM1040
MAETAPAPYFSEIARGPDQVEAHWLTTQDGQRIRAGLWRSHGPSAGTILLFPGRTEYIEKYGPLAIDLTDRGFDVLTVDWRGQGLADRSLSDGRLGHVAEFGAFQLDVAALVAHAEALNLPRPWYLLGHSMGGAIGLRALHEGLPVAACAFTAPMWAIRIPFALRPAARLLARFGTALGVSEKLVPTTTIEQYVQVTPFEGNTLTNDPEMYAFLQMQMTQHPELALGGPTVQWLSQAMLECADLRARPSPDVPCVTFLGENEQIVATEAIHDRMARWPSGKLEMIPDAQHEILMEIPQTRRQTCAILTAHFKKHV

SEQ ID NO: 106918 - DNA, 945 bp, Nitrobacter hamburgensis X14
  CDS (1)..(945): transl_table=11
atgaggcttgtttcgatccccgcaaatccggttccggacgattacgtcagcggcaccgtcaggacctccgacggggtcgatctgcgctttgcgcgctgggcgccgccgccggggcgaaaggggacggtctgcgtgtttaccgggcgcggcgagcagatcgaaaaatacttcgagaccgtgtgcgacctgcgagaccgcggttttgcagtggcgatgatcgactggcgggggcaggggcactcggcgcggcagtcgtacgatccgcgcaagggttacgtgcgccgtttctccgattacgagatcgacgtccggtcctttgtggagcaggtggtgctgccggattgtccgccgccgtacttcgcgctggcgcattcgatgggaggcgcggtgcttctgcgggtggcgcacgccggccagcgctggtttgatcgtatcgtgctgtcggcgccgatgatcgatctgccgggacataccacctcgtttccggcgcgcgcgctgttgcgcgcgatgcggctgttcggacagggcggtcgctacgttcccggcggcggcgaccaactcaccggcgtcgccgatttcatcgacaatcccctcaccagcgaccccgtccggttcgcccgcaacgtcgcgatcctcgaggaagatccgacgctcggaatcgcctcaccgacggtggcgtgggccgataccgctttccgggcgatgcatgaatttcgcgccgtgaattatccgtcgaagattcgccagccgctgctgctgatcgcggccggcgacgataccatcgtctccaccccggcggtcgaggagttcgcctatcatctgcgctgcggcgcgcacctcgtcatcgccggatcgaagcacgagatcctgcaggaacaggatcgataccgcggccagttctgggcagcgttcgacgccttcgtgccggggacgccgctgttctag

SEQ ID NO: 106919 - protein, 314 aa, Nitrobacter hamburgensis X14
MRLVSIPANPVPDDYVSGTVRTSDGVDLRFARWAPPPGRKGTVCVFTGRGEQIEKYFETVCDLRDRGFAVAMIDWRGQGHSARQSYDPRKGYVRRFSDYEIDVRSFVEQVVLPDCPPPYFALAHSMGGAVLLRVAHAGQRWFDRIVLSAPMIDLPGHTTSFPARALLRAMRLFGQGGRYVPGGGDQLTGVADFIDNPLTSDPVRFARNVAILEEDPTLGIASPTVAWADTAFRAMHEFRAVNYPSKIRQPLLLIAAGDDTIVSTPAVEEFAYHLRCGAHLVIAGSKHEILQEQDRYRGQFWAAFDAFVPGTPLF

SEQ ID NO: 106920 - DNA, 945 bp, Paracoccus denitrificans PD1222
  CDS (1)..(945): transl_table=11
atgaagcccgcacccttcaacacgctgcccggcgatccgctccccttggcccgcgccttctggctgcgggccgaggacggggtgcggctccgggcggcgcattgggcggcgggcggcgcctcggggacggtgctgctgtttccgggccgcacggaatatctagagaaatacaacgacatcgcggcagaattgaatgccgccgggctggacgtgctggcaccggactggcgcggccagggcatgtccgaccgattgcaggacaatacccgccccggccatgtcggcgatttcgccgattaccagcgcgacgtggtcgaactggtcgtcgccgcgcaggaactggacctgccccggccctggcatcttctggcgcattccatgggcggcgccatcggccttgcggcgctggatgccgggctgccggtggaaagcgtggtcttctcggcgccgatgtggggcatcgacctgcgccgcgtgccggaagccgtcgccatggccgtcgcccggcttggcatccggctgggccggagcggccatcccgctcccggctcggggggcgaggaaagcttcgtgctgctggaccctttccacgacaacctgctgaccggggacggccggcgctggggccggctggtggccgaggccgccacctggcccgatatcgcggtcggcggcgccagctacggctggctgcgcgcggcgcttctggaatgccgccgcctcgccgccctgccctcgccggcactgccggcgctgatcgcgcttggcgatcgcgagcggatcgtctcgccccatgccatccgcacccgcgtcgccgcctggcccggcgccaccatgctggacttgcccgattgccggcatgagccgatgatggagcgcgaccccgtccgcagccgctttcttgaagccgccctcgcccatttcgagtccgccgcggcgggctga

SEQ ID NO: 106921 - protein, 314 aa, Paracoccus denitrificans PD1222
MKPAPFNTLPGDPLPLARAFWLRAEDGVRLRAAHWAAGGASGTVLLFPGRTEYLEKYNDIAAELNAAGLDVLAPDWRGQGMSDRLQDNTRPGHVGDFADYQRDVVELVVAAQELDLPRPWHLLAHSMGGAIGLAALDAGLPVESVVFSAPMWGIDLRRVPEAVAMAVARLGIRLGRSGHPAPGSGGEESFVLLDPFHDNLLTGDGRRWGRLVAEAATWPDIAVGGASYGWLRAALLECRRLAALPSPALPALIALGDRERIVSPHAIRTRVAAWPGATMLDLPDCRHEPMMERDPVRSRFLEAALAHFESAAAG

SEQ ID NO: 106922 - DNA, 990 bp, Shewanella denitrificans OS-217
  CDS (1)..(990): transl_table=11
atggtgagtatgataaagacagcccaaggttattcttcagaactgactcgagatcagtcagagttaacacaattttggtcacaggtgcagcaggaaagtttagccattgagcctgggatcaccttggcctatggatttatcagacatgaagacaatcgccgcgccattgtgattagcaatggccgagtcgagtcctaccttaagtatcaggagttaatttacgactgctatcagcaaggctttagtgtgtatgcactcgatcaccgaggccaaggcttgtccagccgcttaaccaccaatccccaccaagggcatgtggagcatttttctgattatgtagatgattttaaagtatttatcgaacgcgtggtaaaaccagagcgacacaaggagttatttcttgtcggccactccatgggcggtgccattgcgactcactatatacaccaagatccaacgacctttaacgcagcagtcttatcggcgcccatgtacggcattatactgccccttccgactgtcgttattaagcaactagcaaccaagatgataaacactcagcctgtcataggcagccacttagtcgctacaaactacattattggcgggcgggattatcaagccattagctttaaactgaatcaactcacccatagccaggtacgttaccagcattatcgtgatttataccaacaacaaccccaatgccagctcgggtctccaaccaaccagtggttagcagaggccattgatgccgctaaggcgagtattgatatggccagaggaagcccgatccctttgctcatcttgcaagcggggaaagataagatagtctgtaatcaggcgcaaaataaagcgcttgcagggctttgccagcggatcattatcgaaggcgctttccatgaagtgtttatcgaaactgataaactcagagataaagcgctaaaggcactgttcgattttattaaccaacactcagagataatttag

SEQ ID NO: 106923 - protein, 329 aa, Shewanella denitrificans OS-217
MVSMIKTAQGYSSELTRDQSELTQFWSQVQQESLAIEPGITLAYGFIRHEDNRRAIVISNGRVESYLKYQELIYDCYQQGFSVYALDHRGQGLSSRLTTNPHQGHVEHFSDYVDDFKVFIERVVKPERHKELFLVGHSMGGAIATHYIHQDPTTFNAAVLSAPMYGIILPLPTVVIKQLATKMINTQPVIGSHLVATNYIIGGRDYQAISFKLNQLTHSQVRYQHYRDLYQQQPQCQLGSPTNQWLAEAIDAAKASIDMARGSPIPLLILQAGKDKIVCNQAQNKALAGLCQRIIIEGAFHEVFIETDKLRDKALKALFDFINQHSEII

SEQ ID NO: 106924 - DNA, 975 bp, Shewanella frigidimarina NCIMB 400
  CDS (1)..(975): transl_table=11
atgcattacatgaaattttcatctgaattaaagctcgatactagtgagcaaagacacttttggcaacaagtacaccaatcgagtttttgtactgatgacggtataaatattgcctatgcgatgatccaacatcctaatagtcaacgagcaatagtgatcagcaatggcagagtagaatcttatataaaatatcaagaattgatgtttgatttatatcaacaaggatttagcgtttacgctttagatcatcgaggacaaggattatcagaccggctcacacataatccgcatcaaggttatgttgctagctttactgattataccgaagacttaactcaatttattaatcagatagttagccaacaacagcatgatgagctatttatcatcgctcactcaatgggatgcaccattgccagcgattatattaatcaacacccaaatacatttactgcagccgtattctcagcgcccatgtttggtattcgattaccgtttacaaaacctatcattcgttggctagcacaaaagctcgataataatcgtctggaagcaaataaagtacacagcacatttgtaatagggggaacccattacaaacccgacagctttaaacgcaaccgactgactcatagccaaaaacgttataagcactatcgcaacatcttcgaagaaaccactaaagcacagttaggctcaccgactaaccattggttactagaggcaatggatgcagcggagaaatgcatcgactacgctaaacacagccaaactccgatactaattttgcaagctgaaaaagacacgattgtctgtaatgaggcgcaaaaccaagcactaagcactcattgtcataaagtgatcattgaaggcgcatatcacgaagtattcatcgagaaagatactatgcgtaatatcgccctgtctcataccattgactttatggcacaacactcaaagatagctgtgtcttaa

SEQ ID NO: 106925 - protein, 324 aa, Shewanella frigidimarina NCIMB 400
MHYMKFSSELKLDTSEQRHFWQQVHQSSFCTDDGINIAYAMIQHPNSQRAIVISNGRVESYIKYQELMFDLYQQGFSVYALDHRGQGLSDRLTHNPHQGYVASFTDYTEDLTQFINQIVSQQQHDELFIIAHSMGCTIASDYINQHPNTFTAAVFSAPMFGIRLPFTKPIIRWLAQKLDNNRLEANKVHSTFVIGGTHYKPDSFKRNRLTHSQKRYKHYRNIFEETTKAQLGSPTNHWLLEAMDAAEKCIDYAKHSQTPILILQAEKDTIVCNEAQNQALSTHCHKVIIEGAYHEVFIEKDTMRNIALSHTIDFMAQHSKIAVS

SEQ ID NO: 106926 - DNA, 963 bp, Burkholderia ambifaria AMMD
  CDS (1)..(963): transl_table=11
atgatccggaacaccgatgccaacgaacaggggacccgccagatgaacgccactaccacgccggccgccggacccgtcaccgcagcacctgagctggcgtcgccgcccgctccgcgcatgggccggctgcgcaccgcggacggactcgaactggcgtcgtaccgctggccggccggcgacggcacggagccgccgcgcgcgacgctcgcgctcgtgcacggcctcgccgagcacgcgggccgttacacggcgctggcggccagactgaacgcagccggcatcgacgtgctggcgatcgatctgcgcgggcacggccagtcgcccggcaaacgtgcgtgggtcgagcgtttcgacggttacctgaacgatgcggatgcactcgttgccgaagccgcctgcggcgatacgccgctcttcctgatgggacacagcatgggcggcgccgtcgctgcgctgtatgcgatcgaacgcgtgccggccagcggccacgcgctggccggtctcgtgctgtcgagccccgcgctcgcgccggggcgcgacgtgccgcgctggatgctcgcgatgagccgcttcatcagccgtgcatggccgagcttccccgcaatcaggatcgatgcggcgctgctgtcgcgcgatccggccgtcgtcgcggccaatcgtgccgatccgctcgtgcaccatggcgcggtgccggcgcgcaccggtgccgaaatcctcgacgcgatggcgcgcatcgagcgcggccgcggtgcgctgcgcgtgccggtgctcgtctatcacggcaccgaggacaagctgaccgagcccgacggaagccgtgcattcggcgcccacgtcggctcgcccgatcgcacgctgacgctatacgaaggcgggttccacgagacgatgaacgatctcgagcgcgatcgcgtgatcgatgcgctgatcgcgtggattcacgcgcgcgtgccggcgcgctga

SEQ ID NO: 106927 - protein, 320 aa, Burkholderia ambifaria AMMD
MIRNTDANEQGTRQMNATTTPAAGPVTAAPELASPPAPRMGRLRTADGLELASYRWPAGDGTEPPRATLALVHGLAEHAGRYTALAARLNAAGIDVLAIDLRGHGQSPGKRAWVERFDGYLNDADALVAEAACGDTPLFLMGHSMGGAVAALYAIERVPASGHALAGLVLSSPALAPGRDVPRWMLAMSRFISRAWPSFPAIRIDAALLSRDPAVVAANRADPLVHHGAVPARTGAEILDAMARIERGRGALRVPVLVYHGTEDKLTEPDGSRAFGAHVGSPDRTLTLYEGGFHETMNDLERDRVIDALIAWIHARVPAR

SEQ ID NO: 106928 - DNA, 957 bp, Arabidopsis thaliana
  CDS (1)..(957)
atgcaggcaagtgaaacagagaacatcaagtatgaagagagtttcatcaagaacactcgaggaatgaaactgttcacgtgcaaatgggtaccagcaaagcaagagccaaaggctttagtctttatttgccatggatatgcaatggaatgtagcatcaccatgaacagtactgcgaggaggctggtgaaagcaggatttgcggtatatggaattgattacgaagggcatggaaaatctgatgggcttagtgcttatgtcccaaactttgaccatctcgttgatgatgtctctactcactacacaagcatttgcgagaaagaagagaataaagggaagatgaggttcttgttaggagaatcaatgggaggagcagtgcttttgttgttacacagaaagaagcctcagttttgggatggggctgtcttggttgctccaatgtgtaagattgctgaagaaatgaaaccaagccctttggtaatttcgatattggccaaacttagtggagtgataccttcgtggaaaatcatccctggccaagatatcattgagactgcttttaagcagccagaaatcaggaaacaggttagggaaaatccctactgctacaagggacgtccacgtttgaagactgcttatgagcttttgagggttagcaccgatctcgagaagaggcttaatgaggtttcattaccgttcatagttttgcacggtgaagacgataaagtcacagataaagcggtgagtcgacaactgtatgaagttgcatctagttcggacaagactttcaagttgtaccctgggatgtggcatggtttactctatggagagacaccagagaatatcgagactgtttttgctgacatcattggctggttggataagaaagttgctgatgaaagtggaggctttgaatccgagcttaaacgtaaaaatgatggtattcctttgaaagggtag

SEQ ID NO: 106929 - protein, 318 aa, Arabidopsis thaliana
MQASETENIKYEESFIKNTRGMKLFTCKWVPAKQEPKALVFICHGYAMECSITMNSTARRLVKAGFAVYGIDYEGHGKSDGLSAYVPNFDHLVDDVSTHYTSICEKEENKGKMRFLLGESMGGAVLLLLHRKKPQFWDGAVLVAPMCKIAEEMKPSPLVISILAKLSGVIPSWKIIPGQDIIETAFKQPEIRKQVRENPYCYKGRPRLKTAYELLRVSTDLEKRLNEVSLPFIVLHGEDDKVTDKAVSRQLYEVASSSDKTFKLYPGMWHGLLYGETPENIETVFADIIGWLDKKVADESGGFESELKRKNDGIPLKG

SEQ ID NO: 106930 - DNA, 936 bp, Leishmania major
  CDS (1)..(936)
atgtcgtactactgctctggcggtcattgcctgaagtacgccaccccaggtcgggaaccacccgacccacagctctttcctcactacatgcaaaatgcacaaaacctgtggttgcacttcagcgagtggtggccgcatggtgacggcggcagctgcccggccccgccaactaaaggcgtcgtttttatcgtgcccggcttgggcgagcacaccggccgctacgactccgtcgcgctccgactcaaccaggagggctacgttgtcttttccatggacaatcaaggcaccggcggcagcgagggcgagcggctatacgttgagtgcttcacgcacttcgtcgatgacgtctgcgcgttcgtcgtattcatccagacacggtacgcggccctcaagagccagccaacctttcttatggggcactcgatggggggactcattgccactctggtggcgcagagggacgcaagcggcttccgcggggtcgtgctgagcggcccagctctcgggctgtcgaagcccgtcccctgctttatgcggtcgcttgcgcactttctctcacagtggttcccgaagctgccggtgcgcaaactcgaccccgatctcgtcagctacaacacccctgtcgtgcaacttgtgaagcaggacccgttttactccaacgtgacgcttcgtgcgcgcttcgtcgatgagatgctgattgcgcaggatcgcgccgcggaagccgcgggaacgtcgcagtttccttttttgattgtccacggcgaggaggatcagctctgctcgttagagacgtctaaaagcttcttcaagagcgctctgtcagaggacaagaatctggtctcctacccccgtgctgggcatgaagtactgacggagctgtgtcgagctgaggtgatggcagaggtgataaagttcatcgacgagcgggcgaggtga

SEQ ID NO: 106931 - protein, 311 aa, Leishmania major
MSYYCSGGHCLKYATPGREPPDPQLFPHYMQNAQNLWLHFSEWWPHGDGGSCPAPPTKGVVFIVPGLGEHTGRYDSVALRLNQEGYVVFSMDNQGTGGSEGERLYVECFTHFVDDVCAFVVFIQTRYAALKSQPTFLMGHSMGGLIATLVAQRDASGFRGVVLSGPALGLSKPVPCFMRSLAHFLSQWFPKLPVRKLDPDLVSYNTPVVQLVKQDPFYSNVTLRARFVDEMLIAQDRAAEAAGTSQFPFLIVHGEEDQLCSLETSKSFFKSALSEDKNLVSYPRAGHEVLTELCRAEVMAEVIKFIDERAR

SEQ ID NO: 106932 - DNA, 1056 bp, Oryza sativa
  CDS (1)..(1056)
atgacaaaggagatggccgatgatgtcgagtaccatgaggagtttgtgacgaatccgagggggttgcggctcttcacatgcggctggcttcctgcttcttcctcccccaaggcgctcatcttcctttgccatggctacggcatggaggtcagtggcttcatgaaagcatgtggggtcgagctggccacggcgggttacggcgtgttcggcatcgattatgaggggcatggcaagtccatgggtgccagatgctacatccagaagttcgagcatcttgtcgatgactgcgacagattcttcaaatcaatatgtgagctggaggagtacagagacaagagccggttcctgtacggggagtcgatgggcggcgcggttgcgctgctgctgcaccgcaaggacccaaccttctgggacggcgccgtcctcgtcgcgccgatgtgcaagatatcggagaaggtgaagccgcatccgttggtggtgacgctcctgacgcaggtggaggagatcatccccaagtggaagatcgtccccaccaaggacgtcatcgactctgccttcaaagaccccatcaagcgcgaaaagatcaggaagaacaagctgatctaccaggacaagcccaggctgaagacggcgctggagctgctgcgaaccagcatcagcgtcgagcaaagcttgtcacaggtgagcatcccgttcttcatcctgcacggcgaggccgacaaggtgacggacccggaggtgagccgtgcgctgtacgagcgcgccgccagcgccgacaagaccatcaagctctacccggggatgtggcacggcctcaccgccggcgagccggaccacaacgtccacctcgtcttctccgacatcgtcgcctggctcgaccgccgcagccaccgccaggacagggcgagcattaccccgccggcggcctgcaccgacagcgccgccgccgctgcggcggacagcccagtgtcgcctgagccgccgcggcaaggcgccgccggcggcttcctctgcggcctaaccggccgagcaaatccccagcaatgtaggatgtaa

SEQ ID NO: 106933 - protein, 351 aa, Oryza sativa
MTKEMADDVEYHEEFVTNPRGLRLFTCGWLPASSSPKALIFLCHGYGMEVSGFMKACGVELATAGYGVFGIDYEGHGKSMGARCYIQKFEHLVDDCDRFFKSICELEEYRDKSRFLYGESMGGAVALLLHRKDPTFWDGAVLVAPMCKISEKVKPHPLVVTLLTQVEEIIPKWKIVPTKDVIDSAFKDPIKREKIRKNKLIYQDKPRLKTALELLRTSISVEQSLSQVSIPFFILHGEADKVTDPEVSRALYERAASADKTIKLYPGMWHGLTAGEPDHNVHLVFSDIVAWLDRRSHRQDRASITPPAACTDSAAAAAADSPVSPEPPRQGAAGGFLCGLTGRANPQQCRM

SEQ ID NO: 106934 - DNA, 777 bp, Western X phytoplasma
  CDS (1)..(777): transl_table=11
atgtttattaataaaaattttttttatattaattttaaaaacgttcctaatccgaaagctaatattattattactcacggattaggcgaaagttcgcaagattatctccctttagctgactttttatgtcaaactggttatgccgttattttatacgatgttagaggacacggaaaaagtggcggttcgagaggtgatgtgaataattttcatgttttggtcgatgatctggcttctattgtgaaggaaattaaaaaaaaatcttctttaaaaatttttttaatcggtcatagtatgggcggaattattactaacgcttatatggtaaaatatggtgaggttaacggttctattattagttctgctcccgctcatgtactgaataataaacatttaaaatgccctttttattggtttaattttaaaccaaggaaacttaattttttatctaataaaatcgctcatgcacctttatataagggttatttcccttatcatttagaatatgttactccgcgtttaatgagaaatttattagttttaagtcctcaatatttacaaaaaagattatctttttatgttggttctgttttgtttttatacagtgtccaagataaaattatttcttttaaaaatggttcttttttatttgaaaaagtaccttctaaagataaaaaattaattctatatcaagtgtcttatcataatttatttcacgatatagaagcaaccaaagcgtttgaagatacggttttatggctagatcaaaggtattga

SEQ ID NO: 106935 - protein, 258 aa, Western X phytoplasma
MFINKNFFYINFKNVPNPKANIIITHGLGESSQDYLPLADFLCQTGYAVILYDVRGHGKSGGSRGDVNNFHVLVDDLASIVKEIKKKSSLKIFLIGHSMGGIITNAYMVKYGEVNGSIISSAPAHVLNNKHLKCPFYWFNFKPRKLNFLSNKIAHAPLYKGYFPYHLEYVTPRLMRNLLVLSPQYLQKRLSFYVGSVLFLYSVQDKIISFKNGSFLFEKVPSKDKKLILYQVSYHNLFHDIEATKAFEDTVLWLDQRY

SEQ ID NO: 106936 - DNA, 912 bp, Homo sapiens
  CDS (1)..(912)
atgccagaggaaagttcccccaggcggaccccgcagagcattccctaccaggacctccctcacctggtcaatgcagacggacagtacctcttctgcaggtactggaaacccacaggcacacccaaggccctcatctttgtgtcccatggagccggagagcacagtggccgctatgaagagctggctcggatgctgatggggctggacctgctggtgttcgcccacgaccatgttggccacggacagagcgaaggggagaggatggtagtgtctgacttccacgttttcgtcagggatgtgttgcagcatgtggattccatgcagaaagactaccctgggcttcctgtcttccttctgggccactccatgggaggcgccatcgccatcctcacggccgcagagaggccgggccacttcgccggcatggtactcatttcgcctctggttcttgccaatcctgaatctgcaacaactttcaaggtccttgctgcgaaagtgctcaaccttgtgctgccaaacttgtccctcgggcccatcgactccagcgtgctctctcggaataagacagaggtcgacatttataactcagaccccctgatctgccgggcagggctgaaggtgtgcttcggcatccaactgctgaatgccgtctcacgggtggagcgcgccctccccaagctgactgtgcccttcctgctgctccagggctctgccgatcgcctatgtgacagcaaaggggcctacctgctcatggagttagccaagagccaggacaagactctcaagatttatgaaggtgcctaccatgttctccacaaggagcttcctgaagtcaccaactccgtcttccatgaaataaacatgtgggtctctcaaaggacagccacggcaggaactgcgtccccaccctga

SEQ ID NO: 106937 - protein, 303 aa, Homo sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 106938 - DNA, 24 bp, Artificial sequence
  primer
atgtttcagcagcaaaaagactgg

SEQ ID NO: 106939 - DNA, 24 bp, Artificial sequence
  primer
ttaaacctctgtagagcggtttcc

SEQ ID NO: 106940 - protein, 321 aa, Artificial sequence
  Variant (2)..(12): xaa in position 2 to 12 is any amino acid
  Variant (13)..(25): xaa in position 13 to 25 is any or no amino acid
  Variant (27)..(27): xaa in position 27 is any amino acid
  Variant (29)..(30): xaa in position 29 to 30 is any amino acid
  Variant (32)..(33): xaa in position 32 to 33 is any amino acid
  Variant (35)..(37): xaa in position 35 to 37 is any amino acid
  Variant (40)..(49): xaa in position 40 to 49 is any amino acid
  Variant (50)..(53): xaa in position 50 to 53 is any or no amino acid
  Variant (55)..(56): xaa in position 55 to 56 is any amino acid
  Variant (58)..(60): xaa in position 58 to 60 is any amino acid
  Variant (62)..(63): xaa in position 62 to 63 is any amino acid
  Variant (65)..(65): xaa in position 65 is any amino acid
  Variant (67)..(67): xaa in position 67 is any amino acid
  Variant (69)..(72): xaa in position 69 to 72 is any amino acid
  Variant (73)..(79): xaa in position 73 to 79 is any or no amino acid
  Variant (81)..(81): xaa in position 81 is any amino acid
  Variant (83)..(84): xaa in position 83 to 84 is any amino acid
  Variant (86)..(87): xaa in position 86 to 87 is any amino acid
  Variant (89)..(90): xaa in position 89 to 90 is any amino acid
  Variant (92)..(106): xaa in position 92 to 106 is any amino acid
  Variant (107)..(116): xaa in position 107 to 116 is any or no amino acid
  Variant (125)..(125): xaa in position 125 is any amino acid
  Variant (127)..(140): xaa in position 127 to 140 is any amino acid
  Variant (141)..(145): xaa in position 141 to 145 is any or no amino acid
  Variant (148)..(148): xaa in position 148 is any amino acid
  Variant (151)..(191): xaa in position 151 to 191 is any amino acid
  Variant (192)..(222): xaa in position 192 to 222 is any or no amino acid
  Variant (224)..(251): xaa in position 224 to 251 is any amino acid
  Variant (252)..(254): xaa in position 252 to 254 is any or no amino acid
  Variant (256)..(256): xaa in position 256 is any amino acid
  Variant (259)..(260): xaa in position 259 to 260 is any amino acid
  Variant (262)..(263): xaa in position 262 to 263 is any amino acid
  Variant (265)..(265): xaa in position 265 is any amino acid
  Variant (267)..(289): xaa in position 267 to 289 is any amino acid
  Variant (290)..(299): xaa in position 290 to 299 is any or no amino acid
  Variant (303)..(304): xaa in position 303 to 304 is any amino acid
  Variant (306)..(317): xaa in position 306 to 317 is any amino acid
  Variant (318)..(320): xaa in position 318 to 320 is any or no amino acid
LXXXXXXXXXXXXXXXXXXXXXXXXVXLXXGXXEXXXKYXXXXXXXXXXXXXXGXXVXXXDXXGXGXSXXXXXXXXXXXGXVXXFXXYXXDXXXXXXXXXXXXXXXXXXXXXXXXXLLGHSMGGXIXXXXXXXXXXXXXXXXXXXVLXAPXXXXXXXXXXXXXXXXXXXXXXXXXXXXXXXXXXXXXXXXXXXXXXXXXXXXXXXXXXXXXXXXXXXXXXXXLXXXXXXXXXXXXXXXXXXXXXXXXXXXXXXXPXLIXXAXXDXIXXXXXXXXXXXXXXXXXXXXXXXXXXXXXXXXXHEIXXEXXXXXXXXXXXXXXXF

SEQ ID NO: 106941 - protein, 36 aa, Artificial sequence
  Variant (2)..(3): xaa in position 2 to 3 is any amino acid
  Variant (4)..(4): xaa in position 4 is any or no amino acid
  Variant (6)..(16): xaa in position 6 to 16 is any amino acid
  Variant (17)..(17): xaa in position 17 is Phe or Leu
  Variant (18)..(20): xaa in position 18 to 20 is any amino acid
  Variant (21)..(21): xaa in position 21 is Asp or Gly
  Variant (22)..(27): xaa in position 22 to 27 is any amino acid
  Variant (28)..(28): xaa in position 28 is Asp or Glu
  Variant (29)..(30): xaa in position 29 to 30 is any amino acid
  Variant (32)..(32): xaa in position 32 is any amino acid
  Variant (33)..(33): xaa in position 33 is any or no amino acid
  Variant (35)..(35): xaa in position 35 is any amino acid
  Variant (36)..(36): xaa in position 36 is Ala, Glu or Ser
GXXXEXXXXXXXXXXXXXXXXXXXXXXXXXGXXGXX

SEQ ID NO: 106942 - protein, 7 aa, Artificial sequence
  Variant (3)..(3): xaa in position 3 is Leu or Met
  Variant (5)..(5): xaa in position 5 is Ala or Gly
  Variant (6)..(6): xaa in position 6 is any amino acid
  Variant (7)..(7): xaa in position 7 is Ile, Leu or Val
HSXGXXX

SEQ ID NO: 106943 - protein, 6 aa, Artificial sequence
  Variant (3)..(3): xaa in position 3 is any amino acid
  Variant (4)..(4): xaa in position 4 is Phe, Leu or Met
  Variant (5)..(5): xaa in position 5 is any amino acid
  Variant (6)..(6): xaa in position 6 is Asp or Glu
HEXXXX

SEQ ID NO: 106944 - DNA, 747 bp, Escherichia coli
  CDS (1)..(747)
atggctgattgggtaacaggcaaagtcactaaagtgcagaactggaccgacgccctgtttagtctcaccgttcacgcccccgtgcttccgtttaccgccgggcaatttaccaagcttggccttgaaatcgacggcgaacgcgtccagcgcgcctactcctatgtaaactcgcccgataatcccgatctggagttttacctggtcaccgtccccgatggcaaattaagcccacgactggcggcactgaaaccaggcgatgaagtgcaggtggttagcgaagcggcaggattctttgtgctcgatgaagtgccgcactgcgaaacgctatggatgctggcaaccggtacagcgattggcccttatttatcgattctgcaactaggtaaagatttagatcgcttcaaaaatctggtcctggtgcacgccgcacgttatgccgccgacttaagctatttgccactgatgcaggaactggaaaaacgctacgaaggaaaactgcgcattcagacggtggtcagtcgggaaacggcagcggggtcgctcaccggacggataccggcattaattgaaagtggggaactggaaagcacgattggcctgccgatgaataaagaaaccagccatgtgatgctgtgcggcaatccacagatggtgcgcgatacacaacagttgctgaaagagacccggcagatgacgaaacatttacgtcgccgaccgggccatatgacagcggagcattactggtaa

SEQ ID NO: 106945 - protein, 248 aa, Escherichia coli
MADWVTGKVTKVQNWTDALFSLTVHAPVLPFTAGQFTKLGLEIDGERVQRAYSYVNSPDNPDLEFYLVTVPDGKLSPRLAALKPGDEVQVVSEAAGFFVLDEVPHCETLWMLATGTAIGPYLSILQLGKDLDRFKNLVLVHAARYAADLSYLPLMQELEKRYEGKLRIQTVVSRETAAGSLTGRIPALIESGELESTIGLPMNKETSHVMLCGNPQMVRDTQQLLKETRQMTKHLRRRPGHMTAEHYW

SEQ ID NO: 106946 - DNA, 828 bp, Mesorhizobium loti MAFF303099
  CDS (1)..(828): transl_table=11
atgaacaccacatccgccttcaacaccgccggcgcccgcccgctgcagtttcctataccggccaatgtctatgccgaaaccgtcgtctcggtgaagcactacaccgaccggctgttctctttccgcatcacccgtccgcagtcgctgcgcttccgctccggcgaattcgtcatgatcggcctgcccaatgccgagaagccggtgttccgtgcctattcggtcgcaagcccggcctgggacgaagagctggaattcttctcgatcaaggtgccggacggcccgctgacctcggaactgcagaagatccaggtcggcgacaccgtcatcatgcgccagaagtcgaccgggaccctggtggtcgacgcgctgaccccggccaagcggctgttcatgatctcgaccggcaccggcatcgcgcccttcgccagcctgctgcgcgaccccgacacctatgagaaattcgaccagctgatcctgacccatacctgccgcgacaatgccgagctgacctacggccaggaattggtggcggcgctggaaagcgacccgctgatcggcgaactgaccaccgggcgcgtcacgctctacaattcgacgacccgcgaagaatcggcccgcatgggccgcatcaccgcgctgatcggttcaggcaagttctacgccgaccttggcatcgacaagctcaatccggaaacggaccgcatcatgatctgcggctcgatgcatatgctcaaggatgtcaaggaactcgccgaaagcctcggcttccaggaaggctcgctcagccatcccgcgaccttcgtcgtcgagcgcgccttcgtcggctga

SEQ ID NO: 106947 - protein, 275 aa, Mesorhizobium loti MAFF303099
MNTTSAFNTAGARPLQFPIPANVYAETVVSVKHYTDRLFSFRITRPQSLRFRSGEFVMIGLPNAEKPVFRAYSVASPAWDEELEFFSIKVPDGPLTSELQKIQVGDTVIMRQKSTGTLVVDALTPAKRLFMISTGTGIAPFASLLRDPDTYEKFDQLILTHTCRDNAELTYGQELVAALESDPLIGELTTGRVTLYNSTTREESARMGRITALIGSGKFYADLGIDKLNPETDRIMICGSMHMLKDVKELAESLGFQEGSLSHPATFVVERAFVG

SEQ ID NO: 106948 - DNA, 777 bp, Pseudomonas aeruginosa PAO1
  CDS (1)..(777): transl_table=11
atgagcaatctgtacaccgagcgcgttctcagcgtgcaccactggaacgacaccctgttcagcttcaagaccacccgcaacccgggtctgcgcttcaagaccggccagttcgtgatgatcggcctggaagtcgacggtcgcccgctgatgcgcgcctacagcattgccagcccgaactacgaagagcacctggagttcttcagcatcaaggtcccggacggcccgctgacctcgcgcctgcagcacctgaaggaaggcgacgagctgatggtcagccgcaagccgaccggcaccctggtgcacgacgacctgctgcccggcaagcacctctacctgctcagcaccggcaccggcatggcgcccttcctcagcgtgatccaggacccggaaacctacgagcgctacgagaaggtgatcctggtccacggcgtgcgctgggtcagcgaactggcctacgccgacttcatcaccaaggtcctgccggaacacgagtacttcggcgaccaggtgaaagagaagctgatctactacccgctggtgacccgcgagccgttccgcaaccagggccgccagaccgacctgatgcgcagcggcaagctgttcgaggacatcggcctgccgccgatgaatccgcaggacgaccgtgcgatgatctgcggcagcccgagcatgctggaagagaccagcgccgtgctcgacagcttcggcctgaagatctcgccgcgcatgggcgagccgggcgactacctgatcgagcgcgccttcgtcgagaagtag

SEQ ID NO: 106949 - protein, 258 aa, Pseudomonas aeruginosa PAO1
MSNLYTERVLSVHHWNDTLFSFKTTRNPGLRFKTGQFVMIGLEVDGRPLMRAYSIASPNYEEHLEFFSIKVPDGPLTSRLQHLKEGDELMVSRKPTGTLVHDDLLPGKHLYLLSTGTGMAPFLSVIQDPETYERYEKVILVHGVRWVSELAYADFITKVLPEHEYFGDQVKEKLIYYPLVTREPFRNQGRQTDLMRSGKLFEDIGLPPMNPQDDRAMICGSPSMLEETSAVLDSFGLKISPRMGEPGDYLIERAFVEK

SEQ ID NO: 106950 - DNA, 777 bp, Pseudomonas aeruginosa PAO1
  CDS (1)..(777): transl_table=11
atgaccgccagcgaagagaaattcacccgccagacgctgctcgacgtgcagcctctgactcccaacctgttcaccctgcgtaccagccgcgacgcgggattccggttccgcgccgggcaattcgcccggctcggcgtgtacaagcccagcggcagcatcgtctggcgcgcctactcgatggtttcggcgcctcatgacgaattcctcgacttcttttccatcgtcgtcccggacggcgagttcaccagcgaactcagccgcctgcgcgagggcgaccagttgctggtcgatcgccaggccttcggcttcctcaccctcgaccgcttcgtggatggtcgtgacctttggctgctggccaccggtaccggtgtggcgccgttcgtctcgatcctgcaggacttcgaggtctgggagcgcttcgaaagcatcaagctggtctacagcgtgcgcgagagcaaggagctggcctaccgcgagctgatcgccggcctcgccgagcgcgaatacctggccgagcatgcccacaagctgcagttcatcccggtggtgacccgcgagcaggtacccggttgcctgaacggacgtatcaccacgttgatcgagaacggcgatctggagcgtgccgccgacctggaactgaccccggagcattcgcgggtgatgctctgcggcaacccgcagatgatcgaggacacccgcgccgtgctgaaggctcgcggcatgaacctcagtctgacccggcgcccggggcaggtggcggtggagaactactggtag

SEQ ID NO: 106951 - protein, 258 aa, Pseudomonas aeruginosa PAO1
MTASEEKFTRQTLLDVQPLTPNLFTLRTSRDAGFRFRAGQFARLGVYKPSGSIVWRAYSMVSAPHDEFLDFFSIVVPDGEFTSELSRLREGDQLLVDRQAFGFLTLDRFVDGRDLWLLATGTGVAPFVSILQDFEVWERFESIKLVYSVRESKELAYRELIAGLAEREYLAEHAHKLQFIPVVTREQVPGCLNGRITTLIENGDLERAADLELTPEHSRVMLCGNPQMIEDTRAVLKARGMNLSLTRRPGQVAVENYW

SEQ ID NO: 106952 - DNA, 777 bp, Neisseria meningitidis MC58
  CDS (1)..(777): transl_table=11
atggcagcattcaatacccaaaaagtattgtccgtacaccactggacagacgcatattttacctttacctgcacccgcgacgaatcgttgcgctttgaaaacggacagttcgttatggtcggattgatggtggacggcaagccgctgatgcgtgcatacagcgtcgcctccgccaactgggaagaacacctcgaatttttcagcattaaagtccaagacggcccgctgaccagccgcctgcaacacctcaaagtcggcgacgacgtgttaatcagcaaaaaaccgaccggaaccctggttgccggcgacctgaatccgggcaaacacctttacttgttgagcaccggtaccggcatcgctcctttcttgagcatcaccaaagaccccgaaatttacgagcaatttgaaaaaatcatcctcgtacacggcgtgcgctacaaaaaagatttggcgtactacgaccgctttaccaaagaattgcccgaacacgaatacctcggtgacttggttaaagaaaaactgatttactacccgattgtttcgcgcgaagaattcgaacaccacggtcgcctaaccgacctgatggtgagcggcaaactgtttgaagacatcggcctgcccaaaatcaacccgcaagacgaccgcgccatgctgtgcggcagccccgcgatgctgaaagatacctgcaaagttttggacgatttcggactgaccgtctctccgaaaacaggcgtacgcggcgattacctgattgagcgtgcgtttgtagatcaataa

SEQ ID NO: 106953 - protein, 258 aa, Neisseria meningitidis MC58
MAAFNTQKVLSVHHWTDAYFTFTCTRDESLRFENGQFVMVGLMVDGKPLMRAYSVASANWEEHLEFFSIKVQDGPLTSRLQHLKVGDDVLISKKPTGTLVAGDLNPGKHLYLLSTGTGIAPFLSITKDPEIYEQFEKIILVHGVRYKKDLAYYDRFTKELPEHEYLGDLVKEKLIYYPIVSREEFEHHGRLTDLMVSGKLFEDIGLPKINPQDDRAMLCGSPAMLKDTCKVLDDFGLTVSPKTGVRGDYLIERAFVDQ

SEQ ID NO: 106954 - DNA, 780 bp, Neisseria meningitidis MC58
  CDS (1)..(780): transl_table=11
atggcagcctcgcccgaagcaaaattcaccgaagaaaagattttgtgggtcaaacaccacacgccgaaactcatcactttcgccatcagccgtcccgaatcctaccgctttaaagccggacagttctcccgactcggtttctacgaaggggaaggtttcatttggcgtgcctattccattgtttccgcagaatatgccgacacgctcgaatattttgccgtactcatccaagacggccccatgtcggcccgtttcgccaaaatgcaacagggcaacaccatcctgctcgataaaaatgccaccggcttcctcctgcccgaacgcttccccgacggcaaggatttggtgatgctctgcaccggctcgggcatcgcccccttcctttccattctcgaacaacccgaaatccgtcaacgtttcgataccgtcaacctgatacattccgtatcttttcccgaagaattgattttcaacgaccgactcgccgcattgactgaacatcccctggtaggcgaatacggacactctttccgtttcgtccctgttaccacccgtgccgccaacccctcgggcttaagcggaaaacgcattccggaactcttaaaaaacaacagcatcgaacaggcgctgcataccaagttcaccccggaatccacacggtttatgatttgcggcaacccggaaatggtcaaagacactttccaaacgctgctcgacatgggttacgccatgcaccgcaaccgcattcccggtcaaatcatgatggaaaacggcttctaa

SEQ ID NO: 106955 - protein, 259 aa, Neisseria meningitidis MC58
MAASPEAKFTEEKILWVKHHTPKLITFAISRPESYRFKAGQFSRLGFYEGEGFIWRAYSIVSAEYADTLEYFAVLIQDGPMSARFAKMQQGNTILLDKNATGFLLPERFPDGKDLVMLCTGSGIAPFLSILEQPEIRQRFDTVNLIHSVSFPEELIFNDRLAALTEHPLVGEYGHSFRFVPVTTRAANPSGLSGKRIPELLKNNSIEQALHTKFTPESTRFMICGNPEMVKDTFQTLLDMGYAMHRNRIPGQIMMENGF

SEQ ID NO: 106956 - DNA, 780 bp, Neisseria meningitidis Z2491
  CDS (1)..(780): transl_table=11
atggcagcctcgcccgaagcaaaattcactgaagaaaagattttgtgggtcaaacaccacacgccgaaactcatcactttcgccatcagccgtcccgaatcctaccgttttaaagccggacagttctcccgactcggtttctacgaaggggaaggctttatttggcgtgcctactccatcgtttccgcagaatatgcagacacgctcgaatattttgccgtactcatccaagacggccccatgtcggcccgtttcgccaaaatgcaacagggcgacaccatcctgctcgataaaaatgccaccggcttcctcctgcccgaacgcttccccgacggcaaggatttggtgatgctctgcaccggctccggcatcgcccccttcctttccattctcgaacaacctgaaatccgacagcgtttcgataccgtcaacctgatacattccgtatcttttcccgaagaattgattttcaacgaccggctcgccgcattgtccgaacatcccctggtaggcgaatacagacactcgttccatttcgtccctgttaccacccgtgccgccaacccctcgggcttaagcggaaaacgcattccggaactcttaaaaaacagcagcatcgaacaggcgctgcataccaagttcaccccggaatccacacggtttatgatttgcggcaacccggaaatggtcaaagatactttccaaacgctgcttgacatgggttacgccatgcaccgcaaccgcattcccggtcaaatcatgatggaaaacggcttctaa

SEQ ID NO: 106957 - protein, 259 aa, Neisseria meningitidis Z2491
MAASPEAKFTEEKILWVKHHTPKLITFAISRPESYRFKAGQFSRLGFYEGEGFIWRAYSIVSAEYADTLEYFAVLIQDGPMSARFAKMQQGDTILLDKNATGFLLPERFPDGKDLVMLCTGSGIAPFLSILEQPEIRQRFDTVNLIHSVSFPEELIFNDRLAALSEHPLVGEYRHSFHFVPVTTRAANPSGLSGKRIPELLKNSSIEQALHTKFTPESTRFMICGNPEMVKDTFQTLLDMGYAMHRNRIPGQIMMENGF

SEQ ID NO: 106958 - DNA, 780 bp, Xylella fastidiosa 9a5c
  CDS (1)..(780): transl_table=11
atgtctcccgccttcggtaccgaaacggtgatccatgtccatcactggaccgatgcctacttcagtttcattactacccgtgactctgggtttcgcttcgagaacggccagtttgtgatgattggtttggaaacagaagcacgaccgcttttacgtgcttactccattgccagcgccaactgggaggagcaactggaatttttaagcattaaggtacaaaacggcctgctgacctcacggctacaacacatcaaacctggagacaaaattctggttggtaaaaagcccaccggcacactattgattcacgatttacatccgggacgtcatctgtatttactggggactggtactgggcttgcaccctggctgtcaatcatcaaggacccagaaacctatgagcgatttgacaaagtcatcctgactcatggtgtgcgctacagtaaggatcttgcttaccgtgactacttcgaaaaggaactaccgcagcatgaattgcttggcgagacgattcgcaagaagcttctctattaccctgcggtaactcgtgaggacttccctaaccgtggccgcttaacccacctaattgaaagtggcgcgatgcaaaacacgcttggtttaccaatcattgatcaggccaacgaccgtttcatgctatgtggaaacccgcaaatgctgactgatctacgcaccttattgaacgcacgtagcttcaatgcctcagcacgtataggtagccccggcgattacgtatttgaacgtgctttcgttgatcaatga

SEQ ID NO: 106959 - protein, 259 aa, Xylella fastidiosa 9a5c
MSPAFGTETVIHVHHWTDAYFSFITTRDSGFRFENGQFVMIGLETEARPLLRAYSIASANWEEQLEFLSIKVQNGLLTSRLQHIKPGDKILVGKKPTGTLLIHDLHPGRHLYLLGTGTGLAPWLSIIKDPETYERFDKVILTHGVRYSKDLAYRDYFEKELPQHELLGETIRKKLLYYPAVTREDFPNRGRLTHLIESGAMQNTLGLPIIDQANDRFMLCGNPQMLTDLRTLLNARSFNASARIGSPGDYVFERAFVDQ

SEQ ID NO: 106960 - DNA, 813 bp, Sinorhizobium meliloti 1021
  CDS (1)..(813): transl_table=11
atgaatgctccggcaaaaaaagaagatttcgcggtacaggctccggcaggcgtcttcgctgaaacggtgacgagcgtcgaacactacaccgaccggctcttccgcttccgcatgacacgcccgcaggagttccgcttccgctcgggcgaatttgcgatgatcggactgatggtcggcgacaagcccgtttatcgtgcctattcgatcgcgagcccggcctgggacgaggaactggaattcttctccatcaaagtgcccgatgggccgctgacgtcgcatctgcaggggatcaagcccggtgaccaggtgctgatgcgcaagaagccgaccggcacgctggtgttggatgcgctcgtgcccggccgcaggctctatatgttctcgacgggcacgggcatcgcgccctttgcgagcctcatccgcgacccggagaccttcgagaagttcgaggaggtcatccttacccatacctgccgcgacgtggcggagctgaaatatggcttcgatctcgtcgatgaaatccgcaatcacgagttcctgaacgagatcgtcggcgacaagcttcggcactacgccacggttacgcgcgaagaatatcccttcaagggccggatcaccgacctgatgaccaacggcaagttcttcgcagacctcggcctgccgccgctcgatcccgagatcgaccgcggaatgatctgcggttccaccgccatgctgaaggataccaaggaaatcctcgaagccgccggcctgacggaaggcgccaacaacaagccggcagagttcgtcatcgaacgtgcattcgtcggctga

SEQ ID NO: 106961 - protein, 270 aa, Sinorhizobium meliloti 1021
MNAPAKKEDFAVQAPAGVFAETVTSVEHYTDRLFRFRMTRPQEFRFRSGEFAMIGLMVGDKPVYRAYSIASPAWDEELEFFSIKVPDGPLTSHLQGIKPGDQVLMRKKPTGTLVLDALVPGRRLYMFSTGTGIAPFASLIRDPETFEKFEEVILTHTCRDVAELKYGFDLVDEIRNHEFLNEIVGDKLRHYATVTREEYPFKGRITDLMTNGKFFADLGLPPLDPEIDRGMICGSTAMLKDTKEILEAAGLTEGANNKPAEFVIERAFVG

SEQ ID NO: 106962 - DNA, 798 bp, Caulobacter crescentus CB15
  CDS (1)..(798): transl_table=11
gtgaaggaagccccgtacttcgtcgagaaggtgctgtgggtgaaacactggaccgaccgcctgttcagcttcgccatcacgcgaccggccagcttccgcttccggtcgggcgagttcgtgatgatcggcctgccgccgcgcgaagagctcggcgagaagaagccgatcctgcgcgcctattcgatcggctcgccctcgttcgccgaagagctggagttcttctcgatcaaggttccggacggcccgctgacgtcgcgcctgcaactgatccaggagggcgatgagatccttctgggcaagaagccgacgggcaccctggtgctggacgccgttcgccccggcaagcgtctgttcctgttcggcaccggcacgggtctggccccctggctgtcggtggcgcgcgatccggacgcctatagccgcttcgagcgcgtgatcgtcgcgcacggcgtacgcgaggtgaaggagctggcctatcgcgatctcttcacccaggagatcttcgacgatccgctggtgggcgacgaggcgcgcgcccagctgacctactatccgaccgtgacgcgtgaagcgttcgagcgccagggccgcttcaccgatctgatcaccagcggcaagctgttccaggacctcgggattgaaggcgacaggttcgatcccgagaacgaccgcgccatgctgtgcggctcgatggcgatgatcaaggacaccgccgccctgctcgaagcccaggggctcaaggaaggctccaacgccgaaccgggcgacttcgtgatcgagcgggctttcgtcggctaa

SEQ ID NO: 106963 - protein, 265 aa, Caulobacter crescentus CB15
MKEAPYFVEKVLWVKHWTDRLFSFAITRPASFRFRSGEFVMIGLPPREELGEKKPILRAYSIGSPSFAEELEFFSIKVPDGPLTSRLQLIQEGDEILLGKKPTGTLVLDAVRPGKRLFLFGTGTGLAPWLSVARDPDAYSRFERVIVAHGVREVKELAYRDLFTQEIFDDPLVGDEARAQLTYYPTVTREAFERQGRFTDLITSGKLFQDLGIEGDRFDPENDRAMLCGSMAMIKDTAALLEAQGLKEGSNAEPGDFVIERAFVG

SEQ ID NO: 106964 - DNA, 777 bp, Ralstonia solanacearum GMI1000
  CDS (1)..(777): transl_table=11
atgtccgctttcaatcaagagaccgttctgagcgtccatcactggaacgaatcgctgttcagcttccgtaccacgcgcgacaaagccttgcgcttccataacggccactttgtcatgctgggcctggaagtcgagggcaagccgctgatgcgtgcctacagtatcgccagccccaactacgaagaacacctggagttcttcagcatcaaggtgcagaacggcccgctgacgtcgcgcctgcagcacctgaaggtcggtgacaccgtgctggtcagccgcaagccggtcggcacgctggtgctggacgacctgctgcccggcaagaacctctacctgttcggcaccggcaccggcctggcgccgttcatgagcatcatccaggatcccgaaacctacgagcgcttcgagaaggtcgtgctgctgcacggcgtgcgccaggtcagcgaactggcctatgccgatttcatcaccagcgagctgccgaacaacgaattcttcggcgaccaggttcgcgagaagctgatctactacccgaccgtcactcgcgagcccttccgcaacatgggccgcctgacggatctggccgatagcggcaagctgttcgacgacattggccttgcgccgctggacccggcggtggatcgcgccatgatctgcggcagccccgccatgctggaagacacctgcaagctgctggatgcgcgcggcttcaagatttcgtcgcgcatgggcgaggcaggcgactatgtgatcgagcgcgccttcgtcgagaagtaa

SEQ ID NO: 106965 - protein, 258 aa, Ralstonia solanacearum GMI1000
MSAFNQETVLSVHHWNESLFSFRTTRDKALRFHNGHFVMLGLEVEGKPLMRAYSIASPNYEEHLEFFSIKVQNGPLTSRLQHLKVGDTVLVSRKPVGTLVLDDLLPGKNLYLFGTGTGLAPFMSIIQDPETYERFEKVVLLHGVRQVSELAYADFITSELPNNEFFGDQVREKLIYYPTVTREPFRNMGRLTDLADSGKLFDDIGLAPLDPAVDRAMICGSPAMLEDTCKLLDARGFKISSRMGEAGDYVIERAFVEK

SEQ ID NO: 106966 - DNA, 813 bp, Agrobacterium tumefaciens str. C58
  CDS (1)..(813): transl_table=11
atgaacgcgccagccaagacggaagatttcgcgatcaagatacctgatggtgtttacgccgagacggttttgtcggtggagcactatacggatcacctgttccgtttccgcatgacgcgtccagccggcttccgtttccgttccggcgagttcgccatgatcggcctgatggtcggtgaaaagccgatctatcgcgcttattccatcgccagcccggcctgggacgaggaactggaattcttctcgatcaaggttcctgatggcccgctgacctcgcgtcttcaggcaatcaagcccggcgataccgtgctgatgcgcaagaagccgacaggcacgctggttctggatgccctgacacccggcaggcggctctacatgttctcgaccggcacaggcattgcgcctttcgcaagcctgatccgcgaccccgagacttatgagaagttcgaagaggtcatcctcacccacacctgccgtgacgtcgccgagctgaaatacggtttcgatctggttgaggaaatccgcaatcacgaatttctgaacgagatcgtcggcgacaagctcaagcattatgcgactgtcacccgcgaggattaccccttcaagggccgcatcaccacgctgatcgaaaacggcaagctgtttgccgatctcggtgtgccggcactcgatcccgctatcgatcgcggcatgatctgcggttcctcggcaatgttgaaggacaccaaggagttgcttgaaaaggccggccttaatgaaggcgccaacaacaagcccgccgaattcgtgatcgaacgcgctttcgtcggctga

SEQ ID NO: 106967 - protein, 270 aa, Agrobacterium tumefaciens str. C58
MNAPAKTEDFAIKIPDGVYAETVLSVEHYTDHLFRFRMTRPAGFRFRSGEFAMIGLMVGEKPIYRAYSIASPAWDEELEFFSIKVPDGPLTSRLQAIKPGDTVLMRKKPTGTLVLDALTPGRRLYMFSTGTGIAPFASLIRDPETYEKFEEVILTHTCRDVAELKYGFDLVEEIRNHEFLNEIVGDKLKHYATVTREDYPFKGRITTLIENGKLFADLGVPALDPAIDRGMICGSSAMLKDTKELLEKAGLNEGANNKPAEFVIERAFVG

SEQ ID NO: 106968 - DNA, 780 bp, Xanthomonas axonopodis pv. citri str. 306
  CDS (1)..(780): transl_table=11
atgtcttccgcttttggcgccgaaacggtgcttgaggtccgtcattggaccgatgcctacttcagtttcaccacgacccgcgatgccggcttccgtttcgaaaacgggcagttcgtgatgatcgggctggaaaccgaaacgcgtccgttgctgcgtgcgtattcgatcgccagcgccaattgggaagaacatctggagttcttcagcatcaaggtgccggacggcccgctgacctcgcggctgcagcacatccagcccggcgacaaggtgctggtcggcaagaaacccaccggcacgctgctgatcagtgatctgcaccccgggcgcaacctgtatctgttgggcaccggtaccggtctggcgccgtggctgtcgatcatcaaggacccggaaacctacgagcgtttcgacaaggtgatcctcacccagggcgtgcggttcgtgcaggatctggcctaccgcgattacttcgaacgcgaattgccgcagcacgaatttctcggcgacctgctgcgcgaaaaattgctgtactacccggccgtcacgcgcgaaaccttcgccaaccaaggccgtttgaccgagctgatggccgatggacgcatgcagcagacgctcgggttgccgacactggatccggccaacgaccgtttcatgatctgtggcagcccgcagatgctggccgacctgcgcagcctgctggatagccgcggtttccagacctcgccgcgcatcggcacgccggggcattacgtgttcgagcgcgcattcgtcgaaaagtga

SEQ ID NO: 106969 - protein, 259 aa, Xanthomonas axonopodis pv. citri str. 306
MSSAFGAETVLEVRHWTDAYFSFTTTRDAGFRFENGQFVMIGLETETRPLLRAYSIASANWEEHLEFFSIKVPDGPLTSRLQHIQPGDKVLVGKKPTGTLLISDLHPGRNLYLLGTGTGLAPWLSIIKDPETYERFDKVILTQGVRFVQDLAYRDYFERELPQHEFLGDLLREKLLYYPAVTRETFANQGRLTELMADGRMQQTLGLPTLDPANDRFMICGSPQMLADLRSLLDSRGFQTSPRIGTPGHYVFERAFVEK

SEQ ID NO: 106970 - DNA, 750 bp, Shewanella oneidensis MR-1
  CDS (1)..(750): transl_table=11
atgtggacgaggggacgagttatcgaacgtattgattggaatgataaattattttcgctgcggatagcggctgagttagcttcctttattcccggtcaatttattaaactcagtcagttgcaaggggataagcgtgttgccagagcttattccctcgtaaactcccccgataagccctatgccgagattctggctgtcgccgtagaggatggccagttatccccacaattacaacatcttgccatcggtgatgaaattgacatcacccctactgccacggggtttatgactttagatgagatccctaaaggtgagttgcaaggtcggcatttgtggtttttagccacgggcaccgccgtgggacctttcttatccatgctggataccgcagagccttggcagcgttttgagaagatcgtacttgtctatggtgtgcgcgaagctaaagacttggcctatctggataaattaaagggttatgcggcgcaatatccaaatcagtttatcctgtgtttggctgtcacccgtgaaaagcttgatggcgcattgcaatgccgtatccccgatggcctagtctcgggtgaaatcgagcgaaaagtcggattaaccttaagtgcggcagattcccaggtgatgatttgcggtaatccagggatgattagcggcgcccaagcggcattgcttgataagggactctcgaaaaatttacgccgtgctccggggcaaattaccgtagaaaaatattggtag

SEQ ID NO: 106971 - protein, 249 aa, Shewanella oneidensis MR-1
MWTRGRVIERIDWNDKLFSLRIAAELASFIPGQFIKLSQLQGDKRVARAYSLVNSPDKPYAEILAVAVEDGQLSPQLQHLAIGDEIDITPTATGFMTLDEIPKGELQGRHLWFLATGTAVGPFLSMLDTAEPWQRFEKIVLVYGVREAKDLAYLDKLKGYAAQYPNQFILCLAVTREKLDGALQCRIPDGLVSGEIERKVGLTLSAADSQVMICGNPGMISGAQAALLDKGLSKNLRRAPGQITVEKYW

SEQ ID NO: 106972 - DNA, 780 bp, Pseudomonas putida KT2440
  CDS (1)..(780): transl_table=11
atgagcaacatgaaccacgaacgtgtcctcagtgtgcaccactggaacgacaccctgttcagcttcaagtgcacccgcgacccgggcctgcgcttcgagaacggtcagttcgtgatgatcggcctgcagcaggacaacggccgtccgctcatgcgtgcctactccatcgcttcgccaaactgggaagagcaccttgaattcttcagcatcaaggtgccggacggcccgctgacctcgcagctgcagcacctgaaggaaggcgatgagatcatcatcagcaagaagcctaccggcaccctggtcctcgacgacctgaatcctggcaagcacctgtacctgctgagcaccggcactggtctggcgccgttcatgagcgtcatccaggacccggaaacctacgagcgctttgaaaaagtgatcctggtgcacggcgtgcgctatgtgaacgaagtggcctaccgcgagttcatcaccgagcacctgccgcagaacgagttcttcggtgagtcggttcgcgacaagctgatctactacccgaccgtgacccgcgagccgttcgaaaaccagggccgtctgaccgacctgatgcgcagcggcaagctgttcagcgacatcggcctgccgccgatcaacccgcaagacgaccgcgcgatgatctgcggcagcccgagcatgctcgacgagaccagcgaagtgctggacagcttcggcctgaagatctccccgcgcatgcgcgagccgggtgactacctgatcgaacgtgccttcgtcgagaagtaa

SEQ ID NO: 106973 - protein, 259 aa, Pseudomonas putida KT2440
MSNMNHERVLSVHHWNDTLFSFKCTRDPGLRFENGQFVMIGLQQDNGRPLMRAYSIASPNWEEHLEFFSIKVPDGPLTSQLQHLKEGDEIIISKKPTGTLVLDDLNPGKHLYLLSTGTGLAPFMSVIQDPETYERFEKVILVHGVRYVNEVAYREFITEHLPQNEFFGESVRDKLIYYPTVTREPFENQGRLTDLMRSGKLFSDIGLPPINPQDDRAMICGSPSMLDETSEVLDSFGLKISPRMREPGDYLIERAFVEK

SEQ ID NO: 106974 - DNA, 777 bp, Pseudomonas putida KT2440
  CDS (1)..(777): transl_table=11
atgaccgctagcgccgaaaagttcactcgccagacactgctcgatgttcagccactgacgccgaacctcttcagcctgcgggttacgcgcgatgcggggttccgtttccgttccggccaatttgcccggctaggtgtgaccaaggccgatggtagtgtggtgtggcgcgcctattccatggtcagcgcccctcatgacgagcacctggatttcttttccatcgtggtgccaggtggtgaattcaccagtgagctgagccgtttgggggcaggcgatacgttgctgatcgaccgccaggcgtttggttttctcaccctcgaccgcttcgtcggaggtcgtgacctgtggctgctggctaccggtaccggcattgcgccctttatgtcgatcctgcaggacttcgaggcctgggagcgcttcgacagcatcaagctggtgtattcagtgcgcgaagcgaaggagctggcctatgtggatgaaattgccgggctggaacagcgcgagtacctggccgagtacgcgggcaagttgcagttcattcccgtggtgacccgtgaacaacaccctggggcgttgaatcagcgcattaccacgttgatcgagaatggcgagctggagaaggcggcagggcttgagctgtcgccggagcattcgcgggtgatgctgtgcggtaacccggaaatgatcgacgaaacccgcaaggtcctcaaggcgcgagacttgcaactgagcctgagcaagcggcccgggcaggtggctgtcgagaactactggtaa

SEQ ID NO: 106975 - protein, 258 aa, Pseudomonas putida KT2440
MTASAEKFTRQTLLDVQPLTPNLFSLRVTRDAGFRFRSGQFARLGVTKADGSVVWRAYSMVSAPHDEHLDFFSIVVPGGEFTSELSRLGAGDTLLIDRQAFGFLTLDRFVGGRDLWLLATGTGIAPFMSILQDFEAWERFDSIKLVYSVREAKELAYVDEIAGLEQREYLAEYAGKLQFIPVVTREQHPGALNQRITTLIENGELEKAAGLELSPEHSRVMLCGNPEMIDETRKVLKARDLQLSLSKRPGQVAVENYW

SEQ ID NO: 106976 - DNA, 855 bp, Bradyrhizobium japonicum USDA 110
  CDS (1)..(855)
atggcaatggtgtccgccctgctttcagggccgggcagcgcttttgccctaaaaccgcaattattcggaatatcgaaaatcatgagcgcgttttaccgagagaaagttctttccgtccagcactggaccgacacgctgttcagcttccgcgccacgcgcgataccggcttccgcttccagaacggccagttcgcgatgatcggcctcgaggtcgacggccgtccgctgctgcgcgcctacagcatggcgagcgccaaccacgaggaagagctcgagttcttctcgatcaaggttcaggacggtccgctcacctcgcgcctccagaagatcaaggagggcgacaccatcctggtcggccgcaaggcgaccggcacgctgatcaccgacaacctcatcccgggcaagcggctgatgctgctctcgaccggtacaggcctcgcgccgttcgcgagcctgatcaaggaccccgacgtctacgagcagttcgagaccatcgtgctggtgcatggctgccgccaggtctccgagctcgcttatggcgagaagctcgtcgccaatctgcgcgaggacgagctgttcggcgagctgctcgcggacaagctggtctattatccgaccgtgacccgcgagccgttccgcaatcggggccgcatcaccgacctcatcagctccgagcagatcttcaacgacatcggacagggcccgctcgacatcgcaaccgaccgcatcatgatgtgcggcagcccggcgatgctggaagagctgaaggtgatgttcgaaggccgcgacttcatcgagggaagcggcaacaagcccggccatttcgtgatcgagaaggcgttcgtcgagcggtaa

SEQ ID NO: 106977 - protein, 284 aa, Bradyrhizobium japonicum USDA 110
MAMVSALLSGPGSAFALKPQLFGISKIMSAFYREKVLSVQHWTDTLFSFRATRDTGFRFQNGQFAMIGLEVDGRPLLRAYSMASANHEEELEFFSIKVQDGPLTSRLQKIKEGDTILVGRKATGTLITDNLIPGKRLMLLSTGTGLAPFASLIKDPDVYEQFETIVLVHGCRQVSELAYGEKLVANLREDELFGELLADKLVYYPTVTREPFRNRGRITDLISSEQIFNDIGQGPLDIATDRIMMCGSPAMLEELKVMFEGRDFIEGSGNKPGHFVIEKAFVER

SEQ ID NO: 106978 - DNA, 774 bp, Bradyrhizobium japonicum USDA 110
  CDS (1)..(774)
atgagcgcatttcagagggaaacggttttgtcggtcaggcactggaccgagtccctgttcagcttcaccgcgacacgcgatccgggcttccgcttccagaacggccagttcgccatgatcggcctggaggtcgagggcaagccgttgatgcgggcctacagcatggcgagcgccaaccacgaggaggcgctcgagttcttctcgatcaaggtgcaggacggcccgctgacctcgcgcctccagaagatcagggaaggcgacatcatcctggtcggccgcaaggcgaccggcacgctgatcaccggcaacctcattcccggcaagcgcctcttgctgctctcgaccggcacgggactcgcgccgttcgccagcctgatcaaggaccctgacgtctacgagaattacgagaccatcgtgctcgcccatggctgccgccaggtctcggagcttgcctatggcgagcacctcgtcgaaggcctgcgcaaccacgaattcttcggtcccctgatccgcgacaggctgatctactacccgaccgtgacccgcgagccgttccgcaaccgcggccgcatcaccgatctgatcgcctcgaaccagctgttcgacgacatcgggctgccgggcctcgatatcgagaccgaccgcatcatgctgtgcggcagcccggcgatgctggaggaactccctgcgatgttttccgcgcgcggctttgtcgagggcaatcacagccagcccggccatttcgtgatcgaaaaggcctttgtcgagcgctga

SEQ ID NO: 106979 - protein, 257 aa, Bradyrhizobium japonicum USDA 110
MSAFQRETVLSVRHWTESLFSFTATRDPGFRFQNGQFAMIGLEVEGKPLMRAYSMASANHEEALEFFSIKVQDGPLTSRLQKIREGDIILVGRKATGTLITGNLIPGKRLLLLSTGTGLAPFASLIKDPDVYENYETIVLAHGCRQVSELAYGEHLVEGLRNHEFFGPLIRDRLIYYPTVTREPFRNRGRITDLIASNQLFDDIGLPGLDIETDRIMLCGSPAMLEELPAMFSARGFVEGNHSQPGHFVIEKAFVER

SEQ ID NO: 106980 - DNA, 774 bp, Bradyrhizobium japonicum USDA 110
  CDS (1)..(774)
atgagcaatttcaaccaggaaagcgttttgagcgtccaccattggaccgacacgctgttctccttcaagaccacccgcagcccgaccttccgcttccgcaacggtgaattcaccatgatcgggctcaaggtcggcgagaagccgctgctgcgggcctacagcgtcgccagcgccaattacgaggacacgctggagttcttctcgatcaaggtgccggacggcccgctgacctcgcggctccagcacctgaaggaaggcgacgagatcatcgtcagccgcaaggccaccggcacgctggtgatcgacaatctggaagagggccgcaacctctatttgatcggcaccggcacgggcctcgctccgttcctgagcgtgatcaaggaccccgagacctacgagcgcttcgagaaggtggtgctgctgcacggttgccgccacgtcaaggaactcgcctatggcgagatgatcaccgagcatctgccgaaagatgagctgctcggcgagtacatccagagccagcttatctactacccgacggtgacccgcgatcccttccgcaaccgcggccgcatcaccgacctcatcacctcgggcaagctgttcagcgatatcggcctgccggcgctggaggccgcgcacgaccgcgtcatgatctgcggcagcccggcgctggtcgcggacacccgcgtgctcctgggcgagcgcggcttcatcgagggcaatcacggcgaaccggcccagttcgtggtcgaaaaggctttcgccgagcgctag

SEQ ID NO: 106981 - protein, 257 aa, Bradyrhizobium japonicum USDA 110
MSNFNQESVLSVHHWTDTLFSFKTTRSPTFRFRNGEFTMIGLKVGEKPLLRAYSVASANYEDTLEFFSIKVPDGPLTSRLQHLKEGDEIIVSRKATGTLVIDNLEEGRNLYLIGTGTGLAPFLSVIKDPETYERFEKVVLLHGCRHVKELAYGEMITEHLPKDELLGEYIQSQLIYYPTVTRDPFRNRGRITDLITSGKLFSDIGLPALEAAHDRVMICGSPALVADTRVLLGERGFIEGNHGEPAQFVVEKAFAER

SEQ ID NO: 106982 - DNA, 780 bp, Xylella fastidiosa Temecula1
  CDS (1)..(780): transl_table=11
atgtctcccgccttcggtaccgaaacggtgatccatgtccatcactggaccgatgcctacttcagtttcattactacccgtgacactggatttcgcttcgaaaacggccaatttgtaatgattggtttggaaacagaaacaagaccgcttttacgcgcttactccattgcaagtgccaactgggaggagcaactggaatttttaagcattaaggtaaaaaacggcctgctgacctcacggctacaacacatcaaacctggagacaaaattctggttggtaaaaaacccaccggcacactattgattcacgatttacatccgggacgccatctgtatttactggggactggtactgggcttgcaccctggctctcaatcatcaaggacccagaaacctatgagcgatttgacaaagtcatcctgactcatggtgtgcgctacagtaaggatcttgcttaccgtgactacttcgaaaaggaactaccgcagcatgaattgcttggcgagacgattagcaagaagcttctctattaccctgcggtaacccgtgaggacttccctaaccgtggccgcttaacccacctgattgaaagtggcgcgatgcaaaagacgcttggtttaccaatcattgatccggccaacgaccgtttcatgctatgtggaaacccgcaaatgctggctgatctacgcaccttattgaacgcacgtagcttcaatgcctcagtacgtataggtagccccggcgattacgtatttgaacgtgctttcgttgatcaatga

SEQ ID NO: 106983 - protein, 259 aa, Xylella fastidiosa Temecula1
MSPAFGTETVIHVHHWTDAYFSFITTRDTGFRFENGQFVMIGLETETRPLLRAYSIASANWEEQLEFLSIKVKNGLLTSRLQHIKPGDKILVGKKPTGTLLIHDLHPGRHLYLLGTGTGLAPWLSIIKDPETYERFDKVILTHGVRYSKDLAYRDYFEKELPQHELLGETISKKLLYYPAVTREDFPNRGRLTHLIESGAMQKTLGLPIIDPANDRFMLCGNPQMLADLRTLLNARSFNASVRIGSPGDYVFERAFVDQ

SEQ ID NO: 106984 - DNA, 780 bp, Pseudomonas syringae pv. tomato str. DC3000
  CDS (1)..(780): transl_table=11
atgagcaacatgaaccacgagcgtgtcctcagcgtccaccattggaacgacaccctcttcagtttcaagtgcacccgcgaccctggtctgcgtttcgagaacggtcaattcgtcatgatcggtctgcagcagcccaatggtcgtccgctcatgcgcgcttactcgattgccagcccgaactgggaagagcatctggagttcttcagcatcaaggtgccggacggcccgctgacctcgcagttgcagcacctcaaggaaggcgacgaaatcatcatcagcaagaagcctacgggtacgctggtgctggatgacctcaagccgggcaagcatctatacctgctgagcaccggtacaggcctcgcgccgttcatgagcgtcatccaggacccggaaacctacgagcgtttcgagaaggtcatcctgtgccacggcgtgcgttacgtgaacgaggtcgcctatcgcgaattcatcaccgagcacctgccgcagaacgagttcttcggtgaatcgctgcgcgacaagctgatctactacccgactgtcactcgcgagccgttcgagaacgaaggtcgcctgaccgatctgatgcgcagcggcaagctgttcagcgacatcggcctgccaccgatcaaccctcaggacgaccgcgccatgctgtgcggcagtccgagcatgctcgacgaaaccagcgaagtactgaacagcttcggcctgactgtgtctccgcgcatgcgtgagccgggcgattatctgatcgagcgtgcattcgtcgagaagtaa

SEQ ID NO: 106985 - protein, 259 aa, Pseudomonas syringae pv. tomato str. DC3000
MSNMNHERVLSVHHWNDTLFSFKCTRDPGLRFENGQFVMIGLQQPNGRPLMRAYSIASPNWEEHLEFFSIKVPDGPLTSQLQHLKEGDEIIISKKPTGTLVLDDLKPGKHLYLLSTGTGLAPFMSVIQDPETYERFEKVILCHGVRYVNEVAYREFITEHLPQNEFFGESLRDKLIYYPTVTREPFENEGRLTDLMRSGKLFSDIGLPPINPQDDRAMLCGSPSMLDETSEVLNSFGLTVSPRMREPGDYLIERAFVEK

SEQ ID NO: 106986 - DNA, 777 bp, Pseudomonas syringae pv. tomato str. DC3000
  CDS (1)..(777): transl_table=11
atgaccgtcagtgacgacaaattcacccgccagacgctgcagcgtgtcacaccgctgaccacgaatctgtttaccctgcgcaccacccgcgaccccggctttcgctttcgcgcagggcagttcgcgcggctgggtgtgaccaaggctgacggcacgacggtgtggcgtgcgtactcgatggtttcttctccgcacgacgagtttctggagtttttctcaatcgtggtgcccgatggggaattcaccagcgagttgagccgcctgcgcgagggcgacagcctgatggtggagaagcaggcgtttggttacctgaccctggaccgcttcgttgatggtcgcgacctgtggctgctgtccaccggcacgggcgttgcgccgtttctttcgattcttcaggacttcgaggtctgggagaaatttgaacgggtgattctggtgtacagcgttcgcgagtccagcgagcttgcctatcagccgctgatcagcgaattgatgcagcgtgattacctggccgagtacgcgcacaagtttatgtttctgcccaccgtcacccgcgaacagcatacgggtgcactgaatggccgtatcacccaactgatcgaaaacggagcgcttgaacgcgccgcaggtatcgacctgacgccggagcattcgcgggtaatgctgtgcggcaacccacagatgatcgacgacacccgcgcattgctcaagcagcgcgacatgcgcctgagcctgtcccgcaaaccggggcaggtggcggtggaaacgtattggtag

SEQ ID NO: 106987 - protein, 258 aa, Pseudomonas syringae pv. tomato str. DC3000
MTVSDDKFTRQTLQRVTPLTTNLFTLRTTRDPGFRFRAGQFARLGVTKADGTTVWRAYSMVSSPHDEFLEFFSIVVPDGEFTSELSRLREGDSLMVEKQAFGYLTLDRFVDGRDLWLLSTGTGVAPFLSILQDFEVWEKFERVILVYSVRESSELAYQPLISELMQRDYLAEYAHKFMFLPTVTREQHTGALNGRITQLIENGALERAAGIDLTPEHSRVMLCGNPQMIDDTRALLKQRDMRLSLSRKPGQVAVETYW

SEQ ID NO: 106988 - DNA, 765 bp, Vibrio parahaemolyticus RIMD 2210633
  CDS (1)..(765): transl_table=11
atgactgagctgaaaggtttcaatctagccaaggtggagaaacgcattgactggactggcgagctgttcagtttaagggtctcaggcgcgcctcttacctttaaagccggccagttcaccaagcttgctttgctagatgatgagggcaagcctatcagccgtgcttactctgtggttaatgcgccaagcgagcaacacgagtggctcgaattcctcattgtggcagatcctcaagggcaactttctccaaggttgcaaaagctaaaagcgggtgacccgatttatgtgggtgaaaccgcgcatggcgatctcattcacgacaccattcctaagcaagcgagtgatctatggttgctttcgacagggactggcattggcccgtttctatctttgctggatgacattaacctgcttcctcacaatgatcgtatcgtgctggtgcatggtgttcgctacgaaaaagatttggtctacaaatacctgattgagcatcttcaattccgatatgaaggacgcttaaagtacgtgccaatcgtgagtcgtgaattgtcactcggaaaactgcaaggtcgaatcccagaattgattgcgtctggtgagcttgccaataaagtggatgtgcctttctctccgcaaagcagctttgtgatgctgtgtggtaacccagagatgattaaagataccttgccggtactgcaagagttagggttagaaaagtatcgaactcgaacaggcggtcacgttatctatgagcgttattggtaa

SEQ ID NO: 106989 - protein, 254 aa, Vibrio parahaemolyticus RIMD 2210633
MTELKGFNLAKVEKRIDWTGELFSLRVSGAPLTFKAGQFTKLALLDDEGKPISRAYSVVNAPSEQHEWLEFLIVADPQGQLSPRLQKLKAGDPIYVGETAHGDLIHDTIPKQASDLWLLSTGTGIGPFLSLLDDINLLPHNDRIVLVHGVRYEKDLVYKYLIEHLQFRYEGRLKYVPIVSRELSLGKLQGRIPELIASGELANKVDVPFSPQSSFVMLCGNPEMIKDTLPVLQELGLEKYRTRTGGHVIYERYW

SEQ ID NO: 106990 - DNA, 747 bp, Salmonella enterica subsp. enterica serovar Typhi Ty2
  CDS (1)..(747): transl_table=11
atggccgattgggtaacaggtaaagtcactaaggtgcaaaactggactgacgcactgttcagcctgaccgttcacgcccccattaatccttttactgcaggccaatttaccaaactcggactggagatcgatggcgagcgcgttcagcgcgcgtattcctatgtgaatgcgcctgacaatccgaatttagagttttatctggtgacggttccgcaaggaaagctcagcccgcggctggcggcgctaaaacctggcgatgaggtacaagtggtcagcgacgcgtcgggtttctttgtactggatgaagtgcctgactgcgagacgctatggatgctggcgaccggaaccgctattggcccgtatttgtctattctgcaatatggccaggatgtcacgcgctttaaaaatctggtcttagtccacgccgcacgcttcgccgccgatttaagctatctgccgctaatgctggaactgcaacagcgttatgaaggcaagctgcgcatccaaacggtggtcagccgggagagcgtgccaggctcgcttaccgggcgcgtgcctgcgctcattgaaaacggcgagctggaaaaagccgttggattaccgatggataaagagaccagccacgtcatgctgtgcgggaacccgcagatggtgcgcgatacgcagcaactgctgaaagagacccgacagatgactaaacatctgcgccgccgaccggggcatatgacggctgaacattactggtga

SEQ ID NO: 106991 - protein, 248 aa, Salmonella enterica subsp. enterica serovar Typhi Ty2
MADWVTGKVTKVQNWTDALFSLTVHAPINPFTAGQFTKLGLEIDGERVQRAYSYVNAPDNPNLEFYLVTVPQGKLSPRLAALKPGDEVQVVSDASGFFVLDEVPDCETLWMLATGTAIGPYLSILQYGQDVTRFKNLVLVHAARFAADLSYLPLMLELQQRYEGKLRIQTVVSRESVPGSLTGRVPALIENGELEKAVGLPMDKETSHVMLCGNPQMVRDTQQLLKETRQMTKHLRRRPGHMTAEHYW

SEQ ID NO: 106992 - DNA, 975 bp, Rhodopirellula baltica SH 1
  CDS (1)..(975): transl_table=11
atggatgaattgggctacccggacgatgaagagaagcgactgcttcgcgagcggcactacaacgcgaccatcatcaaacggatggatctgacggaagacctggcccggttccgcatccaatgcgatgaacccgtgatgccgtttgagcccggacagtatgtcgccatcgggcttgggaactgggaaccgcgattgcgtggcacccagccggaggacgttccaatcaaaaagtcgcgaaaattggtgcgacgggcgtattccatttcatgtccgatgcttcacgatgccgaatcgcccaaagcgggtgagttggcgcccgtcgatcaaatcgactacctggagttttacatcacgttggtgcgtcagggcgcaactgccgcgagcaagcctcccgccctgacacctcgtctgtttggcaaaggtgagggagatcgaatttgcgtcgagcgcaaaatcacgggtcggtatttgctgggtgatattccggcggacgaaaacgtcttgatgctcgggaccggcaccggcgaagctccgcacaacgccatggcgaccacattgttgtctggcgggcaccgtggaaaagtcgtcatcgcaaccagcgtccgttatcagtcggacatcgcttaccagagcgagcacgatgaactgatgcgacgttttccgaactattgctacttgccgttgacgactcgtgagcccaagaatctggaaccgaaccggcccgactatgtcggcaagcagtatctgcaaaccatgttcaccaccggcaagctggcggagttggttggtgatccactcgcgcccggcaacacgcacgtctttttgtgtggaaatccggacatgattggttacgtgccgcctggcggagacgttcccgaccgacctggcatgctgcctctgcttcgcgctgccggtttccacgatgccacagaaacacccggacctggcaccattcgctttgagaagtattggtaa

SEQ ID NO: 106993 - protein, 324 aa, Rhodopirellula baltica SH 1
MDELGYPDDEEKRLLRERHYNATIIKRMDLTEDLARFRIQCDEPVMPFEPGQYVAIGLGNWEPRLRGTQPEDVPIKKSRKLVRRAYSISCPMLHDAESPKAGELAPVDQIDYLEFYITLVRQGATAASKPPALTPRLFGKGEGDRICVERKITGRYLLGDIPADENVLMLGTGTGEAPHNAMATTLLSGGHRGKVVIATSVRYQSDIAYQSEHDELMRRFPNYCYLPLTTREPKNLEPNRPDYVGKQYLQTMFTTGKLAELVGDPLAPGNTHVFLCGNPDMIGYVPPGGDVPDRPGMLPLLRAAGFHDATETPGPGTIRFEKYW

SEQ ID NO: 106994 - DNA, 750 bp, Wigglesworthia glossinidia endosymbiont of Glossina brevipalpis
  CDS (1)..(750): transl_table=11
atgactgaatgggttcctggcaaaataataaaagtaaaaaattggactgatagattgtttagtattatacttcatgctcctatttctccatttatagctggacaattcgctaaattaaaattaaatataaatgaaaaatatatacaacgcgcatattcttatgtaaatgctcctaaagataataatttagaattttatttggtagaaacaaaactaggtaaatttagtccagttttaaaatcattaaatactggtcagaaaattttaataactaaaaattcttctggatcatttattttagaaatgattcctgattgtaaaaatttatggatgatagctacaggaactgcaataggtccatatttatcaatattacaacaaggagaagatttaaacagatttgaaaaaattatattaattcatgctgtaagattttataaagatttaagttatgttgaaaaaatttataatttaaaaaaaatatataaaaataagttatttgttcaattaatagttagtagagaaaaaacaaaaaatactttatttggtagaataccagaattaataaataatggaaatttagaaagatctttaaaaatatatattgatttaaaagatactcatgttatgttatgtggaaatccaaatatgatacatgatacttatagttgtttgaacaaaaaatttaaaatgactaaaaattatcaaaataaagtaggtaatataacaagcgaattatattggaaataa

SEQ ID NO: 106995 - protein, 249 aa, Wigglesworthia glossinidia endosymbiont of Glossina brevipalpis
MTEWVPGKIIKVKNWTDRLFSIILHAPISPFIAGQFAKLKLNINEKYIQRAYSYVNAPKDNNLEFYLVETKLGKFSPVLKSLNTGQKILITKNSSGSFILEMIPDCKNLWMIATGTAIGPYLSILQQGEDLNRFEKIILIHAVRFYKDLSYVEKIYNLKKIYKNKLFVQLIVSREKTKNTLFGRIPELINNGNLERSLKIYIDLKDTHVMLCGNPNMIHDTYSCLNKKFKMTKNYQNKVGNITSELYWK

SEQ ID NO: 106996 - DNA, 750 bp, Candidatus Blochmannia floridanus
  CDS (1)..(750): transl_table=11
atgtctacatggattttaggaaaagttcttaacataagacactggactaatcaattatttagcattactatcaatgctaaaattgatacatttattgctggccagttctccaaaatagggataaaaatcaataacaaaatcatacaacgagcatattctcatcttaatgctccaaataatccaaatctagaattttacatcaccaaagtaacatctggtactttaactaatttattacacaccttacaaattggagataccataatgatctctaaacaatcttatggtcaatttatattagataaaataccaaatcattctaattatttatggatgatcgctacaggcacaggaataagtccatatttatctatactcgaaagttttgacaaaagattatacctttttttaaaaattatattaattcacgctactcgatattctaaaaacctaaattacttacctaaaatgacagaattgcaaaaagcatataatggaaaattacttatacaaactatcttaagtcgagaatactcttttaactcaatgtatggatatatcccaacgttaatagaaaacaataccttagaaaaaaaaataggactatatttaaacaataacagttacgtaatgttatgtggaaaccctcaaatgataaccgatacaaaaaaaatactaaagaaaaaatataatatgaaaaatcattcccataaaaatacaggaaatattattcaagaacgatattggtaa

SEQ ID NO: 106997 - protein, 249 aa, Candidatus Blochmannia floridanus
MSTWILGKVLNIRHWTNQLFSITINAKIDTFIAGQFSKIGIKINNKIIQRAYSHLNAPNNPNLEFYITKVTSGTLTNLLHTLQIGDTIMISKQSYGQFILDKIPNHSNYLWMIATGTGISPYLSILESFDKRLYLFLKIILIHATRYSKNLNYLPKMTELQKAYNGKLLIQTILSREYSFNSMYGYIPTLIENNTLEKKIGLYLNNNSYVMLCGNPQMITDTKKILKKKYNMKNHSHKNTGNIIQERYW

SEQ ID NO: 106998 - DNA, 798 bp, Bordetella pertussis Tohama I
  CDS (1)..(798): transl_table=11
atgaccgataccaagtacacgcgccagaccatcaccgccgtccagacctgggtgccgggcaaactgttttcggtgcgcgtcacccgagaccccgccttcctcttccaggctggccagttcgcccgcgtcggcctgcccgacagcgacgatccgcaggccgaacccagcgtatggcgcgcctactccatggtctccgcgcccgaggagccatggctggagttctattccatcgtggtccccgaaggccagttcagcccgcgcatggagcgcctgcagcccggcgacgccctctatgtggaaaagaagccgttcggcttcctgaccatagaccgcttcgccccgggcggcgacctctggctgctggcttccggcacgggcctgtcggcctatctgtccatcttgcgcgacccggccacctggcgcgccgtcgaccgcatcatcctcgtgcacggggtgcgcagcgccgaggaactggcctatcgcgacgaaatcgagcaatggcgcagccagcccgcgttcgccccctatttcgaggccgacccgcgcaagctgatctacctgccgatcgccacgcgcgagaccctgcccggcatgccgcaggcgcgcctgaccacgctgatcgccgacggacggctcgaacagctggcgggccagccgctggacccgcagcgcgccaagatcatgctgtgcggcaacccggccatgctggccgacgcccgcaagctgctgagcgaacgcggtttcgcccccggccggcgcggcatacccggcaatctggcggtcgaaaactactggtaa

SEQ ID NO: 106999 - protein, 265 aa, Bordetella pertussis Tohama I
MTDTKYTRQTITAVQTWVPGKLFSVRVTRDPAFLFQAGQFARVGLPDSDDPQAEPSVWRAYSMVSAPEEPWLEFYSIVVPEGQFSPRMERLQPGDALYVEKKPFGFLTIDRFAPGGDLWLLASGTGLSAYLSILRDPATWRAVDRIILVHGVRSAEELAYRDEIEQWRSQPAFAPYFEADPRKLIYLPIATRETLPGMPQARLTTLIADGRLEQLAGQPLDPQRAKIMLCGNPAMLADARKLLSERGFAPGRRGIPGNLAVENYW

SEQ ID NO: 107000 - DNA, 777 bp, Bordetella parapertussis 12822
  CDS (1)..(777)
atggcagctttcaataccgagcgcgtgctcagcgtgcgccactggaacgacacccttttctccttcaccaccacccgcgatgcggcgctgcgctttcacaatggccatttcgtcatgatcggcctggaaatcgaaggcaagccgttgatgcgcgcctacagcatcgccagcgccaattacgaggaaaacctcgagttcctcagcatcaaggtgcaggacgggccgctgacctcgcggctgcagcacctcaaggaaggcgacaccatcctggtcagccgcaagccggtgggcacgctggtggtcgacgatctcaagccgggcaagcacctgtatctgttcggcaccggcacgggcctggccccgttcatgagcatcatcaaggatcccgaggtctacgagcggttcgagaaagtggtgctggtgcacggggtgcgctgggccagcgagctggcctatgccgatttcatcgagaaggaactgcccggcaacgagttcttcggcgacatcgtgcgcgacaagctggtctattaccccaccgtgacgcgcgaaccgttccgcaaccagggccgcatcacgcagctggtcgactcgggcaagctgtgcgccgacatcggcctgccgcagctggacccggcggtcgaccgcgccatgatctgcggcagcccgcacatgctggccgatatccgcgccatgctggacaagcgcgggttcgaggtttcgccgggcgtgggcgagccgggcgactacgtgttcgagcgcgcgttcgtggacaaataa

SEQ ID NO: 107001 - protein, 258 aa, Bordetella parapertussis 12822
MAAFNTERVLSVRHWNDTLFSFTTTRDAALRFHNGHFVMIGLEIEGKPLMRAYSIASANYEENLEFLSIKVQDGPLTSRLQHLKEGDTILVSRKPVGTLVVDDLKPGKHLYLFGTGTGLAPFMSIIKDPEVYERFEKVVLVHGVRWASELAYADFIEKELPGNEFFGDIVRDKLVYYPTVTREPFRNQGRITQLVDSGKLCADIGLPQLDPAVDRAMICGSPHMLADIRAMLDKRGFEVSPGVGEPGDYVFERAFVDK

SEQ ID NO: 107002 - DNA, 798 bp, Bordetella parapertussis 12822
  CDS (1)..(798)
atgaccgataccaagtacacgcgccagaccatcaccgccgtccagacctgggtgccgggcaaactgttttcggtgcgcgtcacccgagaccccgccttcctcttccaggcaggccagttcgcccgcgtcggcctgcccgacagcgacgatccgcaggccgaacccagcgtatggcgcgcctactccatggtctccgcgcccgaggagccatggctggagttctattccatcgtggtccccgaaggccagttcagcccgcgcatggcgcgcctgcagcccggcgacgccctctatgtggaaaagaagccgttcggcttcctgaccatagaccgcttcgccccgggcggcgacctctggctgctggcttccggcacgggcctgtcggcctatctgtccatattgcgcgacccggccacctggcgcgccttcgaccgcatcatcctcgtgcacggggtgcgcagcgccgaggaactggcctatcgcgacgaaatcgagcaatggcgcagccagcccgcgttcgccccctatttcgaggccgacccgcgcaagctgatctacctgccgatcgccacgcgcgagaccctgcccggcatgccgcaggcgcgcctgaccacgctgatcgccgacggacggctcgaacagctggcgggccagccgctggacccgcagcgcgccaagatcatgctgtgcggcaacccggccatgctggccgacgcccgcaagctgctgagcgaacgcggtttcgcccccggccggcgcggcgtacccggcaatctggcggtcgaaaactactggtaa

SEQ ID NO: 107003 - protein, 265 aa, Bordetella parapertussis 12822
MTDTKYTRQTITAVQTWVPGKLFSVRVTRDPAFLFQAGQFARVGLPDSDDPQAEPSVWRAYSMVSAPEEPWLEFYSIVVPEGQFSPRMARLQPGDALYVEKKPFGFLTIDRFAPGGDLWLLASGTGLSAYLSILRDPATWRAFDRIILVHGVRSAEELAYRDEIEQWRSQPAFAPYFEADPRKLIYLPIATRETLPGMPQARLTTLIADGRLEQLAGQPLDPQRAKIMLCGNPAMLADARKLLSERGFAPGRRGVPGNLAVENYW

SEQ ID NO: 107004 - DNA, 777 bp, Bordetella bronchiseptica RB50
  CDS (1)..(777)
atggcagctttcaataccgagcgcgtgctcagcgtgcgccactggaacgacacccttttctccttcaccaccacccgcgatgcggcgctgcgctttcacaatggccatttcgtcatgatcggcctggaaatcgaaggcaagccgttgatgcgcgcctacagcatcgccagcgccaattacgaggaaaacctcgagttcctcagcatcaaggtgcagaacgggccgctgacctcgcggctgcagcacctcaaggaaggcgacaccatcctggtcagccgcaagccggtgggcacgctggtggtcgacgatctcaagccgggcaagcacctgtatctgttcggcaccggcacgggcctggccccgttcatgagcatcatcaaggatcccgaggtctacgagcggttcgagaaagtggtgctggtgcacggggtgcgctgggccagcgagctggcctatgccgatttcatcgagaaggaactgcccggcaacgagttcttcggcgacatcgtgcgcgacaagctggtctattaccccaccgtgacgcgcgaaccgttccgcaaccagggccgcatcacgcagctggtcgactcgggcaagctgtgcgccgacatcggcctgccgcagctggacccggcggtcgaccgcgccatgatctgcggcagcccgcacatgctggccgatatccgcgccatgctggacaagcgcgggttcgaggtttcgccgggcgtgggcgagccgggcgactacgtgttcgagcgcgcgttcgtggacaaataa

SEQ ID NO: 107005 - protein, 258 aa, Bordetella bronchiseptica RB50
MAAFNTERVLSVRHWNDTLFSFTTTRDAALRFHNGHFVMIGLEIEGKPLMRAYSIASANYEENLEFLSIKVQNGPLTSRLQHLKEGDTILVSRKPVGTLVVDDLKPGKHLYLFGTGTGLAPFMSIIKDPEVYERFEKVVLVHGVRWASELAYADFIEKELPGNEFFGDIVRDKLVYYPTVTREPFRNQGRITQLVDSGKLCADIGLPQLDPAVDRAMICGSPHMLADIRAMLDKRGFEVSPGVGEPGDYVFERAFVDK

SEQ ID NO: 107006 - DNA, 798 bp, Bordetella bronchiseptica RB50
  CDS (1)..(798)
atgaccgataccaagtacacgcgccagaccatcaccgccgtccagacctgggtgccgggcaaactgttttcggtgcgcgtcacccgagaccccgccttcctcttccaggcaggccagttcgcccgcgtcggcctgcccgacagcgacgatccgcaggccgaacccagcgtatggcgcgcctactccatggtctccgcgcccgaggagccatggctggagttctattccatcgtggtccccgaaggccagttcagcccgcgcatggcgcgcctgcagcccggcgacgccctctatgtggaaaagaagccgttcggcttcctgaccatagaccgcttcgccccgggcggcgacctctggctgctggcttccggcacgggcctgtcggcctatctgtccatattgcgcgacccggccacctggcgcgccttcgaccgcatcatcctcgtgcacggggtgcgcagcgccgaggaactggcctatcgcgacgaaatcgagcaatggcgcagccagcccgcgttcgccccctatttcgaggccgacccgcgcaagctgatctacctgccgatcgccacgcgcgagaccctgcccggcatgccgcaggcgcgcctgaccacgctgatcgccgacggacggctcgaacagctggcgggccagccgctggacccgcagcgcgccaagatcatgctgtgcggcaacccggccatgctggccgacgcccgcaagctgctgagcgaacgcggtttcgcccccggccggcgcggcatacccggcaatctggcggtcgaaaactactggtaa

SEQ ID NO: 107007 - protein, 265 aa, Bordetella bronchiseptica RB50
MTDTKYTRQTITAVQTWVPGKLFSVRVTRDPAFLFQAGQFARVGLPDSDDPQAEPSVWRAYSMVSAPEEPWLEFYSIVVPEGQFSPRMARLQPGDALYVEKKPFGFLTIDRFAPGGDLWLLASGTGLSAYLSILRDPATWRAFDRIILVHGVRSAEELAYRDEIEQWRSQPAFAPYFEADPRKLIYLPIATRETLPGMPQARLTTLIADGRLEQLAGQPLDPQRAKIMLCGNPAMLADARKLLSERGFAPGRRGIPGNLAVENYW

SEQ ID NO: 107008 - DNA, 783 bp, Chromobacterium violaceum ATCC 12472
  CDS (1)..(783): transl_table=11
atgtcctctcctaatctgaccgctgaaaaggtcctgtccgtccatcactggaacgacacgctgttcagcttcacctgcacccgcgacgcgggcttgcgtttcatcaacggccaattcgtgatgataggcctggaggtgaacggcaagccgctgatgcgcgcctactccatcgtcagctccaattacgaagagcacatggagttctacagcatcaaggtgcaggatggccccctgacctcgcgcctgcagcatctgcaggtcggcgacaccgtcatgatcagcaagaagcccaccggcaccctggtgcaggacaacctgcttccgggcaagaacctgtacctgctgtccaccggcaccggcctcgccccgttcatgtccatcatcaaggatccggacgtgtacgagcgctacgacaaggtgatcctcacccacggcgtgcgttgggtcagcgagctgggttaccacgactacatcaccaaggaactgccggaaaacgaattcttcggcgaaatggtgagcgagaagctgatctactacccgaccgtcacccgcgagccgttccgcaaccagggccgcctgaccgacctgatcaccagcggcaagctgtgcgccgacatcggcctgccgcagttgaatccggaacacgaccgcgtgctgatctgcggcagcccgagcatgctgcacgacctgtgcgagatcctgaacggcatgggtttcaaggaatcgccgcggatgggcgagccggccgactacgcgatcgagcgcgccttcgtcgagaagtaa

SEQ ID NO: 107009 - protein, 260 aa, Chromobacterium violaceum ATCC 12472
MSSPNLTAEKVLSVHHWNDTLFSFTCTRDAGLRFINGQFVMIGLEVNGKPLMRAYSIVSSNYEEHMEFYSIKVQDGPLTSRLQHLQVGDTVMISKKPTGTLVQDNLLPGKNLYLLSTGTGLAPFMSIIKDPDVYERYDKVILTHGVRWVSELGYHDYITKELPENEFFGEMVSEKLIYYPTVTREPFRNQGRLTDLITSGKLCADIGLPQLNPEHDRVLICGSPSMLHDLCEILNGMGFKESPRMGEPADYAIERAFVEK

SEQ ID NO: 107010 - DNA, 792 bp, Chromobacterium violaceum ATCC 12472
  CDS (1)..(792): transl_table=11
atggacgccgcgctagaagccgagattcaacagaaatacaccgttgaaaccatcaccgacatgaagcgctggaccgacaagttgatcagcttccggctgacgcggcccgccggttttcgcttcgcggccggccagttcgcccggctgggcctgccgttggagaacggcggccaggcgtggcgcgcgtattcgatgtgctcggccgaatacgacgagttcctggagttctattccatcgtggtgccggagggccagttcagttcccgcctcgccaggctgcagccgggggcggaggtgatgctggacaagcgggcgatgggttttttccaggctgagcggctgccggacggcgaggatctgtggctgatcgccaccggcaccggcatcgcgccttatctgtcgattctgaaacaacccgaagtgtggcaacgcttcgagcgcatcgtgctggcgcactgtgtccgcgaggcggcggagctgtcgttccaggacgagatcgccgccttgcgcgagcatccgctgtggcgtgagcatggccgcaagctgcagtacctgcctgtggtgacgcgtaatgcgcccgagggcatgctgagccagcgcgtgccggcgctgctgcagagcggcgagttggcggcgcgcgccggcatcgagatgtcgcccgagcacagccgctttatgctgtgcggcaatcccaaaatggtggaggatacccaccgccaactgatgaagatgggctaccggatgacccggcagaacgcgccgggccatatcgtgctggaaaacggctggtaa

SEQ ID NO: 107011 - protein, 263 aa, Chromobacterium violaceum ATCC 12472
MDAALEAEIQQKYTVETITDMKRWTDKLISFRLTRPAGFRFAAGQFARLGLPLENGGQAWRAYSMCSAEYDEFLEFYSIVVPEGQFSSRLARLQPGAEVMLDKRAMGFFQAERLPDGEDLWLIATGTGIAPYLSILKQPEVWQRFERIVLAHCVREAAELSFQDEIAALREHPLWREHGRKLQYLPVVTRNAPEGMLSQRVPALLQSGELAARAGIEMSPEHSRFMLCGNPKMVEDTHRQLMKMGYRMTRQNAPGHIVLENGW

SEQ ID NO: 107012 - DNA, 747 bp, Photorhabdus luminescens subsp. laumondii TTO1
  CDS (1)..(747): transl_table=11
atggcaaactgggttacaggaaaagttacacaagttattcactggacgaataccttattcagcatcaggatacatgcaccggttgaaaaatttactgcgggccagtttgcaaaactggcgatggaaatagatgatgaacgggtacaacgggcctactcttatgttaatgccccgatagataataatcttgaattctacttagtgacggttcctgaaggcaaactcagcccacaattagcagctctgcaaccgggtgatgatctcttagtaacagaacaagccgcaggcttttttattcttgatgaaatacctgattgtgaaacattatggatgctttcaacagggaccgccattggcccttatctgtcaatcctccagcaaggagatcatctggatagattcaaaaacatcgtattggtgcatgccgtcagactaacacaagatttaagctatctgcccttaatgcagcaattagttgaacgtctcaatggcaagttacgaattcagactatcgtcagccgtgaacaaaacctcggctcattgactggccgtatcccgacattgatcgagaatggcgaacttgagtccgctgtcggacttacgatgagcagtgacaacagccatattatgttatgtggtaaccctcaaatggtgaaagatacccagcaactgctaaaagagcagcgtggaatggcaaaacacttacgccgcaaaccggggcatatcaccagtgaacaatattggtaa

SEQ ID NO: 107013 - protein, 248 aa, Photorhabdus luminescens subsp. laumondii TTO1
MANWVTGKVTQVIHWTNTLFSIRIHAPVEKFTAGQFAKLAMEIDDERVQRAYSYVNAPIDNNLEFYLVTVPEGKLSPQLAALQPGDDLLVTEQAAGFFILDEIPDCETLWMLSTGTAIGPYLSILQQGDHLDRFKNIVLVHAVRLTQDLSYLPLMQQLVERLNGKLRIQTIVSREQNLGSLTGRIPTLIENGELESAVGLTMSSDNSHIMLCGNPQMVKDTQQLLKEQRGMAKHLRRKPGHITSEQYW

SEQ ID NO: 107014 - DNA, 780 bp, Vibrio vulnificus YJ016
  CDS (1)..(780): transl_table=11
atggctgaactgaaaatcactgaacatcgagattttgcgaaggccgtggtagaaaagcgcaccgattggacgggggagctttttagcctacgtgttactggcacgcatttggattttaaagcgggtcaatttaccaagctggctttgctggatgagcaaggccaaatggtgagccgtgcctattctctggtaaatgccccttcggtgctgaatgattggttggagtttttgatcgtctctcacccgcaaggaaaactcacaccaaaattgcaatcgctcaaaactggggatgagatttacgtgggcaaaagcgctcatggcgatctcacttccgacatcattcccaaaaccaccgaagacctctggctttttgccacagggactggcattggtccttttctttcgctcctcgatgacattacccatcaacctcgttgtgatcgcatcatcttggtccattgcgtacgatatgaaaaagatcttgtttatcgctatctgattgagcagttgaaagagctgtatggcggccgtttagtttacgtgcccatcgtgtcgagagagcaagtaccgaacacgctacatggtcgaattccggcattgctctcttctgggatactgttccatcaccttggcatggagatgtcagccaaaaccagttttgccatgttgtgtggtaatccggaaatgattaaagacacctctgcggcgctgcaaaacttgggtttggaaaaataccgtcgtcaaacagggggaaacattatttttgagcgttactggtaa

SEQ ID NO: 107015 - protein, 259 aa, Vibrio vulnificus YJ016
MAELKITEHRDFAKAVVEKRTDWTGELFSLRVTGTHLDFKAGQFTKLALLDEQGQMVSRAYSLVNAPSVLNDWLEFLIVSHPQGKLTPKLQSLKTGDEIYVGKSAHGDLTSDIIPKTTEDLWLFATGTGIGPFLSLLDDITHQPRCDRIILVHCVRYEKDLVYRYLIEQLKELYGGRLVYVPIVSREQVPNTLHGRIPALLSSGILFHHLGMEMSAKTSFAMLCGNPEMIKDTSAALQNLGLEKYRRQTGGNIIFERYW

SEQ ID NO: 107016 - DNA, 774 bp, Rhodopseudomonas palustris CGA009
  CDS (1)..(774): transl_table=11
atgagtgcattccaaaccgaaacggtgttgtcggtccggcactggaccgactcgcttttcagtttcaccgcgacgcgcgaccctggattccggttccagagcggccagttcgcgatgatcggcctggaagtcgacggccggccgttgatgcgcgcctacagcatggcgagcgccaatcacgaggaagagctggagtttttcagcatcaaggtgccgaacggtccgctgacctcgcggctgcagcagatcaaggaaggcgatcagatcctggtcgggcgcaaggcgaccggaacgctgatcgcgggcaatctgatccccggcaagcggctgctgctgctgtcgaccggcaccgggctggccccgttcgcgagcctgatcaaggacccggaaatctacgacaactacgaatccatcgtgctggtccacggctgccgtcagattcccgaactggcctatggcgagcaactggtcgagcgcctgcgcgaccacgagttcctcggtgatctgatccgcgacaagctgcattactacccgaccgtgacccgcgagccgttccgcaaccgcggccgcgtcaccgatctgatcgcgtcgggccagttgttcagcgatctcggccagtccggtctcgatcgcgagtctgaccgggtgatgctgtgtggcaacccggcgatgctcgccgaactgccggcgatgctgagcgaacgcggcttccgcgagggcaaccacagcgagccaggccatttcgtggtcgagaaggcattcgtcgagcgctga

SEQ ID NO: 107017 - protein, 257 aa, Rhodopseudomonas palustris CGA009
MSAFQTETVLSVRHWTDSLFSFTATRDPGFRFQSGQFAMIGLEVDGRPLMRAYSMASANHEEELEFFSIKVPNGPLTSRLQQIKEGDQILVGRKATGTLIAGNLIPGKRLLLLSTGTGLAPFASLIKDPEIYDNYESIVLVHGCRQIPELAYGEQLVERLRDHEFLGDLIRDKLHYYPTVTREPFRNRGRVTDLIASGQLFSDLGQSGLDRESDRVMLCGNPAMLAELPAMLSERGFREGNHSEPGHFVVEKAFVER

SEQ ID NO: 107018 - DNA, 747 bp, Yersinia pestis biovar Medievalis str. 91001
  CDS (1)..(747): transl_table=11
atggctgaatgggttagtggcaaaattactcacatcgagcactggactgacgcgctgtttagtctccaggttaatgcacccgtggatccgtttaccgccgggcagttcgccaaactggcgttggatattaatggtgagcgtgtacagcgtgcctactcttacgtgaatgccccgagcgaccataatctggagttttatctggtcacggtaccggaaggaaaactcagtccacgcctggatcaactatccgtggggggggaagtgatgatcaccaagcaagccgcaggttttttcgtactggaagaaattcccgactgcgataccttgtggatgctggcaaccggtaccgccattggcccttatttgtcgattttacaggaagggcaagatttggagcgtttcaagcatttggtactggtacacgccgcacgctttgcccatgacctcagctacctaccgctgatgcaacagcttgagcaacgctataacggcaagctgcgtatccaaaccgtcgtgagccgcgaagaatcacccgattctttaactgggcgggtaccggcgctgatcgaaaatggtgctttggaagcggcagttggcctaaaaattgatgcgaaagacagccatgtcatgctgtgtggtaacccacaaatggtgcgtgatacccagcaattactgaaagaacagcgcgaaatgcgtaaacatctgcgccgtaaaccggggcatatgaccagcgagcagtattggtga

SEQ ID NO: 107019 - protein, 248 aa, Yersinia pestis biovar Medievalis str. 91001
MAEWVSGKITHIEHWTDALFSLQVNAPVDPFTAGQFAKLALDINGERVQRAYSYVNAPSDHNLEFYLVTVPEGKLSPRLDQLSVGGEVMITKQAAGFFVLEEIPDCDTLWMLATGTAIGPYLSILQEGQDLERFKHLVLVHAARFAHDLSYLPLMQQLEQRYNGKLRIQTVVSREESPDSLTGRVPALIENGALEAAVGLKIDAKDSHVMLCGNPQMVRDTQQLLKEQREMRKHLRRKPGHMTSEQYW

SEQ ID NO: 107020 - DNA, 831 bp, Bartonella quintana str. Toulouse
  CDS (1)..(831): transl_table=11
atgaatacgcctgccacccatgttcaatcaaacatcaacagcgtttcatcaagttttccgattcctgaaaatgtgtttgcgcttaccgttcaggaagtttatcattatacagaccatttgtttaaatttcgtctgaatcgtccggaaagttttcgttttcgttcaggtgagtttgttatgatcggtttgccaaatgcagaaaagccaatttatcgcgcttattcgatcgcaagtccattttgggatgaacagcttgagtttttttcgatcaaagttccaggaggatcattaactgaacatctccaaaaaattaaaattggtgatacagttttaatgcgtaaaaaatctactggaacattagttcttgatgctcttattcctggaaagcgcctttatcttctgtcaacggggacaggggttgctccctttgcaagtcttatccgtgatcctgaaacctatgaaaaattttcagaagtagtccttattcaaacaacccgtgagcgagatgagcttacttatgcaaaagatcttgttgactctttgcagcaagatccgctgattggtgaatatgtgaaacagttgaagttttatcccatgaccactcgcgaatcttctaagcatatggggcgcattacgactgttatggagagtggtgctttttttgaaacaaccggtttaccgaaaattcattctaatgaagatcgggtaatgatttgcggttccatggcgatgctgaaagattgtgcaagaatgtgtgaatcctttggtcttgttgaaggtgccaacaatgcacctgctacttatgttgtagagcgcgcgtttgtagggtga

SEQ ID NO: 107021 - protein, 276 aa, Bartonella quintana str. Toulouse
MNTPATHVQSNINSVSSSFPIPENVFALTVQEVYHYTDHLFKFRLNRPESFRFRSGEFVMIGLPNAEKPIYRAYSIASPFWDEQLEFFSIKVPGGSLTEHLQKIKIGDTVLMRKKSTGTLVLDALIPGKRLYLLSTGTGVAPFASLIRDPETYEKFSEVVLIQTTRERDELTYAKDLVDSLQQDPLIGEYVKQLKFYPMTTRESSKHMGRITTVMESGAFFETTGLPKIHSNEDRVMICGSMAMLKDCARMCESFGLVEGANNAPATYVVERAFVG

SEQ ID NO: 107022 - DNA, 831 bp, Bartonella henselae str. Houston-1
  CDS (1)..(831): transl_table=11
atgaatacgtctgctagcaatgttcagtcaaacatcagcagcgttgcatcagattttcctattcctgaaaatgtattcgcgcttactgtacaggaagtttatcactatacagaccgtttgtttaaatttcgcttgaatcgtcctgaaagttttcgttttcgttctggtgaatttgttatgattggtttgccaaatgcagaaaagccaatttatcgtgcttattcgattgcaagtccattttgggatgagcagcttgaatttttttcgatcaaagttccaggagggccattaaccgaacatctccaaaaaattaaaattggtgataccgttcttatgcgtaaaaaatctactggaacgctggttcttgatgcccttattcctggaaaacgcctttatcttttgtcaacagggacaggagttgctccctttgcaagtcttatccgtgatcctgaaacttatgaaaaattttcagaagtcgttcttattcaaacaactcgtgagtgcgatgaacttaattatgcaaaagatttggttgtctctctacaacaagatccactaattggtgaatacgcaccacagctgaaattttatcctatgactacgcgcgaatcttctgagcatatggggcgcattacgactgttatggagagtggcgctttttttgaaatgactggtttgccgaagattcatgctgatgaagatcgggtgatgatttgtggttccatggcgatgctgaaagattgtgcgagaatgtgtgaagtctttggtcttgttgaaggtgccaataatgcaccggctacatatgttgtggagcgtgcctttgtagggtga

SEQ ID NO: 107023 - protein, 276 aa, Bartonella henselae str. Houston-1
MNTSASNVQSNISSVASDFPIPENVFALTVQEVYHYTDRLFKFRLNRPESFRFRSGEFVMIGLPNAEKPIYRAYSIASPFWDEQLEFFSIKVPGGPLTEHLQKIKIGDTVLMRKKSTGTLVLDALIPGKRLYLLSTGTGVAPFASLIRDPETYEKFSEVVLIQTTRECDELNYAKDLVVSLQQDPLIGEYAPQLKFYPMTTRESSEHMGRITTVMESGAFFEMTGLPKIHADEDRVMICGSMAMLKDCARMCEVFGLVEGANNAPATYVVERAFVG

SEQ ID NO: 107024 - DNA, 762 bp, Acinetobacter sp. ADP1
  CDS (1)..(762): transl_table=11
atgtctattgaaaaatttagcgtagaaaaagtgttgtctatacaccgttggacaccaacattgtttagctttaccttaacccgacctgcacattttaaatttagcgcagggcagtttgcacggattggtttaaaagtaaaagatgatttggtagttcgtgcctattccattgtttcatcgccatttgatgaaacactagagttcttttcaattgtggttcccgatggtgcattcacttcaaatttacaacatctcaagattgatgatgaattgtatctggaaaagattccttatggtttcttgacgcttgcgcgttatcagttacctttacctcaggatttatggctactggcaacaggaactggactggcgccctttatttccatgctgcaagatttttctacttgggaaaattaccagcatatttatctggtttacagtgtacgaagtgctgccgaactggcctatgtagaaaaaattcaggaaattgcagcaaattttggagaaggacatcgcgactttaagtttattcctgtcgttactcgtgatccacatgcagcattgcatgagcgtttacctgttttaattgaaaatggtgaacttgaaaaagctgccaaccatatgcttaaccctgccagtagtcatgtgatgctatgtggaaatccacaaatggtagaagataccaaagaagccttaaaacgccgtggtctaagtatgaaccgacgtggtgaaggcaatatcgcagtagaaaactattggtaa

SEQ ID NO: 107025 - protein, 253 aa, Acinetobacter sp. ADP1
MSIEKFSVEKVLSIHRWTPTLFSFTLTRPAHFKFSAGQFARIGLKVKDDLVVRAYSIVSSPFDETLEFFSIVVPDGAFTSNLQHLKIDDELYLEKIPYGFLTLARYQLPLPQDLWLLATGTGLAPFISMLQDFSTWENYQHIYLVYSVRSAAELAYVEKIQEIAANFGEGHRDFKFIPVVTRDPHAALHERLPVLIENGELEKAANHMLNPASSHVMLCGNPQMVEDTKEALKRRGLSMNRRGEGNIAVENYW

SEQ ID NO: 107026 - DNA, 747 bp, Erwinia carotovora subsp. atroseptica SCRI1043
  CDS (1)..(747)
atggctgaatgggtgacaggcagagtgattcaggtggaaaactggacagaaagtctgtttagcattcgggttcaggcgcccgctgattcattcactgctgggcagtatggcaagctggcgctggagattgatggtgaaaaagtgcaacgcgcgtattcgtacgtgaatgcgcccagcgatcctacgcttgagttctatctggtgaccgtgccagaaggcaaacttagccctcatctgcatgccatgcagcctgggtcggaagtcatgattgtcaaagaggccgccggatttttcgtgctggaagagattcctgattgtgaaacactgtggatgctggcaacaggcacgggcatcggcccctatttgtccatccttcaggaaggcaaagatctggaacgctttaagaacatcgtgctggttcatgccgctaggttctcacgcgatctgagttatctgccgctgatgcagcagttacagcagcgctaccacggcaaactgcatattcaaacggtggtcagccgggaagaggaagcaggctcgctgacaggacgcatcccgcagcttattagcaacggtacgctggaatccgcagtaggcttaccgatggatacggccaccagccatgtcatgctgtgcggtaacccgcagatggtgcgcgatacccaagcattgctaaaagaagagcggcaaatgaccaaacacctgcgccgcaggcccggtcatatgactgctgagaactattggtaa

SEQ ID NO: 107027 - protein, 248 aa, Erwinia carotovora subsp. atroseptica SCRI1043
MAEWVTGRVIQVENWTESLFSIRVQAPADSFTAGQYGKLALEIDGEKVQRAYSYVNAPSDPTLEFYLVTVPEGKLSPHLHAMQPGSEVMIVKEAAGFFVLEEIPDCETLWMLATGTGIGPYLSILQEGKDLERFKNIVLVHAARFSRDLSYLPLMQQLQQRYHGKLHIQTVVSREEEAGSLTGRIPQLISNGTLESAVGLPMDTATSHVMLCGNPQMVRDTQALLKEERQMTKHLRRRPGHMTAENYW

SEQ ID NO: 107028 - DNA, 747 bp, Yersinia pseudotuberculosis IP 32953
  CDS (1)..(747): transl_table=11
atggctgaatgggttagtggcaaaattactcacatcgagcactggactgacgcgctgtttagtctccaggttaatgcacccgtggatccgtttaccgccgggcagttcgccaaactggcgttggatattaatggtgagcgtgtacagcgtgcctactcttacgtgaatgccccgagcgaccataatctggagttttatctggtcacggtaccggaaggaaaactcagtccacgcctggatcaactatccgtggggggggaagtgatgatcaccaagcaagccgcaggttttttcgtactggaagaaattcccgactgcgataccttgtggatgctggcaaccggtaccgccattggcccttatttgtcgattttacaggaagggcaagatttggagcgtttcaagcatttggtactggtacacgccgcacgctttgcccatgacctcagctacctaccgctgatgcaacagcttgagcaacgctataacggcaagctgcgtatccaaaccgtcgtgagccgcgaagaatcacccggttctttaactgggcgggtaccggcgctgatcgaaaatggtgctttggaagcggcagttggcctaaaaattgatgcgaaagacagccatgtcatgctgtgtggtaacccacaaatggtgcgtgatacccagcaattactgaaagaacagcgcgaaatgcgtaaacatctgcgccgtaaaccggggcatatgaccagcgagcagtattggtga

SEQ ID NO: 107029 - protein, 248 aa, Yersinia pseudotuberculosis IP 32953
MAEWVSGKITHIEHWTDALFSLQVNAPVDPFTAGQFAKLALDINGERVQRAYSYVNAPSDHNLEFYLVTVPEGKLSPRLDQLSVGGEVMITKQAAGFFVLEEIPDCDTLWMLATGTAIGPYLSILQEGQDLERFKHLVLVHAARFAHDLSYLPLMQQLEQRYNGKLRIQTVVSREESPGSLTGRVPALIENGALEAAVGLKIDAKDSHVMLCGNPQMVRDTQQLLKEQREMRKHLRRKPGHMTSEQYW

SEQ ID NO: 107030 - DNA, 774 bp, Burkholderia mallei ATCC 23344
  CDS (1)..(774): transl_table=11
atgtccgcgaatgcccacgaaaccgtgctgtccgttcatcactggaacgacacgctgttcagcttcaagacgacgcgcgcgccgggcttgcgtttcaagaccggccagttcgtgatgatcgggctcgagatcgacgggcggccgctgatgcgcgcctacagtgtcgtcagcgcgcactacgacgatcatctggagttctacagcatcaaggtgcccgacggcccgttgacctcgcggctgcagcatctgcgggccggcgacaaattgctcgtcgcgggcaagccgaccggttcgctgatcatcgacaatctgcggccgggcaagcatctctatctgctgtcgacgggcacggggctcgcgcccttcatcagcgtgatccgcgatcccgactactacggcgcgttcgacaagatcgtgctcatgcacggcgtgcgctggaagagcgagctcggctatttcgatcacatcacgaccgaattgcccgaaaacgcgtactttggcgatctcgtgcgcgacaagctgatctattacccgagcgtgacgcgcgagacgttcgagcgtcaggggcggctgaccgagctgatcgaatcgggcaagctgttcgacgacgtcgggctgccgccgctcgatcccgcggtcgatcgcgcgatggtctgcggcggcccgagcatgctcgccgatctcgtcgagatgctggagcggcgcggctttgtcgaaggcacgagccatgcgccgggcgattacgtgatcgagcgcgcgttcgtcgagaaatga

SEQ ID NO: 107031 - protein, 257 aa, Burkholderia mallei ATCC 23344
MSANAHETVLSVHHWNDTLFSFKTTRAPGLRFKTGQFVMIGLEIDGRPLMRAYSVVSAHYDDHLEFYSIKVPDGPLTSRLQHLRAGDKLLVAGKPTGSLIIDNLRPGKHLYLLSTGTGLAPFISVIRDPDYYGAFDKIVLMHGVRWKSELGYFDHITTELPENAYFGDLVRDKLIYYPSVTRETFERQGRLTELIESGKLFDDVGLPPLDPAVDRAMVCGGPSMLADLVEMLERRGFVEGTSHAPGDYVIERAFVEK

SEQ ID NO: 107032 - DNA, 771 bp, Burkholderia mallei ATCC 23344
  CDS (1)..(771): transl_table=11
atgagcaaattcgacaccgctaccgtcctgtccgtccatcactggaccgacacgctgttcagcttcacctgcacccgcgaccaagccctgcgcttcaacaacggcgagttcacgatggtcggcctggaagtcgacggcaagccgctcacgcgcgcctacagcatcgtgagcccgaactacgaagaacatctcgaattcttcagcatcaaggtgcagaacgggccgctcacgtcgcggctgcagcacctgaaggtcggcgatccggtcctgatcggcaagaagccgacgggcacgctcgtcgccgacaacctgctgccgggcaagacgctgtggctgctgtcgacgggcacgggcctcgcgccgttcatgtcgatcattcgcgacccggacatttacgagcgcttcgagaaggtggtcctcacccacacgtgccgcctgaagggcgagctcgcgtacatggactacatcaagcacgacctgccgggccacgaatacctcggcgacgtgatccgcgagaagctcgtctactacccgaccgtcacgcgcgaggagttcgagaacgaaggccggatcaccgatctgatcgcgtccggcaagctcttcacggatctggacgtgccgccgttctcgccggagcgcgaccgcgtgatgctctgcggcagcaccgcgatgctgaaggacacgaccgagctgctgaagaaggcgggcctcgtcgaaggcaagaacagcgctcccggccactacgtgatcgagcgcgcgttcgtcgactga

SEQ ID NO: 107033 - protein, 256 aa, Burkholderia mallei ATCC 23344
MSKFDTATVLSVHHWTDTLFSFTCTRDQALRFNNGEFTMVGLEVDGKPLTRAYSIVSPNYEEHLEFFSIKVQNGPLTSRLQHLKVGDPVLIGKKPTGTLVADNLLPGKTLWLLSTGTGLAPFMSIIRDPDIYERFEKVVLTHTCRLKGELAYMDYIKHDLPGHEYLGDVIREKLVYYPTVTREEFENEGRITDLIASGKLFTDLDVPPFSPERDRVMLCGSTAMLKDTTELLKKAGLVEGKNSAPGHYVIERAFVD

SEQ ID NO: 107034 - DNA, 1020 bp, Burkholderia mallei ATCC 23344
  CDS (1)..(1020): transl_table=11
atggaacaccgcatcgccctgcagttcgaagacggcgtcacccgcttcatcgcctgccgcgacggcgagacgctcgccgacgccgcgtatcgccagcagatcaacctcccgctcgattgccgcgacggcgcgtgcggcacgtgccgctgccggtgcgaatccggcgactacgcgctgcccgcgtcgagctacatcgaagacgcgctgacggctaacgaggccgcgcagcgctacgtgctcgcgtgccagacgcgcccgcgctccgattgcgtgatcgacgtgcccgcgtcgtccgccgcatgcaagacgggcgccgcgcgccacgagggcacgctcgcgtcggtcgagcggctgtccgcgtcgacgattcatttctcgatcgacgtcgacgagcccgcgaagctcgcctttctcgccgggcagtacgtgaacgtcgagattcccggcctcggcgcgacgcgctcgtactcgttcagctcgcgcccgggcgacgcgcgcgtgtcgtttctcgtgcgcaacgtgccgggcgggcgaatgagccgctatctcaccgacgaggccgcgcccggccagcggatcgcgttctccgggccgcacggcagcttttacctgcgcgacgccgcgcggcccgcgctctttctcgcgggcggcaccggcatcgcgccgttcctgtcgatgctcgacgtctgcgcatcgcgcgacggcgcgccgcccgtgcggctcgtctacggcgtcacgcgcgacgacgatctcgtcgcgctcgagcgcctcggcgacgtcgagcgccgcctcgccggcttcgcgtaccggacctgcgtcgcggacgaggcgagtgcgcacccacgcaagggctacgtgagcgcgcacgtcgagcccgaatggctgaacggcggcgacgtcgacatctatctgtgcggcccggcgccgatggtcgacgcggtgcaggcctggctgcgcgagcgcggcgtcacgccggccaatctgtacttcgaaaaattctcgtcgagcaacgcaccatga

SEQ ID NO: 107035 - protein, 339 aa, Burkholderia mallei ATCC 23344
MEHRIALQFEDGVTRFIACRDGETLADAAYRQQINLPLDCRDGACGTCRCRCESGDYALPASSYIEDALTANEAAQRYVLACQTRPRSDCVIDVPASSAACKTGAARHEGTLASVERLSASTIHFSIDVDEPAKLAFLAGQYVNVEIPGLGATRSYSFSSRPGDARVSFLVRNVPGGRMSRYLTDEAAPGQRIAFSGPHGSFYLRDAARPALFLAGGTGIAPFLSMLDVCASRDGAPPVRLVYGVTRDDDLVALERLGDVERRLAGFAYRTCVADEASAHPRKGYVSAHVEPEWLNGGDVDIYLCGPAPMVDAVQAWLRERGVTPANLYFEKFSSSNAP

SEQ ID NO: 107036 - DNA, 759 bp, Photobacterium profundum SS9
  CDS (1)..(759): transl_table=11
atggctgactggattcctgcggaagttgttactaatcgtcactggaataatgacctttttagtttaactttacgcgctaatattgaaccatttaaagctgggcaatttaccaaactcggtttagaaattgacggcaaaatgatccagcgcgcctactccttcgttaatcctcccagtgaaacccttgttgaagtatatgctacacgcgtggctgatggcttgctttcgcctcgccttcacgccctacaagcaggcgatacggtatttgtatctgctcgcgcaaatggctatttcacactaaatgaagtgcccgagagtgagcatttgtggatgcttgccacaggtacggcaattggtccttatctttctatcttattaaattcagataccagcgcgaacagcgtttggaaacgctaccgtaaagtcgtgctaatccatgccgtgcgctttgcgtctgatcttagctatcaagctgaaataaacacactaaaagaaaggcacccagatcagttcatcgttcaaccttttgtcagtcgagaacccgcaatgctcagtttgccggggcgcatacctcaagccattgcagatgggatgttagagcgccatgtcggcctacctcttaacccgaccacaagccaaatcatgttgtgtggcaatcctgaaatggtcaaagatacgaaagcagcccttgaagccaaaggatttgagaaaaacctacgtcgtaaaccaggacaaattaccatggagcattattggtaa

SEQ ID NO: 107037 - protein, 252 aa, Photobacterium profundum SS9
MADWIPAEVVTNRHWNNDLFSLTLRANIEPFKAGQFTKLGLEIDGKMIQRAYSFVNPPSETLVEVYATRVADGLLSPRLHALQAGDTVFVSARANGYFTLNEVPESEHLWMLATGTAIGPYLSILLNSDTSANSVWKRYRKVVLIHAVRFASDLSYQAEINTLKERHPDQFIVQPFVSREPAMLSLPGRIPQAIADGMLERHVGLPLNPTTSQIMLCGNPEMVKDTKAALEAKGFEKNLRRKPGQITMEHYW

SEQ ID NO: 107038 - DNA, 741 bp, Idiomarina loihiensis L2TR
  CDS (1)..(741): transl_table=11
atgatccaatggattagtggaaaagttgtcgagaattaccgttggagttctggcgttttcagtttaagagttgtggctgagccgtttgattttaaggctggacagtttgtgcgtttgggtttgaatattggtggtgaacagttgttgcgcgcctattcactagccagcgctccggacgaagccatactggactttgtgattgctgaagtggaagatggcgaggtcagtaccaagttagctcagttacagccgggtgacagcgtgtacataactcagcccgcaggtggctttttcacgctggatgaagtgccggacggcgacagcttgtggatgctttctaccggaaccggcattggtccgttcatttctatgctaagaaccgaaaagccgtgggaacgatttaaacggattaatctggtgcacggtgtacgcgtggcagaagacctggtttatcaggggcaaatagagcagtggcaacaagaataccccgggcagttaggctatcaaccggtgattacccgtgaaaacattcccggagctctctctgcgcgcattcctgaactgatcaactcaggacagttaagcaacgcacttgaaacgccgttagacactagcgcgcaagtcatgctttgtggtaaccccgacatgataaaagagtcacgcgctgcgcttgcggaattagggcttgccaaaaacacccgccgtaagcctggtaatgtgacctctgaaaattactggtaa

SEQ ID NO: 107039 - protein, 246 aa, Idiomarina loihiensis L2TR
MIQWISGKVVENYRWSSGVFSLRVVAEPFDFKAGQFVRLGLNIGGEQLLRAYSLASAPDEAILDFVIAEVEDGEVSTKLAQLQPGDSVYITQPAGGFFTLDEVPDGDSLWMLSTGTGIGPFISMLRTEKPWERFKRINLVHGVRVAEDLVYQGQIEQWQQEYPGQLGYQPVITRENIPGALSARIPELINSGQLSNALETPLDTSAQVMLCGNPDMIKESRAALAELGLAKNTRRKPGNVTSENYW

SEQ ID NO: 107040 - DNA, 783 bp, Idiomarina loihiensis L2TR
  CDS (1)..(783): transl_table=11
atgagaagtatcattgcggaaaaagtgactcaggtacgccactggaacgacaccctgtttagctttagaaccacacgccaaccaagctttaccttcgaaaacggtcagtttgtaatgatgggactgcagctggaagacaagcctctgctcagagcttacagcattgccagtgcaaaccatgaagaagagcttgagttcttcagtattaaagtgccggacggcgctttaacgtcgcgcctgcaacatatcaaggtgggtgacgaagtggtgttgtcgacacgccctacaggcacgttagtacccgggcacttactgccaggcaaaaacttgtacttgctcagtaccggcaccggtttagcgccttttatgagcgttattaaagaccccgacatatacgaacagtacgataaagtcgttttggttcacggtgtgcgctgggtgtctgagttggcgtatcaaaaagaaatctctgagattctgccaaataacgaatactttggtgactgggtgcgggaaaagctcatttattacccgacagtgacccgcgagccattccgtgatgaagcgcatcagcaacgtattaccgatttgctggagtctggcaccttaaccaaaaccattggtatgccagatctgaaccctgaacacgatcgctttatgttgtgcggtaatgacgctatgcttcaagatctgatggttattctcaatgaacggggctttagtaaagcaacatcgcgtaagcaaggcagctacgtgattgagcaggcctttattgaaaaataa

SEQ ID NO: 107041 - protein, 260 aa, Idiomarina loihiensis L2TR
MRSIIAEKVTQVRHWNDTLFSFRTTRQPSFTFENGQFVMMGLQLEDKPLLRAYSIASANHEEELEFFSIKVPDGALTSRLQHIKVGDEVVLSTRPTGTLVPGHLLPGKNLYLLSTGTGLAPFMSVIKDPDIYEQYDKVVLVHGVRWVSELAYQKEISEILPNNEYFGDWVREKLIYYPTVTREPFRDEAHQQRITDLLESGTLTKTIGMPDLNPEHDRFMLCGNDAMLQDLMVILNERGFSKATSRKQGSYVIEQAFIEK

SEQ ID NO: 107042 - DNA, 777 bp, Azoarcus sp. EbN1
  CDS (1)..(777): transl_table=11
atgtccttgccagccgaccgcttcaccactgagcgcatcatcacgctacggcgctggacgccgcatctgttcagcttccgcaccacgcgcgacccggcattccgcttcgtgccggggcagttcgcccgcctcgggctgcaaaaggaagacggctcgatcgtctggcgcgcgtattcgatggtctccgcaccgtacgacgaacacctcgagttttattcgatcgtcgtgccggacggagaattcacgagccgcctcgcccgcctcgccgaaggggacgagattttcgtcgagaagatgaactacggcttcctgacgaccgatcgcttcgaaagcgggcgcgacctgtggctgctcgcgaccggcaccgggctcgcgccgttcatctcgattctgcatgaccgcagcacctggaccgactacgaacgcatcgtcctcgtgcacagcgtgcgcaccgctgccgaacttgcctaccgcgacgagatcgcgcggctcgtcgatcacccgctggtcggcgacgtcgtgcacaagctgcactacgtgccggtcgtcacgcgcgagcgggttgccggggcattgagcgcgcgcatcacgacgctgatcgagagcggcgaactcgaacgcacagtcggcttcccgctcgaccacgaacgcagccgcatcatgctgtgcgggaatccgcagatggtcgatgacgggcgcaagctgctcaatcgtctcggctacaagctgtcgcgccgcgcggctccggcgcagctcgtcgtcgagaacatgtggtga

SEQ ID NO: 107043 - protein, 258 aa, Azoarcus sp. EbN1
MSLPADRFTTERIITLRRWTPHLFSFRTTRDPAFRFVPGQFARLGLQKEDGSIVWRAYSMVSAPYDEHLEFYSIVVPDGEFTSRLARLAEGDEIFVEKMNYGFLTTDRFESGRDLWLLATGTGLAPFISILHDRSTWTDYERIVLVHSVRTAAELAYRDEIARLVDHPLVGDVVHKLHYVPVVTRERVAGALSARITTLIESGELERTVGFPLDHERSRIMLCGNPQMVDDGRKLLNRLGYKLSRRAAPAQLVVENMW

SEQ ID NO: 107044 - DNA, 777 bp, Azoarcus sp. EbN1
  CDS (1)..(777): transl_table=11
atgagcaatctcgctgtcgaacgtgtcctgagcgtccaccactggaacgactcgctgttcagcttccgcacgacgcgtaaccgcggcctgcgcttcgagaatggccagttcgtcatgataggcctcgaagtggacggccggccgctgacgcgcgcctacagcatcgcaagcccgaactacgaggagcatcttgaattcttcagcatcaaggtgccgaacgggccgctcacgtcgcggctgcagcacctcaaggaaggcgatccgatcgtcgtcagcaagaagccgaccggaacgctcgtgctgcacgacctgaagcccggcaagcgcctgtacatgctcgcgaccggcaccggtctcgccccgttcctgagcctgatgcaggatccgcatacgtacgagcgtttcgagcacgtcgtgctgattcatggcgtgcgcaccgtgtcggagctcgcctaccgcgacttcatcacgagagaactggcggacaacgagttcttcggcgaggacgcacgcaacaagctgatctattacccgaccgtcacgcgcgagccgttcgtcaaccaggggcgcctgacggacctgatcgaaaccggcaagctgttcgaagacatcggcctgccgtcgctcgatccggagcacgaccgcgcgatgatctgcggcagtccggcgatgctcaaggacagctgcgagatgctcgacgcgcgcggcttcaagatctcgcgccatatcggagagccgggcgactacgtgatcgagcgcgccttcgtcgagaagtga

SEQ ID NO: 107045 - protein, 258 aa, Azoarcus sp. EbN1
MSNLAVERVLSVHHWNDSLFSFRTTRNRGLRFENGQFVMIGLEVDGRPLTRAYSIASPNYEEHLEFFSIKVPNGPLTSRLQHLKEGDPIVVSKKPTGTLVLHDLKPGKRLYMLATGTGLAPFLSLMQDPHTYERFEHVVLIHGVRTVSELAYRDFITRELADNEFFGEDARNKLIYYPTVTREPFVNQGRLTDLIETGKLFEDIGLPSLDPEHDRAMICGSPAMLKDSCEMLDARGFKISRHIGEPGDYVIERAFVEK

SEQ ID NO: 107046 - DNA, 828 bp, Zymomonas mobilis subsp. mobilis ZM4
  CDS (1)..(828): transl_table=11
atgagcgaattcgctgaaatcttagacgaaaccacgggattacagccgaataaagtcctgacggttgaaaaagtgcaatgggtcaaacattggaatgacagactttttagttttgctatttccagacccagcagcttccgcttccgttccggtgaattcgtgatgatcggtttacccggtgaaagtaaaaagccgcttttacgcgcttattctgtcgccagcccttcctatgctgaagaattagaatttctttctatcaaagtcgaaaatggccctcttacctctcaccttcaaaaaatcaaagaaggggatgaaatttatctgggacgcaaaccgactggcaccttggttgcagacacccttttacccggtaagcggcttttcctgttagcaacaggcaccggccttgcgcccttcttaagtattattcgcgatccagatatttacgatcgctttgaaaaaatcattctggttcacagcgtccgcagagtaagcgaccttgcctattatgatgatctggtaaaccagattgcggatgatccgctggtctccgaagaagccgcagaacaattcacctatattccaaccgttacccgagaagaatttgagcgcactagccgcatcaataccatgattgaggatggttccttattcaccgatcggattggtctgccgaaaaagcttgatccagcgacagaccgcctgatgctttgtggtagcatggacatgattaaggactttgaaaaatacctcaatgaacagggattcaaagaaggctctaacagcgaacccggtgatttcgtaatcgagcgggcttttgttgactaa

SEQ ID NO: 107047 - protein, 275 aa, Zymomonas mobilis subsp. mobilis ZM4
MSEFAEILDETTGLQPNKVLTVEKVQWVKHWNDRLFSFAISRPSSFRFRSGEFVMIGLPGESKKPLLRAYSVASPSYAEELEFLSIKVENGPLTSHLQKIKEGDEIYLGRKPTGTLVADTLLPGKRLFLLATGTGLAPFLSIIRDPDIYDRFEKIILVHSVRRVSDLAYYDDLVNQIADDPLVSEEAAEQFTYIPTVTREEFERTSRINTMIEDGSLFTDRIGLPKKLDPATDRLMLCGSMDMIKDFEKYLNEQGFKEGSNSEPGDFVIERAFVD

SEQ ID NO: 107048 - DNA, 834 bp, Silicibacter pomeroyi DSS-3
  CDS (1)..(834): transl_table=11
atgaccgagatgagacccgtgaccgaagccgctgccatcaaggcccccacccttcccgactcccagaccgtaacgcaagtgaaacactggaccgaccggttgttctcgttccgtgtcacgcgccccgccagcctgcgcttccgctcgggcgaattcgtgatgatcgggctgttgggcgacaatggcaaaccgcttctgcgcgcctattccattgcctcacccgcctgggacgaagagctggaattctactcgatcaaggtgcaggacgggccgctgacctcgaagcttcagcatatccagcccggggacgagatcatcctgcggcccaagccggtgggcacgctggtgcatgacgcgctgttgcccggcaagcgcatctggttctttgccaccggcaccggttttgcacccttcgcctcgcttctgcgcgagccgcagacctatgaggattatgacgaggtcatcatcacccatacatgccgcgaggtggcggaactggaatatggccgccagctgatcgaggagatccgccaggacgagctcttggccgaactgatgggcgaaggctttgccgacaagatccgctattaccccaccaccacccgcgaagagagcccgcgcatgggccgcatcaccgaactgctcaaggacggcaccgtattcgccgatctcggcatcgacggcggcatcaaggcggaaaccgaccgcgccatggtctgtggcagccttgccttcaaccatgacatcaaggccattctcgaagggttcggcctgaccgaaggcgccaattccgacccgcgcgagttcgtgatcgaaaaggcctttgtgggctga

SEQ ID NO: 107049 - protein, 277 aa, Silicibacter pomeroyi DSS-3
MTEMRPVTEAAAIKAPTLPDSQTVTQVKHWTDRLFSFRVTRPASLRFRSGEFVMIGLLGDNGKPLLRAYSIASPAWDEELEFYSIKVQDGPLTSKLQHIQPGDEIILRPKPVGTLVHDALLPGKRIWFFATGTGFAPFASLLREPQTYEDYDEVIITHTCREVAELEYGRQLIEEIRQDELLAELMGEGFADKIRYYPTTTREESPRMGRITELLKDGTVFADLGIDGGIKAETDRAMVCGSLAFNHDIKAILEGFGLTEGANSDPREFVIEKAFVG

SEQ ID NO: 107050 - DNA, 888 bp, Gluconobacter oxydans 621H
  CDS (1)..(888): transl_table=11
atgtccaccccgacttttgccgccccgactccgaccatcgacgagcccctgaccggcctggtgccgttcgaaggccatccgaatcagtaccgcctggctgaacccagcaaggaatacgcccacctgtatccggcaaaggtgctgacggtccatcactggacggaccgcctgttcagcttcaccacgacgcgcgatcccggcctgcgtttcgagaacggccagttcgcgatgatcggcatcgaagtcgaaggcaagccgctcctgcgcgcctattcgatcgcgtccgccaactatgaagaccacatggagttcctctccatcgcggttcccgatggcccgctgacctcgcgtctgcgccatgtgaaggtgggcgatacggtcctgatcggccgcaagccggttggcacgctgctgctcgacaacctcaagcccggtcgcaacctgtacttcctgtccacagggacgggtctggcgccgttcatgagcctcatcaaggatcccgaggcttacgagcgctatgagaacgtgatcctcagccacaccgtccgcatctcgggcgaactggcctatgagaaccatatccgccacgaactgccggagcacgagttcctgggcgagttcgtcaaggacaagctgcgctactatccggccgtgacccgcgaagactatgccgtgaccgatcgcatcaccaagctgatcgagacgggcaagatctttgaggatctgggtatcgacaagctcgatcccgagcatgaccgcgtcatgatctgtggttcgccggaaatgcttgccgacaccgaagcccttctcgagcgtatgggtttcgtggaaggcaatatgagccatcagggttcgtatgtcgttgaaaaggcctttgccgagcgctga

SEQ ID NO: 107051 - protein, 295 aa, Gluconobacter oxydans 621H
MSTPTFAAPTPTIDEPLTGLVPFEGHPNQYRLAEPSKEYAHLYPAKVLTVHHWTDRLFSFTTTRDPGLRFENGQFAMIGIEVEGKPLLRAYSIASANYEDHMEFLSIAVPDGPLTSRLRHVKVGDTVLIGRKPVGTLLLDNLKPGRNLYFLSTGTGLAPFMSLIKDPEAYERYENVILSHTVRISGELAYENHIRHELPEHEFLGEFVKDKLRYYPAVTREDYAVTDRITKLIETGKIFEDLGIDKLDPEHDRVMICGSPEMLADTEALLERMGFVEGNMSHQGSYVVEKAFAER

SEQ ID NO: 107052 - DNA, 813 bp, Xanthomonas oryzae pv. oryzae KACC10331
  CDS (1)..(813): transl_table=11
ttgagcagtactcctcccacgacactgaccggtatgtcttccgcttttggcgccgaaacggtgcttgaggtccgtcattggaccgatgcctacttcagcttcaccacgacccgcgatgccggcttccgcttcgaaaacgggcagttcgtgatgatcgggctggaaaccgaaacgcgcccgctgctgcgtgcgtattcgatcgccagcgccaattgggaagaacatctggagttcttcagcatcaaggtgccggacggcccgctgacctcgcggctgcagcacatccagcctggcgacaaggtgctggtcggcaagaaacccaccggcacgctgctgatcagcgatctgcatccgggtcgcaatctgtacctgctgggcactggtaccggcctggcgccgtggctgtcgatcatcaaggacccggaaacctacgagcgcttcgacaaggtgatcctcacccagggcgtgcgcttcgtgcaggatctggcctaccgcgattacttcgaacgcgaattgccgcagcacgaattcctcggcgatttgctgcgcgagaaattgctgtactacccggcggtcacgcgcgaagccttcgccaatcaaggccgtttgaccgagctgctggccgatggccgcatgcagcagacactcgggttgccgacgctggatccggccaacgaccgcttcatgatctgcggcagcccgcaaatgctgaccgacctgcgcaccctgctcgatagccgcggtttccagacctcgccgcgcatcggcacgccggggcattacgtattcgagcgtgcgttcgtcgagaagtga

SEQ ID NO: 107053 - protein, 270 aa, Xanthomonas oryzae pv. oryzae KACC10331
MSSTPPTTLTGMSSAFGAETVLEVRHWTDAYFSFTTTRDAGFRFENGQFVMIGLETETRPLLRAYSIASANWEEHLEFFSIKVPDGPLTSRLQHIQPGDKVLVGKKPTGTLLISDLHPGRNLYLLGTGTGLAPWLSIIKDPETYERFDKVILTQGVRFVQDLAYRDYFERELPQHEFLGDLLREKLLYYPAVTREAFANQGRLTELLADGRMQQTLGLPTLDPANDRFMICGSPQMLTDLRTLLDSRGFQTSPRIGTPGHYVFERAFVEK

SEQ ID NO: 107054 - DNA, 774 bp, Vibrio fischeri ES114
  CDS (1)..(774): transl_table=11
atgacagaaattcctcatggcttaattaaaggcgttgtcttaaaacgccatgattggacggatagattatttagtctgtttgttgaagcgccaatcaatgcttatcaagcgggacagtttaccaagttggcattattaaatgataaaggtgactgggtaagaagagcttattctatcgtaaatacccctgagcatattgaagggcgagagcgaatggaatttctgatcatagccgatcaaaagggagagttatctccttgtttgcaaaaactgaattctggtgacgagatttttgtaggtaaagacgccagtggttttatgactattgatgaagttcctaaaaatgcagatgatttttggttgctttcaacaggtactgccattggcccatttatatcgatattagaaacaccagaacttgaaatacgctttaaaaattttgtgttagttcatgcggtaagaacagagtctgaactgatttatcaacaacgaattgaacagttatctaaacgatataacaagaggtttcattatgtaccaattgtttctagagaatatgtcagcggagctttatgtggacgaatcccgtctttattactcaacggagagcttgaaaagagagcagaacttcaacttagtaaaacatctagcttcttatatatttgtggtaacccaaacatggttaaagacacatctgacgcactaaaagaattaggttttgaaaagcatttacgtcggaaacttgggcaatttagctcagaaaattattggtag

SEQ ID NO: 107055 - protein, 257 aa, Vibrio fischeri ES114
MTEIPHGLIKGVVLKRHDWTDRLFSLFVEAPINAYQAGQFTKLALLNDKGDWVRRAYSIVNTPEHIEGRERMEFLIIADQKGELSPCLQKLNSGDEIFVGKDASGFMTIDEVPKNADDFWLLSTGTAIGPFISILETPELEIRFKNFVLVHAVRTESELIYQQRIEQLSKRYNKRFHYVPIVSREYVSGALCGRIPSLLLNGELEKRAELQLSKTSSFLYICGNPNMVKDTSDALKELGFEKHLRRKLGQFSSENYW

SEQ ID NO: 107056 - DNA, 777 bp, Neisseria gonorrhoeae FA 1090
  CDS (1)..(777): transl_table=11
atggcagcattcaatacccaaaaagtattgtccgtacaccactggacagacgcatattttacctttacctgcatccgcgacgaatcgttgcgctttgaaaacggacagttcgtcatggtcgggctgatggcggacggcaagccgctgatgcgcgcatacagcgtcgcctccgccaactgggaagaacacctcgaatttttcagcattaaagtccaagacggcccgctgaccagccgcctgcaacacctcaaagtcggcgacgaagtgttaatcagcaaaaaaccgaccggaactctggttgccggcgacctgaatccgggcaaacacctttacttgttgagcaccggtaccggcatcgcccctttcttgagcatcaccaaagaccccgagatttacgagcaatttgaaaaaatcatcctcgtacacggcgtgcgctacaaaaaagatttggcgtactacgaccgctttaccaaagaattgcccgaacacgaatacctcggcgacttggttaaagaaaaactgatttactacccgattgtttcccgagaagaattcgaacaccgcggccgcctgaccgacctgatggtaagcggcaaactgtttgaagacatcggcctgcccaaaatcaacccgcaagacgaccgcgcgatgctgtgcggcagccccgcgatgctgaaagatacctgcaaagttttggacgatttcggtctgacagtctccccgaaaaccggcgtgcgcggcgactacctgattgagcgcgcatttgtggatcaataa

SEQ ID NO: 107057 - protein, 258 aa, Neisseria gonorrhoeae FA 1090
MAAFNTQKVLSVHHWTDAYFTFTCIRDESLRFENGQFVMVGLMADGKPLMRAYSVASANWEEHLEFFSIKVQDGPLTSRLQHLKVGDEVLISKKPTGTLVAGDLNPGKHLYLLSTGTGIAPFLSITKDPEIYEQFEKIILVHGVRYKKDLAYYDRFTKELPEHEYLGDLVKEKLIYYPIVSREEFEHRGRLTDLMVSGKLFEDIGLPKINPQDDRAMLCGSPAMLKDTCKVLDDFGLTVSPKTGVRGDYLIERAFVDQ

SEQ ID NO: 107058 - DNA, 780 bp, Neisseria gonorrhoeae FA 1090
  CDS (1)..(780): transl_table=11
atggcagcctcgcccgaagcaaaattcaccgaagaaaagattttgtgggtcaaacaccacacgccgaaactcatcactttcgccatcagccgtcccgaatcctaccgttttaaagccggacagttctcccgactcggtttctacgaaggtaaaggctttatttggcgtgcctattccgtcgtttccgcagaatatgccgacacgctcgaatattttgccgtactcatccaagacggccccatgtcggcccttttcgccaaaatgcaacagggcgacaccatcctgctcgataaaaatgccactggctttctcctgcccgaacgcttccccgacggcaaggatttggtgatgctctgtaccggctcgggcatcgcccccttcctttccattctcgaacaacccgaaatccggcagcgtttcgataccgtcaacctgatacattccgtatcttttcccgaagaattgattttcaacgaccggctggccgcattgtccgaacatcccctggtaggcgaatacggacactcgttccgtttcgtccctgttaccacccgtgccgccaacccctcgggcttaagcggaaaacgcattccggaactcttaaaaaacaacagcatcgaacaggcgctgcataccaagctcaccccggaatccacacggtttatgatttgcggtaacccggaaatggtcaaagacactttccaaacgctgctcgatatgggttacgccatgcaccgcaaccgcattcccggtcaaatcatgatggaaaacggcttctaa

SEQ ID NO: 107059 - protein, 259 aa, Neisseria gonorrhoeae FA 1090
MAASPEAKFTEEKILWVKHHTPKLITFAISRPESYRFKAGQFSRLGFYEGKGFIWRAYSVVSAEYADTLEYFAVLIQDGPMSALFAKMQQGDTILLDKNATGFLLPERFPDGKDLVMLCTGSGIAPFLSILEQPEIRQRFDTVNLIHSVSFPEELIFNDRLAALSEHPLVGEYGHSFRFVPVTTRAANPSGLSGKRIPELLKNNSIEQALHTKLTPESTRFMICGNPEMVKDTFQTLLDMGYAMHRNRIPGQIMMENGF

SEQ ID NO: 107060 - DNA, 747 bp, Salmonella enterica subsp. enterica serovar Choleraesuis str
  CDS (1)..(747): transl_table=11
atggccgattgggtaacaggtaaagtcactaaggtgcaaaactggactgacgcactgttcagcctgaccgttcacgcccccattaatccttttactgcaggccaatttaccaaactcggactggagatcgatggcgagcgcgttcagcgcgcgtattcctatgtcaatgcgcctgacaatccgaatttagagttttatctggtgacggtgccgcaaggaaagctcagcccgcggctggcggcgctaaaacctggcgatgaggtgcaagtggtcagcgacgcgtcgggtttctttgtactggatgaagtgcctgactgcgagacgctatggatgctggcaaccggaaccgctattggcccgtatttgtctattctgcaatatggccaggatgtcgcgcgctttaaaaatctggtcttggtccacgccgcacgcttcgccgccgatttaagctatctgccgctaatgctggaactgcaacagcgttatgaaggcaagctgcgcatccaaacggtggtcagccgggagagcgtgccaggctcgcttaccgggcgcgtgcctgcgctcattgaaaacggcgagctggaaaaagccgttggattgccgatggataaagagaccagccacgtcatgctgtgcgggaacccgcagatggtgcgcgatacgcagcaactgctgaaagagaccagacagatgactaaacatctgcgccgccgaccggggcagatgacggctgaacattactggtga

SEQ ID NO: 107061 - protein, 248 aa, Salmonella enterica subsp. enterica serovar Choleraesuis str
MADWVTGKVTKVQNWTDALFSLTVHAPINPFTAGQFTKLGLEIDGERVQRAYSYVNAPDNPNLEFYLVTVPQGKLSPRLAALKPGDEVQVVSDASGFFVLDEVPDCETLWMLATGTAIGPYLSILQYGQDVARFKNLVLVHAARFAADLSYLPLMLELQQRYEGKLRIQTVVSRESVPGSLTGRVPALIENGELEKAVGLPMDKETSHVMLCGNPQMVRDTQQLLKETRQMTKHLRRRPGQMTAEHYW

SEQ ID NO: 107062 - DNA, 777 bp, Brucella abortus biovar 1 str. 9-941
  CDS (1)..(777): transl_table=11
atgagcagcaactttaatcaggaaaccgtcaccgatatccatcactggaccgatacgctgttttcattccgcaccacccgtgatcccggtttccgctttcagagcggccagttcatcatgatggggctggaagtgaacggaaagccgctgacccgcgcctattcaatcgcatcgagcctttatgaagacggcctggaattcttctcgatcaaggtgccgaacggcccgctaacctcaaaactccagcatctgaaaaagggcgatcagatcattgtttccaagaagccggtcggcacgctgctttatgacaatctgaagcccggcaagcacctctggctgctctcgaccggcaccggccttgctccgttcctgtcgatcatccgggatctggaagtctatgagcgttttgaaaaggtcattctcgtgcatggcgtgcgccaggtggccgagcttgcctacaccgatttcatctccaacgaactgccgcaggacgaattcctgggcgagatggtgaaaaaccagctcatctattatccgaccgtgacgcgcgagccctacaaaaaccgtgggcgactgaccgacctcatccgttcgggccagcttttcaaggatgtcgggctgccggaattcaaccatgaggacgaccgcatgatgctgtgcggcagccctgaaatgctggcggaaaccaagcagattctcgaagaacgcggctttaccgaaggaagccagagcgaacccggcgaattcgttatcgaaaaggctttcgtggaaaaatag

SEQ ID NO: 107063 - protein, 258 aa, Brucella abortus biovar 1 str. 9-941
MSSNFNQETVTDIHHWTDTLFSFRTTRDPGFRFQSGQFIMMGLEVNGKPLTRAYSIASSLYEDGLEFFSIKVPNGPLTSKLQHLKKGDQIIVSKKPVGTLLYDNLKPGKHLWLLSTGTGLAPFLSIIRDLEVYERFEKVILVHGVRQVAELAYTDFISNELPQDEFLGEMVKNQLIYYPTVTREPYKNRGRLTDLIRSGQLFKDVGLPEFNHEDDRMMLCGSPEMLAETKQILEERGFTEGSQSEPGEFVIEKAFVEK

SEQ ID NO: 107064 - DNA, 777 bp, Pseudomonas syringae pv. syringae B728a
  CDS (1)..(777)
atgaccgtcagtgacgacaaattcacccgacagacactgcagcgtgtcacgccgctgaccgcgaacctgtttaccctgcgcaccacgcgtgatcccggctttcgctttcgtgccggacagttcgcgcgtctcggggtgaccaaggccgacggttcagtggtatggcgtgcctattcgatggtttcttcaccgcacgacgagtttctggagtttttttccattgtggtgccggatggcgaattcaccagcgagttgagccgtttgcgtgaaggcgacagcctgttggtggaaaagcaggcgtttggttacctgactctggatcgtttcattgatgggcgcgatctctggctgttatccactgggacgggggtcgcaccgtttctgtcgatccttcaggatttcgaggtctgggagaagttcgagcgggtgattctggtgtacagcgttcgtgagtcgcgcgagctggcctatcagcaattgattgccgaactgatgcagcgtgagtacctggctgaatacgcggacaagtttctgtttctgcccacggtgacccgtgaacagcatccgggcgcattgaatgggcgtatcacgcagttgatcgaaaacggggagctggagcgcgcggccggcattgctctcacgccggagcattcgcgggtgatgttgtgcggcaatccgcagatgatcgatgacacacgggcaattctcaagcagcgcgagatgcgcttgagcctgtcacgcaagccggggcaggtggcggtggagacgtattggtga

SEQ ID NO: 107065 - protein, 258 aa, Pseudomonas syringae pv. syringae B728a
MTVSDDKFTRQTLQRVTPLTANLFTLRTTRDPGFRFRAGQFARLGVTKADGSVVWRAYSMVSSPHDEFLEFFSIVVPDGEFTSELSRLREGDSLLVEKQAFGYLTLDRFIDGRDLWLLSTGTGVAPFLSILQDFEVWEKFERVILVYSVRESRELAYQQLIAELMQREYLAEYADKFLFLPTVTREQHPGALNGRITQLIENGELERAAGIALTPEHSRVMLCGNPQMIDDTRAILKQREMRLSLSRKPGQVAVETYW

SEQ ID NO: 107066 - DNA, 780 bp, Xanthomonas campestris pv. campestris str. 8004
  CDS (1)..(780): transl_table=11
atgtcttccgctttcggcgccgaaacggtgcttgaggtccgccactggaccgacgcctacttcagcttcaccaccacccgcgatgccggcttccggttcgagaatggtcagttcgtgatgatcggcctggagaccgagacgcggccgctgctgcgcgcctactccattgccagcgccaactgggaagaacacctggagttcttcagcatcaaggtgcaggacggcccgctcacctcgcgcctgcagcacatccagccgggcgacaaggtcctggtgggcaagaagcccaccggcacgctgctgatcagcgacctgcatccgggccgcaacctgtacctgttgggcaccggcaccggcctggcgccgtggctgtcgatcatcaaggacccggaaacctacgaacgcttcgacaaggtgatcctcacccacggcgtgcgcttcgaaaaagacctggcctaccgcgattttttcgagcgcgaactgccgcagcacgaattcctgggcgagctcctgcacgacaagctggcgtattacccggcagtcacgcgtgaggcgttcgccaaccagggccgcctgaccgagctgatggccgacggccgcatgcagcagacgctggggctgccgccgctggatccggccaacgaccgcttcatgatctgcggcagcccgcagatgctggccgacctgcgcaccctgctcgatgcacgcggctttgaaacctcgccgcgcatcggcacccccggccattacgtgttcgagcgcgcgttcgtcgagaagtaa

SEQ ID NO: 107067 - protein, 259 aa, Xanthomonas campestris pv. campestris str. 8004
MSSAFGAETVLEVRHWTDAYFSFTTTRDAGFRFENGQFVMIGLETETRPLLRAYSIASANWEEHLEFFSIKVQDGPLTSRLQHIQPGDKVLVGKKPTGTLLISDLHPGRNLYLLGTGTGLAPWLSIIKDPETYERFDKVILTHGVRFEKDLAYRDFFERELPQHEFLGELLHDKLAYYPAVTREAFANQGRLTELMADGRMQQTLGLPPLDPANDRFMICGSPQMLADLRTLLDARGFETSPRIGTPGHYVFERAFVEK

SEQ ID NO: 107068 - DNA, 780 bp, Pseudomonas fluorescens Pf-5
  CDS (1)..(780): transl_table=11
atgagcaacatgaaccacgagcgtgtcctcagtgttcatcactggaatgacactctgttcagcttcaagtgcacccgcgatccgggtctgcgcttcgagaacggtcagttcgtgatgatcggcctgcaacagcctaatggccgtccgcttatgcgtgcctactccattgccagcccgaactgggaagagcatctcgaatttttcagcatcaaggttccagacggtccgttgacttcccaactgcagcatctgaaggaaggcgacgagatcataatcagcaagaagccaaccggtaccctggtactggatgacttgaagcccggcaaacacctgtacctgctcagcaccggcaccggcctggcgccgttcatgagcgtgatccaggatccggaaacctacgagcgtttcgaaaaagtgatcctgtgccacggcgtacgctacgtcaacgaagtcgcctaccgcgagttcatcaccgagcacctgccgcagaacgagttcttcggcgaagccttgcgtgaaaagctgatctactaccccaccgtgacccgcgagccgttcgagaacgaaggccgcctgaccgacctgatgcgcagcggcaagctgttccgcgacatcggcctgccgccgatcaacccgcaggacgaccgcgccatgctgtgcggcagcccgagcatgctggatgaaaccagcgaagtgctcaacagtttcggcctgaccgtttcgccgcgcatgcgcgagccgggtgactacctgatcgagcgtgcattcgtcgaaaagtag

SEQ ID NO: 107069 - protein, 259 aa, Pseudomonas fluorescens Pf-5
MSNMNHERVLSVHHWNDTLFSFKCTRDPGLRFENGQFVMIGLQQPNGRPLMRAYSIASPNWEEHLEFFSIKVPDGPLTSQLQHLKEGDEIIISKKPTGTLVLDDLKPGKHLYLLSTGTGLAPFMSVIQDPETYERFEKVILCHGVRYVNEVAYREFITEHLPQNEFFGEALREKLIYYPTVTREPFENEGRLTDLMRSGKLFRDIGLPPINPQDDRAMLCGSPSMLDETSEVLNSFGLTVSPRMREPGDYLIERAFVEK

SEQ ID NO: 107070 - DNA, 777 bp, Pseudomonas fluorescens Pf-5
  CDS (1)..(777): transl_table=11
atgactgccagtgaagaaaagtacacccgccagaccctgctcgaggtccagcccttgacctccagcctgttcaccctgcgcaccacccgggatgcgggttttcgctttcgtgccgggcagttcgctcgcctcggggtgaccaaagccgacggcagtacggtgtggcgcgcctattccatggtgtcgtcgccgttcgatgagtttctcgagttcttttccatcgtggtgcccggcggcgagttcaccagcgagctgagccgcctggaagtgggggacagcctgctggtggatcgccaggcctttggctacctgaccctggaccgtttcgtcgatggtcgcgacctctggttgctatccaccggcaccgggattgcgccgttcctgtcgatcctccaggacttcgaggtgtgggaaaaattcgaacgcatcatcctggtctacagcgtgcgcgaggccaaggagctggcctatcagcgcctgctggccgagttgtcccagcgcgaatacctggcggaatttgcccacaagctgcaattcatcagcaccgtgacccgcgagcagcatccgggcagcctcaacgggcgcatcacccagttgatcgagaacggtgagctggagcgtgccgccggcgtggagctgagccccgagcactcccgggtgatgctctgcggcaacccgcagatgatcgatgacacccgcgccctgctcaagcagcggggcatgagcctgagcctgacccggcgaccggggcaggtggcggtggaaaactactggtaa

SEQ ID NO: 107071 - protein, 258 aa, Pseudomonas fluorescens Pf-5
MTASEEKYTRQTLLEVQPLTSSLFTLRTTRDAGFRFRAGQFARLGVTKADGSTVWRAYSMVSSPFDEFLEFFSIVVPGGEFTSELSRLEVGDSLLVDRQAFGYLTLDRFVDGRDLWLLSTGTGIAPFLSILQDFEVWEKFERIILVYSVREAKELAYQRLLAELSQREYLAEFAHKLQFISTVTREQHPGSLNGRITQLIENGELERAAGVELSPEHSRVMLCGNPQMIDDTRALLKQRGMSLSLTRRPGQVAVENYW

SEQ ID NO: 107072 - DNA, 831 bp, Psychrobacter arcticum 273-4
  CDS (1)..(831): transl_table=11
atgagcgacaatattcaaaccgtaacagtgctaagcaaaaccacttggacaccaaatttatttagctttaccgtcagccgtcctgatagctttaaattcacggctgggcagttcgtacgcttgggcgttaatcccagtcagttaaattattataagcagcagaacgaagcaggtcatgatatcgccaatgaagcactaaacgaagatatttttcgtgcttactcgattgtctcgtcaccctttgatgaggtactagcatttttctctatcgttattcctgatggcgcttttacctcgcaactacaacatctgcaagtaggcgatgagttgctgcttaataccataccatttggctttttaaccttagcacggtatcaaaagccattaccaaaagatttgtggctgctggctactgggactggacttgcacctttcttatcaatgctgcaagatttaaagacatgggaagattacgagcatatcatcttggcgtatagcgcacgttcgatagaagagttggcgtacgttgagaagatagagagtctacaagaagactttggctccttagtcgataatcctgcaaaattaacctttataccgatcgttactcgtgagcctgtcgagggcgcattgactgaacgtctgccgaaacttctattagacggaacgctgcaagaacgtgcgggtattgccttagatatcgacagtacgcatgtcatgctctgtggtaatccagagatggtagaagatactaaagagactttaaagacattaggactggtaatgaatcgtcgcggcgaaggcaatattgcggtagaaaactactggtaa

SEQ ID NO: 107073 - protein, 276 aa, Psychrobacter arcticum 273-4
MSDNIQTVTVLSKTTWTPNLFSFTVSRPDSFKFTAGQFVRLGVNPSQLNYYKQQNEAGHDIANEALNEDIFRAYSIVSSPFDEVLAFFSIVIPDGAFTSQLQHLQVGDELLLNTIPFGFLTLARYQKPLPKDLWLLATGTGLAPFLSMLQDLKTWEDYEHIILAYSARSIEELAYVEKIESLQEDFGSLVDNPAKLTFIPIVTREPVEGALTERLPKLLLDGTLQERAGIALDIDSTHVMLCGNPEMVEDTKETLKTLGLVMNRRGEGNIAVENYW

SEQ ID NO: 107074 - DNA, 774 bp, Psychrobacter arcticum 273-4
  CDS (1)..(774): transl_table=11
atgtcaaaactccgcaccgaaacggttacagaggttcatcattggaatgatgcactatttagcatcaaaaccacacgcgacgacggcttacgttttcgtaatggtgagtttgcgatgattggtttggtcgttgatggcaagccgttgctacgagcttactcgattgccagtcctaattatgaagaacatttggagtttttctccattaaagtacaagacggtccattaacgtcgcgattgcaacacattaaagttggtgatgagctattggtcagtaaaaaaccaacgggcactctcgtattagatgatctattaccgggtaaaaacctctatatgctgtcaaccggtacaggtgttgcgccatttttagcattagcacgtgaccctgaagtctacgagcgttttgagaaggtcatcttggtacatggtgtgcgcggtgttagtgacttggcttaccgtgacatgttcgaaaacgagctgccgaatgatgaaatttttggtgaagacttccgtaaaaaattcatttattatccgactgtcactcgcgaagaatttagaaataccggtcgtattaccgacttaatgaaatctggcaaattttttgaagatatcggcctgccgccgatgaacaaagaagatgatcgcgttctaatatgcggtagtatgccgtttaatgctgaagtctcagctattttggatgattttggtctaacggtctcaccgcgtatgggtgtacaggcagattatgccgttgaacgcgcctttgttggttaa

SEQ ID NO: 107075 - protein, 257 aa, Psychrobacter arcticum 273-4
MSKLRTETVTEVHHWNDALFSIKTTRDDGLRFRNGEFAMIGLVVDGKPLLRAYSIASPNYEEHLEFFSIKVQDGPLTSRLQHIKVGDELLVSKKPTGTLVLDDLLPGKNLYMLSTGTGVAPFLALARDPEVYERFEKVILVHGVRGVSDLAYRDMFENELPNDEIFGEDFRKKFIYYPTVTREEFRNTGRITDLMKSGKFFEDIGLPPMNKEDDRVLICGSMPFNAEVSAILDDFGLTVSPRMGVQADYAVERAFVG

SEQ ID NO: 107076 - DNA, 780 bp, Pseudomonas syringae pv. phaseolicola 1448A
  CDS (1)..(780): transl_table=11
atgagcaacatgaaccacgagcgtgtcctcagcgtccaccattggaacgacaccctcttcagtttcaagtgcacccgcgaccctggtttgcgtttcgagaacggtcagttcgtcatgatcggtctgcagcagccaaacggtcgtccgctcatgcgcgcctactcgattgccagcccgaactgggaagagcatctggaatttttcagcatcaaggtgccggacggtcctctgacctcgcagttgcagcacctcaaggaaggcgatgaaatcatcatcagcaaaaagcctacgggtacgctggtgctggacgacctcaagccgggcaaacatctttacctgttgagcacgggtactggcctggctccgttcatgagcgtgattcaggaccctgaaacctacgagcgtttcgagaaagtcatcctgtgccacggcgtgcgttacgtgaacgaagtcgcctatcgtgaattcatcaccgagcatttgccgcaaaacgagtttttcggtgaagcgctgcgtgacaagctgatctattacccgactgtcacccgcgagccgttcgagaacgaaggtcgcctgaccgacctgatgcgcagtggcaaactgttcagcgatatcggcttgccaccgatcaacccacaggacgaccgcgccatgttgtgcggtagcccgagcatgctcgacgagaccagcgaagtgctcaacagctttggtctgaccgtttcgccacgcatgcgtgagcccggcgactatctgatcgagcgtgcattcgtcgagaagtaa

SEQ ID NO: 107077 - protein, 259 aa, Pseudomonas syringae pv. phaseolicola 1448A
MSNMNHERVLSVHHWNDTLFSFKCTRDPGLRFENGQFVMIGLQQPNGRPLMRAYSIASPNWEEHLEFFSIKVPDGPLTSQLQHLKEGDEIIISKKPTGTLVLDDLKPGKHLYLLSTGTGLAPFMSVIQDPETYERFEKVILCHGVRYVNEVAYREFITEHLPQNEFFGEALRDKLIYYPTVTREPFENEGRLTDLMRSGKLFSDIGLPPINPQDDRAMLCGSPSMLDETSEVLNSFGLTVSPRMREPGDYLIERAFVEK

SEQ ID NO: 107078 - DNA, 777 bp, Pseudomonas syringae pv. phaseolicola 1448A
  CDS (1)..(777): transl_table=11
atgaccgtcagtgacgacaaattcacccgacagacactgcagcgtgtcacgccgctgaccaccaacctgttcaccctgcgcaccacgcgcgaccctggttttcgctttcgggcaggacagtttgcgcgcctcggtgtgaccaaggcagacggcaccaccgtatggcgtgcctactcgatggtgtcttcaccgcacgacgagtttctggagtttttttccatcgtggtgccggatggcgaattcaccagcgaactgagccgtctgcgcgaaggcgacgaattgatggtggaaaaactggcgtttggttatttgaccctggaccgttttgtcgatggccgcgacctctggctgttatccacaggtacaggtgtcgcgccgtttctatcgatccttcaggatttcgaggtctgggagaagttcgagcgggtgattctggtgtacagcgttcgtgagtcccgcgaactggcctatcagcagttgattggcgaactgatgcagcgtgaatatctggctgaatacgcagacaagttcctgtttctaccgactgtgacccgcgaacagcatccgggcgcactaagtggccgcattacacagttgattgaaaacggcgagcttgagcgcgctgcaggcatcgcactgacacctgagcattcccgggtaatgctgtgcggcaacccgcagatgatcgacgacacacgtgcactgctcaaacagcgtgacatgcgcctgagcctgtcacgcaagccggggcaggttgcggtggagacgtattggtaa

SEQ ID NO: 107079 - protein, 258 aa, Pseudomonas syringae pv. phaseolicola 1448A
MTVSDDKFTRQTLQRVTPLTTNLFTLRTTRDPGFRFRAGQFARLGVTKADGTTVWRAYSMVSSPHDEFLEFFSIVVPDGEFTSELSRLREGDELMVEKLAFGYLTLDRFVDGRDLWLLSTGTGVAPFLSILQDFEVWEKFERVILVYSVRESRELAYQQLIGELMQREYLAEYADKFLFLPTVTREQHPGALSGRITQLIENGELERAAGIALTPEHSRVMLCGNPQMIDDTRALLKQRDMRLSLSRKPGQVAVETYW

SEQ ID NO: 107080 - DNA, 750 bp, Candidatus Blochmannia pennsylvanicus str. BPEN
  CDS (1)..(750): transl_table=11
atgtctacatgggtcaccgggaaaattattgatataaaaaattggacagatcagttgtttagtcttattgtacgagctccagtaaatacatttattgctggtcaatttacaaaaataaagataaaaataaataatataatcgtacaacgtgcttattcatatcttaatgctccgcataatccaaatctagaattttacatagctactgtactagaagggaaatgtaccccattgttatgtactttacgtcccggtgatactcttatgcttactaaaaaagcgtacggacgctttatactcaatgaaattccaaattgtaaaaatttatggatgttagctagcggaacaggaattggtccatatttatcaatactcgaagatcatgataaaagattgtatcaattttcaaatattgtattagtacatgcggtgaggttttctaaaaatttaaattatttatctcaaataagaaaattacaaaaattttataatggtaaattacatgtacaaacaatcataagtcaagaagaatcttatagttcactttttggacgtatacctaatttgatagaaaatgactctttagaaaaagaagtaggattacaattggatattaacaatagtcacgtgatgttgtgtggaaatccgaaaatgatacaggatactaaagaaatattaaataaaaaatacggaatgcaagatcatttacgatataaaccaggtcatgttactcaagaacgttattggtaa

SEQ ID NO: 107081 - protein, 249 aa, Candidatus Blochmannia pennsylvanicus str. BPEN
MSTWVTGKIIDIKNWTDQLFSLIVRAPVNTFIAGQFTKIKIKINNIIVQRAYSYLNAPHNPNLEFYIATVLEGKCTPLLCTLRPGDTLMLTKKAYGRFILNEIPNCKNLWMLASGTGIGPYLSILEDHDKRLYQFSNIVLVHAVRFSKNLNYLSQIRKLQKFYNGKLHVQTIISQEESYSSLFGRIPNLIENDSLEKEVGLQLDINNSHVMLCGNPKMIQDTKEILNKKYGMQDHLRYKPGHVTQERYW

SEQ ID NO: 107082 - DNA, 777 bp, Dechloromonas aromatica RCB
  CDS (1)..(777): transl_table=11
atgagcaactttgctaccgaaaaagtcctctccgttcatcactggaacgacaacctgttcaccttccggacaacgcgcgaccccggcttgcgcttcaataatggtcagtttgtaatgatcggtctcgaagtaaatggtcgccccctgatgcgggcgtacagcgtcgccagcgccaactacgaagagcacctggagttcttcagcatcaaggtccaggatggcccgctgacctcccgcctgcagcacctcaagcctggcgatccgctattgatcagcaagaagccgacgggcacccttgtgctgcgtgacttgaagccaggcaagcgcttgttcatgtttgcgactggcaccgggctggcgccgttcatgagcctgatccacgacccggaaacctacgagcgctttgagaaggtcattctcattcacggcgtacgctggaccaacgaactcgcttatcacgactatatcgaagaggacttgaaggaacacgagtatctgggagaactgcttcgcgaaaagctgatctactacccaacggtaactcgtgagccgttccgcaatgaagggcgacagaccgacctgatcctctctggaaaactgttcgaggacattggcgaagcgccgcttgatccagccaccgaccgcggcatgatctgcggcagcccggccatgctgaaagaaatatccagcatgctcgacggtttcggcttcgagatatcgccccacatcggcgttgccggtgactatgtgatcgaacgggcatttgtcgaacagtaa

SEQ ID NO: 107083 - protein, 258 aa, Dechloromonas aromatica RCB
MSNFATEKVLSVHHWNDNLFTFRTTRDPGLRFNNGQFVMIGLEVNGRPLMRAYSVASANYEEHLEFFSIKVQDGPLTSRLQHLKPGDPLLISKKPTGTLVLRDLKPGKRLFMFATGTGLAPFMSLIHDPETYERFEKVILIHGVRWTNELAYHDYIEEDLKEHEYLGELLREKLIYYPTVTREPFRNEGRQTDLILSGKLFEDIGEAPLDPATDRGMICGSPAMLKEISSMLDGFGFEISPHIGVAGDYVIERAFVEQ

SEQ ID NO: 107084 - DNA, 813 bp, Dechloromonas aromatica RCB
  CDS (1)..(813): transl_table=11
atgctgacccccgcctcaacattccgccgaggcccgcttccggcgcccaccgacaaagcaactgccgagcgcattctcgacatccggcgatggaccgacaagctgatctccgtgcgcacgacacgcaacgtgtcattccgcttccagcccggccaattcgcgcggattggcatcgccagtgacagcggcggcacgatctggcgcccttactcgatggtttcggccaattacgatgagcatctggagttcttctcgatcatcgtgcccaatggcgccttcagtacaaaactggcactagcctcggtcggggataccctttatgtggaaaaacagccctacggttacctgacaacaagccgctttgtcggcgggcaggatctctggatgctggccaccggcaccggaattgcgccattcctgtccatcctgcgcgaccctgaggtctgggcacagtacgacaatctgctgctcgcctatagcgttcgccacatttccgaactcgcctatcgaaacgagattgcttccatcgcacaggaggagcctttcgccgagcatggccacaagttgcgctttgccccgattgtcacgcgggaagctgttcccggcatgctgaatcgtcgactgaccgacctgttgcacgacggagaactggagaaaagcatcggcctgcccatcgatgccgagcgagctcgcatgctgatctgtggcaacccccaaatgcttgacgacgtgcgccaggtactgaccgcacgcggctttcgccccgaccttgggcgcgcccccggccactttgcctgcgagaattattggtaa

SEQ ID NO: 107085 - protein, 270 aa, Dechloromonas aromatica RCB
MLTPASTFRRGPLPAPTDKATAERILDIRRWTDKLISVRTTRNVSFRFQPGQFARIGIASDSGGTIWRPYSMVSANYDEHLEFFSIIVPNGAFSTKLALASVGDTLYVEKQPYGYLTTSRFVGGQDLWMLATGTGIAPFLSILRDPEVWAQYDNLLLAYSVRHISELAYRNEIASIAQEEPFAEHGHKLRFAPIVTREAVPGMLNRRLTDLLHDGELEKSIGLPIDAERARMLICGNPQMLDDVRQVLTARGFRPDLGRAPGHFACENYW

SEQ ID NO: 107086 - DNA, 771 bp, Ralstonia eutropha JMP134
  CDS (1)..(771): transl_table=11
atgagcaatctcaacccccaatccgtactttccgttcaccactggactgacacgctgttcagcttcacctgcacgcgtgacccgggcttccgcttcgagaacggccagttcgccatggtcggcctcgaagtcaatggccgcccgctgctgcgtgcctacagcattgccagcgccaactacgaagagaccctggagttcttcagcatcaaggtgcccgatggcccgctgacctcgcgcctgcagcacctgcaggaaggcgaccagatcttcgtcggcaagaagcccaccggtacgctgctggtcgacaacctgctgccgggcaagaccctgtggctgctcgccacgggtaccggcctggcgccgttcctgtcgatcatccgcgacccggaagtgtatgaacgctacgacaagatcgtgttgacccatacctgccgctttgtggaagagctggcgtatcgcgaactgatttcggaacacctgccgaagcatgaatacctcggcgatctggtgcgcgagaagctggtgtatttcccgaccgtcacgcgcgaggacttccacactcgcggccgcatcaccgagctgattgaaaccggcgagctgttcgaccgcctggatatgccggccttctcgaaagaaaatgaccggatcatgctgtgcggcagcccggacatgctcaaggaagtccgcgcgatgctcgatgagcgcggctttatcgaaggcaatatgagccatcccgggcactttgtgctcgaaaaggcgtttgtcggctga

SEQ ID NO: 107087 - protein, 256 aa, Ralstonia eutropha JMP134
MSNLNPQSVLSVHHWTDTLFSFTCTRDPGFRFENGQFAMVGLEVNGRPLLRAYSIASANYEETLEFFSIKVPDGPLTSRLQHLQEGDQIFVGKKPTGTLLVDNLLPGKTLWLLATGTGLAPFLSIIRDPEVYERYDKIVLTHTCRFVEELAYRELISEHLPKHEYLGDLVREKLVYFPTVTREDFHTRGRITELIETGELFDRLDMPAFSKENDRIMLCGSPDMLKEVRAMLDERGFIEGNMSHPGHFVLEKAFVG

SEQ ID NO: 107088 - DNA, 747 bp, Thiobacillus denitrificans ATCC 25259
  CDS (1)..(747): transl_table=11
atgccctatagcgaacaaaccgtacagtgggtgcggccgtggtccgacaagacgttcagcttcacggtgacgcgtccgcaggatttctcgttcgcgaacggcgagttcgtcacgatcggactcaagcaggaaggcaagctcgtggcgcgtgcctattcgatcgtctcgacggccgaccgcgactatctcgagttcctgagcatccatgtcccggacgggccgctgacgagtcagctttcacagatcaagccgggcgaccgggtctggatcaacaacaagacgacgggaacgctgacgctcgaccacgtgtcgccggggcgcgtcctttacatgctcgccaccggcaccggggtcgcgcccttcgtgagcctcgtgcgcgatcccgcgatcttcgcgcgcttcgaaacggtcgtgctcgtgcattcggttcggacggccgccgaactcgcgtatcgcgaggaactcgaggccatggaccagccacaactgcactacgtgccgacggtgacccgcgagccgtttccgacgaccgagcgcggcagcgaactttttcgctcgggcctgctgtcgcagcgcctgggtttaccgccgcccgaccccgagcaggaccgcgtgatgatctgcggcaacccgcagatgacgcgcgaaatgacgcgctttctcaaggacaccggctggacgctgacgaccccgcgcgggctcggcaatttcacgacagaagtcgccttcgtcctgcatcacggctga

SEQ ID NO: 107089 - protein, 248 aa, Thiobacillus denitrificans ATCC 25259
MPYSEQTVQWVRPWSDKTFSFTVTRPQDFSFANGEFVTIGLKQEGKLVARAYSIVSTADRDYLEFLSIHVPDGPLTSQLSQIKPGDRVWINNKTTGTLTLDHVSPGRVLYMLATGTGVAPFVSLVRDPAIFARFETVVLVHSVRTAAELAYREELEAMDQPQLHYVPTVTREPFPTTERGSELFRSGLLSQRLGLPPPDPEQDRVMICGNPQMTREMTRFLKDTGWTLTTPRGLGNFTTEVAFVLHHG

SEQ ID NO: 107090 - DNA, 837 bp, Psychrobacter sp. 273-4
  CDS (1)..(837)
atgactatgagcgacaatattcaaaccgtaacagtgctaagcaaaaccacttggacaccaaatttatttagctttaccgtcagccgtcctgatagctttaaattcacggctgggcagttcgtacgcttgggcgttaatcccagtcagttaaattattataagcagcagaacgaagcaggtcatgatatcgccaatgaagcactaaacgaagatatttttcgtgcttactcgattgtctcgtcaccctttgatgaggtactagcatttttctctatcgttattcctgatggcgcttttacctcgcaactacaacatctgcaagtaggcgatgagttgctgcttaataccataccatttggctttttaaccttagcacggtatcaaaagccattaccaaaagatttgtggctgctggctactgggactggacttgcacctttcttatcaatgctgcaagatttaaagacatgggaagattacgagcatatcatcttggcgtatagcgcacgttcgatagaagagttggcgtacgttgagaagatagagagtctacaagaagactttggctccttagtcgataatcctgcaaaattaacctttataccgatcgttactcgtgagcctgtcgagggcgcattgactgaacgtctgccgaaacttctattagacggaacgctgcaagaacgtgcgggtattgccttagatatcgacagtacgcatgtcatgctctgtggtaatccagagatggtagaagatactaaagagactttaaagacattaggactggtaatgaatcgtcgcggcgaaggcaatattgcggtagaaaactactggtaa

SEQ ID NO: 107091 - protein, 278 aa, Psychrobacter sp. 273-4
MTMSDNIQTVTVLSKTTWTPNLFSFTVSRPDSFKFTAGQFVRLGVNPSQLNYYKQQNEAGHDIANEALNEDIFRAYSIVSSPFDEVLAFFSIVIPDGAFTSQLQHLQVGDELLLNTIPFGFLTLARYQKPLPKDLWLLATGTGLAPFLSMLQDLKTWEDYEHIILAYSARSIEELAYVEKIESLQEDFGSLVDNPAKLTFIPIVTREPVEGALTERLPKLLLDGTLQERAGIALDIDSTHVMLCGNPEMVEDTKETLKTLGLVMNRRGEGNIAVENYW

SEQ ID NO: 107092 - DNA, 777 bp, Pseudomonas fluorescens PfO-1
  CDS (1)..(777)
atgaccgccagcagcgaaaaattcagccgccagacactgctcgatgtgcaaccactgaccccgaacctgttcacgctgcgtaccacgcgggatacaggtttccgcttccgtgccggacaatttgcccggatcggcgtgacgcgcgaggatggaagtacggtgtggcgcgcctactcgatggtgtcttcgccgttcgacgaatttcttgaattcttttccatcgtggtgccgggtggtgaattcaccagtgaactgagccggctgaaagccggggataccttgctgatcgagcgccaggcctttggttatctgacgctggatcgcttcattgatggccgcgatctctggctgttatccaccggcacaggcgtggcgccgtttctgtcgatccttcaggacttcgaggtctgggagaagtttgaacgaatcattctggtctacagcgtgcgagaggcgcgggaactggcttatcagcagctgattgccgagctgactcagcgtgactacctggctgaatatgctcataagttccagttcatcccggtggttacccgtgaaccgtatgccggcgccctcaacgggcgcatcaccacgctgatcgaaaatggcgagctggagaatagggcaggcgtggagctgacgccggcgcattcgcgagtcatgctttgcggtaacccgcagatgatcgatgacacccgggccctgctcaagcaacgtggcatggccttgagtctgacccggcgaccggggcaggtcgcggtggaaaactactggtaa

SEQ ID NO: 107093 - protein, 258 aa, Pseudomonas fluorescens PfO-1
MTASSEKFSRQTLLDVQPLTPNLFTLRTTRDTGFRFRAGQFARIGVTREDGSTVWRAYSMVSSPFDEFLEFFSIVVPGGEFTSELSRLKAGDTLLIERQAFGYLTLDRFIDGRDLWLLSTGTGVAPFLSILQDFEVWEKFERIILVYSVREARELAYQQLIAELTQRDYLAEYAHKFQFIPVVTREPYAGALNGRITTLIENGELENRAGVELTPAHSRVMLCGNPQMIDDTRALLKQRGMALSLTRRPGQVAVENYW

SEQ ID NO: 107094 - DNA, 771 bp, Burkholderia fungorum LB400
  CDS (1)..(771)
atgagcaacctgaattcacaaaccgtcctgagcgtccatcactggaccgatacgcttttcagcttcacctgcacgcgcgatccgtcgttccgtttcgaaaacggccagttcacgatggtgggtctcgaagtcgacggcaagccgctgatccgcgcctacagcctcgcgagtgcgaactacgaagaacacctcgaattcctgagcatcaaggtgcaggacggcccgctcacgtcgcgtttgcagcatctgaaggtcggcgacgaagtcctgatcggcaagaagccggtcggcacgctggtggccgacaacctgctgccgggcaagacgctgtggctgctgtccaccggcacggggctggcgccgttcatgtcgatcatcaaggatcccgacatttacgaccgctacgagcgcgtcgtgctcacgcacacctgccgtttcgtcgacgaactggcgtacaaggaatacatcacggatcacctgccggcgcacgagcatctgggcgaactggtgcaggaaaagctgctgtactaccccaccgtcacgcgcgaagcgttccagaaccgcggccgcatcaccgaactgatcgaaaccgaaaagctgttcgccgacctcggcgtgccgggcttctcgctcgaaaacgaccgcgtcatgctgtgcggcagcccgcacatgctgcgcgacacgcgcaagctgctcgacgatctgggcttccaggaaggcagcaacaacgcgccgggtcactacgtggtcgaaaaagcgttcgttggctga

SEQ ID NO: 107095 - protein, 256 aa, Burkholderia fungorum LB400
MSNLNSQTVLSVHHWTDTLFSFTCTRDPSFRFENGQFTMVGLEVDGKPLIRAYSLASANYEEHLEFLSIKVQDGPLTSRLQHLKVGDEVLIGKKPVGTLVADNLLPGKTLWLLSTGTGLAPFMSIIKDPDIYDRYERVVLTHTCRFVDELAYKEYITDHLPAHEHLGELVQEKLLYYPTVTREAFQNRGRITELIETEKLFADLGVPGFSLENDRVMLCGSPHMLRDTRKLLDDLGFQEGSNNAPGHYVVEKAFVG

SEQ ID NO: 107096 - DNA, 750 bp, Shewanella baltica OS155
  CDS (1)..(750): transl_table=11
atgtggactaggggacaagttatagaacgtattgattggagcgataagttattttcattgcgcatcgccgccgagttagccccatttattcctggtcagtttatcaagttaagtcaaatgcaagatgataagcgtgtggccagagcttactccttagtaaattcccccgataaaccctatgccgaagtgctcgccgttgcggtagaggacggcctgttatcgccgcaattacacaaccttgtcataggcgatgaaatagaaattacctcaaccgcgaccggtttcatgaccttagcggaaattcctaagggtgagctccaaggcaagcacttatggtttttggccacaggtacagcggtagggccatttttgtctatgctcgacacccatgaaccttgggagcgttttgaaaaagtggtgcttgtgtatggcgtgcgcgaggcgcaggatttggcgtatcttgataagctgcgtgagttagaacgcacatacccagcacagtttatattagttttgagtgtgacccgtgaacccttggccgatgcgttgcagtgtcgtattcccgagggcatagtctcgggtgaaatcgaacaaaaggcaggattaaccttaagtgccgctgattcccaagtcatgatttgcggcaatcccggtatgattaatggtgcacaaagtgccttactcgataagggattagtgaagaacttacgtcgtgctccgggacaaattaccgtagaaaaatattggtga

SEQ ID NO: 107097 - protein, 249 aa, Shewanella baltica OS155
MWTRGQVIERIDWSDKLFSLRIAAELAPFIPGQFIKLSQMQDDKRVARAYSLVNSPDKPYAEVLAVAVEDGLLSPQLHNLVIGDEIEITSTATGFMTLAEIPKGELQGKHLWFLATGTAVGPFLSMLDTHEPWERFEKVVLVYGVREAQDLAYLDKLRELERTYPAQFILVLSVTREPLADALQCRIPEGIVSGEIEQKAGLTLSAADSQVMICGNPGMINGAQSALLDKGLVKNLRRAPGQITVEKYW

SEQ ID NO: 107098 - DNA, 783 bp, Shewanella amazonensis SB2B
  CDS (1)..(783): transl_table=11
atgctggaactgcagccacagagtaggggaggcgatatgtgggttgaaggccgggtgttgcagcgaagggattggaccgacaagttgttcagtctcaggattgacgccaaaatagcgccctttatcgcgggccagtttatcaaactcagtttacccagcgaggataagcgcattgcccgtgcttattctctggttaaccctcccagaaccgattatatcgaggtgctggccgttgccgttgaagagggcgagctctctccaaggctgcaggacttaagccctggtgatgtacttcaggtttcggccagtgcaaccggctttttaaccttgaatgaattacccgacgctcctgcagctgggcgtcagctttggatgctggccacaggcaccgccgttggcccctttatttccatgcttggcaccgaggagccctggcaaaggtttgaacacctggtgcttgtgtatggggttcgccgggctgaggatttggcttatcttgacgagttgcaagccctggcagcaagcaggcccggactgcagctcatcttatcggttacccgggagtcagtacccggagccatgcaactgaggatacccgatgcgttggcctctggcgcgctcgaagctgccagcggccttacattgtctgccgagcattctcaggtgatgatttgtggtaaccccgagatggttgcaagcacccaggcattgttgctggaacgtggtcttagtaaaaaccttcgcagggcacccgggcaaatcaccgtggaaaaatactggtaa

SEQ ID NO: 107099 - protein, 260 aa, Shewanella amazonensis SB2B
MLELQPQSRGGDMWVEGRVLQRRDWTDKLFSLRIDAKIAPFIAGQFIKLSLPSEDKRIARAYSLVNPPRTDYIEVLAVAVEEGELSPRLQDLSPGDVLQVSASATGFLTLNELPDAPAAGRQLWMLATGTAVGPFISMLGTEEPWQRFEHLVLVYGVRRAEDLAYLDELQALAASRPGLQLILSVTRESVPGAMQLRIPDALASGALEAASGLTLSAEHSQVMICGNPEMVASTQALLLERGLSKNLRRAPGQITVEKYW

SEQ ID NO: 107100 - DNA, 762 bp, Shewanella denitrificans OS-217
  CDS (1)..(762): transl_table=11
atgtggactcagggcctagttgttgctcgtcgagactggaacgataaattatttaccttatccattaaggctgagattgccccttttatagcagggcaatttattaaactgagtcaggtacttgccgataaacgtgtcgctagggcttactctatcgtgagtgctcccgatgctgagctgcttgaagtcttggctatcaaagtggaagcgggtcaattgtcacccgccttgcatcaacttgcaattggagatgcgataaccgtcagcactaaggcggcaggctttttaaccttagacgaactgcctcaatcggctgattacagcaacctctggttcttggcgacgggcacaggtgtcgggccgtttatttccatgctgcgcacccaggcaccttggcttaagtatgaaaaaattatcttagtctatggcgttagttatcagacagatattgcctatcatgatgttatccagcagcttttgctgcaataccctaaacagttcgtatttattcccatggtgacgcgggatcctgaggcgagtgtgagcatggccaatgcattgcattgccgtattcctcaaggattagtctctggtgagttagaaacacgggctcaagtggatattaacccccaaagttcacaagtgatgatttgcggtaatccagagatgatatctgaagtgcaaaccttattacttgaaagagggctcagtaagaatttacgccgcgctcccggtcaaattaccttagaaaaatattggtaa

SEQ ID NO: 107101 - protein, 253 aa, Shewanella denitrificans OS-217
MWTQGLVVARRDWNDKLFTLSIKAEIAPFIAGQFIKLSQVLADKRVARAYSIVSAPDAELLEVLAIKVEAGQLSPALHQLAIGDAITVSTKAAGFLTLDELPQSADYSNLWFLATGTGVGPFISMLRTQAPWLKYEKIILVYGVSYQTDIAYHDVIQQLLLQYPKQFVFIPMVTRDPEASVSMANALHCRIPQGLVSGELETRAQVDINPQSSQVMICGNPEMISEVQTLLLERGLSKNLRRAPGQITLEKYW

SEQ ID NO: 107102 - DNA, 750 bp, Shewanella frigidimarina NCIMB 400
  CDS (1)..(750): transl_table=11
atgtggattaccggtaccgtgctaaaacgcattgattggaatgataaattattctcgttgcgtatcaaagccgatgtcgaaccttttatcgcaggtcagtttattaagcttagccaaatgcgtgatgataaacgtgtcgcgcgggcgtattcgcttgtcaatccaccagggactgattatgtcgaagtgctggctgttgcggtagaggatggtcagttatcgccagatctaaaagcattaagccctggtgataccattcaagtcacgcctaaagcgaccggttttatgactttagatgaagtgcctaaaggggcattgcaaggcaagcacttatggctgttagcgacaggcactgcagtgggtccatttatctctatgcttgcaaccgatgagccatggcaacgctttgaaaaagtcgtgttagtttatggtgtaaggcttggtgaagatttagcttatttagaaacgattaaacagtttattagccaacatcctcttcagtttgtgtttattccaattgtgacccgtgaagattatcccgaaggcttatcatgtcgcattcctgatggtattagcagcggattaattgaacagaaagcaggcttagggattaatgcagaacattctcaagtgatgatttgtggtaaccctggaatgataagtgatgcgcaaaccgctttggttgaaaaaggcttagcaaaaaatcttcgacgagcgccagggcaaattacggtcgaaaaatactggtaa

SEQ ID NO: 107103 - protein, 249 aa, Shewanella frigidimarina NCIMB 400
MWITGTVLKRIDWNDKLFSLRIKADVEPFIAGQFIKLSQMRDDKRVARAYSLVNPPGTDYVEVLAVAVEDGQLSPDLKALSPGDTIQVTPKATGFMTLDEVPKGALQGKHLWLLATGTAVGPFISMLATDEPWQRFEKVVLVYGVRLGEDLAYLETIKQFISQHPLQFVFIPIVTREDYPEGLSCRIPDGISSGLIEQKAGLGINAEHSQVMICGNPGMISDAQTALVEKGLAKNLRRAPGQITVEKYW

SEQ ID NO: 107104 - DNA, 588 bp, Rhodocyclus gelatinosus
  CDS (1)..(588): transl_table=11
atgctcgagttcctcagcatcaaggtgcccaacggcccgctgacctcgcggctgcagcacatccaggtgggcgacagcatcatcgtcggccgcaagcccaccggcacgctgctgatcgactacctgctgcccggcaagcgcctgtacctgttctcgaccggcaccgggctggccccgttcatgtcgatcatccgcgacccggagacctacgagaagttcgagaaggtcttcctcgtgcacggcgtgcgccaggtcgacgagctggcctatcacgacctgctcacgcgcaacctccccgagcacgagttcctcggcgagatgatccagagccagctgctgtactacccgacggtgacgcgcgagaactaccacaaccgcggccgcatcaccgagctgatccagtcgggcaagatgttcgacgacctggacctgccgatgctcgacccgatccaagaccgggtgatgatctgcggcagcccggcgatgctgcgggatctgaagcacatgctcgaaggcatgcgcttcaaggaaggcaacacgacgacgccgggcgatttcgtcatcgagcgcgcgttcgccgaccagtga

SEQ ID NO: 107105 - protein, 195 aa, Rhodocyclus gelatinosus
MLEFLSIKVPNGPLTSRLQHIQVGDSIIVGRKPTGTLLIDYLLPGKRLYLFSTGTGLAPFMSIIRDPETYEKFEKVFLVHGVRQVDELAYHDLLTRNLPEHEFLGEMIQSQLLYYPTVTRENYHNRGRITELIQSGKMFDDLDLPMLDPIQDRVMICGSPAMLRDLKHMLEGMRFKEGNTTTPGDFVIERAFADQ

SEQ ID NO: 107106 - DNA, 678 bp, Buchnera aphidicola
  CDS (1)..(678): transl_table=11
atgcaagcacctattaataaatttatagccggacaatttactaaactttcttatataaaaaaaaataaaaaaagaatacaaagagcgtattcatttgttaatagtccaaatagtaaaaatttagaattctatatcttattaattaaaaatgggttattaacaccaaaattatatgatataaaaaataataaaatttttatttcaaaaaattcctttggtttttttactatttcagaattacctaaaaaagaaaatttatggatgattgctactggtacagcaataggtccttattgttctattttaaaatatgaaaatatattaaaaaaatttaaaaaaatcatattaatacatgcagttaaatatagtattgatttaaattatttaaatttatttaaaaaaataaaaaaaaaatataaaaaaaacataaaaataaaaataatattaagtcaagaaaaaagaaaagattatttatttggtcgtataccgaatttaattgcatctggagaattagaaaaatcagtcaaagaaccattaaattctaaaaattcacatgtaatgttatgcggaaatcctaatatgattaaagatacacaaaaaatattattacagtataaaaaaatgaaaaaacatttccgtaaaaatcctggacatataactagggaaaattactggtaa

SEQ ID NO: 107107 - protein, 225 aa, Buchnera aphidicola
MQAPINKFIAGQFTKLSYIKKNKKRIQRAYSFVNSPNSKNLEFYILLIKNGLLTPKLYDIKNNKIFISKNSFGFFTISELPKKENLWMIATGTAIGPYCSILKYENILKKFKKIILIHAVKYSIDLNYLNLFKKIKKKYKKNIKIKIILSQEKRKDYLFGRIPNLIASGELEKSVKEPLNSKNSHVMLCGNPNMIKDTQKILLQYKKMKKHFRKNPGHITRENYW

SEQ ID NO: 107108 - DNA, 1020 bp, Burkholderia sp
  CDS (1)..(1020): transl_table=11
atgtttcgctcaattgctttgcggttcgaggacgatgttacatacttcatcacgtcgtctgaaaacgaaactgtagccgacgccgcataccagcaaggcatcagtatccccctcgattgcagaaacggagtgtgtgggacctgtaagggtttctgtgagcgcggggagtatgacggcggtgactatagcgaggacgccctcagcgccgatgaggcgcgcgagggttttgtgctcccttgccagatgcgggcgcgcactgactgcgtgatacggatcctcgcgtcgtcttcggcctgccaggtcaagaaatcgaccatgacgggccaactaacggagatcgaccgtggtagctcgtccacgctgcagttcacgctggcaattgatccttcctcgaaggtggattttctaccggggcagtacgcgaagctccgtattccggggaccacggagtcacgtgcatattcgtacagctccaagcctggaagtagccatgcgacctttctggttcgtgacgtgccgaacgggaaaatgagcggatacctccgggatcaagcgacgatcaccgaaacctttgagtttgacgggccatacggcgcgttctatctccgggagccagtacgcccgatcctaatgctcgcaggtggcaccggactggctccgtttctgtcgatgctgcagtatatggcgagcttggaacgcaatgacctgccgtcggtccggcttgtttacggtgtcaatcgtgacgacgatcttgtcggtttacataaactcgataagctggcaacgcagctttcaggtttcagctatatcacgaccgtcgtggatgagaccagcgctcaaccgcggcgtggatatgtgacgcaacagatcacgaaagacgacatgaatggtggggacgtcgatatctacgtgtgcgggccacctcccatggtcgaggcggttcgcagctggctggtggctgagaaactgaaccccgtcaatttctacttcgagaagttcgccccaacagttggcgactag

SEQ ID NO: 107109 - protein, 339 aa, Burkholderia sp
MFRSIALRFEDDVTYFITSSENETVADAAYQQGISIPLDCRNGVCGTCKGFCERGEYDGGDYSEDALSADEAREGFVLPCQMRARTDCVIRILASSSACQVKKSTMTGQLTEIDRGSSSTLQFTLAIDPSSKVDFLPGQYAKLRIPGTTESRAYSYSSKPGSSHATFLVRDVPNGKMSGYLRDQATITETFEFDGPYGAFYLREPVRPILMLAGGTGLAPFLSMLQYMASLERNDLPSVRLVYGVNRDDDLVGLHKLDKLATQLSGFSYITTVVDETSAQPRRGYVTQQITKDDMNGGDVDIYVCGPPPMVEAVRSWLVAEKLNPVNFYFEKFAPTVGD

SEQ ID NO: 107110 - DNA, 1505 bp, Azotobacter vinelandii
  CDS (454)..(1230)
gcaggtcaacggatcagcagggtcgccaggtagttgcccacggtcagcgtggcgcccacggccagcgagccgaagccttcctttccgtcgagcagattctcgatttcccgcgcctggttgagcagcgccaccgcctggggcagcagttgccggcccagggcgttgagcttcaggcgcttgccgacgcgatcgaagagctggcagtccgattggcgctcgagttcggtcagcgaggtgctggccgcggactgggagagggagagggattcggccgcgcgggtgacactttccagacgggccacggcggcgaatacctcaagctggcgcagagtgaatcgcatatctatataactgattatccatatcgcgataatttacttaacagatagtttgccggctcctagaatgcacgacaaccataccgccaggcagcaccgtccgaaggagcaccgaatgagcaatctgaacgtagagcgtgtcctcagtgttcatcactggaacgataccctgttcagtttcaagaccacccgcaaccccagcctgcgtttcgaaaacggccaattcgtgatgatcggtctggaggtcgatggacgtcccctgatgcgggcctacagcattgccagcccgaattacgaggaacatctggagttcttcagcatcaaggtacagaacggtccgctcacttcgcgcctgcaacacctgaaggagggcgacgaactgatggtcagccgcaagcccaccggcaccctggtgaccagcgacctgctgcccggcaagcatctttacatgctcagcaccggtaccggactcgcgcctttcatgagcctgatccaggacccggaggtctacgagcgcttcgagaaggtggtgctgatccatggtgtgcgtcaggtcaacgaactggcctatcagcagttcatcaccgagcacctgccgcagagcgagtatttcggtgaggcggtcaaggaaaagctgatctactacccgacggtcacccgcgagtccttccacaaccagggacgtctcaccgacctgatgcgcagcggcaagctgttcgaggatatcggtctgccgccgatcaacccgcaggacgatcgcgcgatgatctgcggcagcccgagcatgctcgacgagagttgcgaagtgctggacggattcggcctgaagatctctccgcgcatgggcgagccgggcgactatctgatcgagcgcgccttcgtcgaaaaataagcgcgcctccctctcgcgaagcccggcctgtccgggcttcttcgctttcggcggcggctcaggccggcagcacttccagcacgcggattcgtcccggccgcgggtagtgccagcgcacttccacgtcccagaagcgcacgccgtagcggcgcgaaggttccggtacctgataggcggggcgtgggtcctgggccaggcactgtccgatcaactcgaccagcggctcgccgagacgagcgcatgcgcctgtgcctgcagcgtgccggttcgctcca

SEQ ID NO: 107111 - protein, 258 aa, Azotobacter vinelandii
MSNLNVERVLSVHHWNDTLFSFKTTRNPSLRFENGQFVMIGLEVDGRPLMRAYSIASPNYEEHLEFFSIKVQNGPLTSRLQHLKEGDELMVSRKPTGTLVTSDLLPGKHLYMLSTGTGLAPFMSLIQDPEVYERFEKVVLIHGVRQVNELAYQQFITEHLPQSEYFGEAVKEKLIYYPTVTRESFHNQGRLTDLMRSGKLFEDIGLPPINPQDDRAMICGSPSMLDESCEVLDGFGLKISPRMGEPGDYLIERAFVEK

SEQ ID NO: 107112 - DNA, 759 bp, Buchnera aphidicola subsp
  CDS (1)..(759): transl_table=11
atgaatccatggattaatgcagacgttttgatggtaaaaaaatggactaaaaatttattcagtcttattttaaatgctcctatagaacctttttttgcaggacaatttaataaattagctctatataacagtaatcctttaaataaaaataaaattcagagggcatactcatatgttaacgctcctagtgaaaaaaacttagaaatttatattgttcgtgtgctcaatggacaactaagcaatctactatataatcttcatagtggcgataaaatttttatcaaaaaaaaatcatttggtttttttattatagatgaaataccagattgcgaaatactatggatgttcgctacaggcactggaataggtccctattgttcaattttacaagaaggaaaaaatattaatagatttaatcatattattttaacacatgcagtacgatatcaaaatgaactaacttatttaccactcatgaaagaattacgtcagaaatataatggaaaattacaaattcaaactattactagtagagaaaaacataaaaattctttaaatggaagaattccttttttattaagaaataaaatattagaaaaacatgttggtttttcaataaaccctcagacttcacatgttatgttatgtggaaatccttttatggtaaaagatacgtttttatttttaaaaaataatagaaatatggaaaagcatttacgtcgaaaaaaaggacatattaccatggaaaattattggtaa

SEQ ID NO: 107113 - protein, 252 aa, Buchnera aphidicola subsp
MNPWINADVLMVKKWTKNLFSLILNAPIEPFFAGQFNKLALYNSNPLNKNKIQRAYSYVNAPSEKNLEIYIVRVLNGQLSNLLYNLHSGDKIFIKKKSFGFFIIDEIPDCEILWMFATGTGIGPYCSILQEGKNINRFNHIILTHAVRYQNELTYLPLMKELRQKYNGKLQIQTITSREKHKNSLNGRIPFLLRNKILEKHVGFSINPQTSHVMLCGNPFMVKDTFLFLKNNRNMEKHLRRKKGHITMENYW

SEQ ID NO: 107114 - DNA, 774 bp, Buchnera aphidicola subsp
  CDS (1)..(774): transl_table=11
atgaatccatggattaatgctaatgttttaaaagttcacaagtggactcaaaatttgttcagtcttattttaaacgcagagattgctccttttcaagcaggacaatttacaaaattagctttaaatgaagaaaacataaatttttctaataatgttaaaaagaaaaaaattcaaagagcatattcgtttgttaatgctccaagtaataaaaatttggaaatttatattgttcgaatacttaatggtaaattaagtaatcttttatataatttaaaatctggagataatttatttattaaagaaaaatcatttggtttttttactttagatgaaatacctaattgtaaaacattatggatgtttgctactggtactggaataggtccttattgttctatactacaagaatataaaaatattaatagatttaaaaatatcatattaatacatgctgtaagatatcaaaacgaattaacctatcttcctttaatgaagcaactttataaaagttataatggaaaattaaagattgaaacaatagtaagtagagaaaaaaatcataattcattatatggaagaatccctcttttattacaaaatcaaattttagaaaaaaaaattggtttaaaaattaatcgcaatgattcacatgttatgttgtgtggaaatccagctatggtaaaagatacatatcttttcttacaaaaagatcgatgtatgcaaaaaaatttacgacgtaaacatggtcatattacaatggaaaattattggtaa

SEQ ID NO: 107115 - protein, 257 aa, Buchnera aphidicola subsp
MNPWINANVLKVHKWTQNLFSLILNAEIAPFQAGQFTKLALNEENINFSNNVKKKKIQRAYSFVNAPSNKNLEIYIVRILNGKLSNLLYNLKSGDNLFIKEKSFGFFTLDEIPNCKTLWMFATGTGIGPYCSILQEYKNINRFKNIILIHAVRYQNELTYLPLMKQLYKSYNGKLKIETIVSREKNHNSLYGRIPLLLQNQILEKKIGLKINRNDSHVMLCGNPAMVKDTYLFLQKDRCMQKNLRRKHGHITMENYW

SEQ ID NO: 107116 - DNA, 750 bp, Buchnera aphidicola subsp
  CDS (1)..(750): transl_table=11
atgaatacttggataacagctaaaattattaaaattaaaaaatggaaaaataacttatttagcgtaatcgttaacgctccaatatccccctttactgctggacaatttactaaattaggttatcaaaaaaaaaatggaaaaataatacaaagagcatattcttttgtaaatgctcctcatgaaaaaaatttagaattttacatggtcttaattaaaaatggacaattaactactaaactctacaatttaaataatacagaccatattcaaattaaaaaaaaatcatatggtttttttacactaaatgaaattcctacttgcaaaatattatggatgtttgcaactggaacaggtattggtccttatttatcaatgttaaaataccaaaaaaacactgaaaaatttcaaaaaattgtattgatacatgctgttcgttatagacatgatcttacatattttaacgaaataaacaatttaaaaaatatttataataaaaaactatatacgcaatttataataagcagagaaaaaactaatttttcactttccggaaggatacctcaattgttaaaaacagaagaactagaaaaacacattaatttatttattgaaaacaatacctcacatgttatgttatgcggaaatccagatatggtaaaacagacacaaaattttcttataaataataaaaacatgaaaaaacatcttagaagaaaaccaggacaaatttctagcgaaaattactggtag

SEQ ID NO: 107117 - protein, 249 aa, Buchnera aphidicola subsp
MNTWITAKIIKIKKWKNNLFSVIVNAPISPFTAGQFTKLGYQKKNGKIIQRAYSFVNAPHEKNLEFYMVLIKNGQLTTKLYNLNNTDHIQIKKKSYGFFTLNEIPTCKILWMFATGTGIGPYLSMLKYQKNTEKFQKIVLIHAVRYRHDLTYFNEINNLKNIYNKKLYTQFIISREKTNFSLSGRIPQLLKTEELEKHINLFIENNTSHVMLCGNPDMVKQTQNFLINNKNMKKHLRRKPGQISSENYW

SEQ ID NO: 107118 - DNA, 21 bp, Artificial sequence
  primer
atggctgattgggtaacaggc

SEQ ID NO: 107119 - DNA, 23 bp, Artificial sequence
  primer
ttaccagtaatgctccgctgtca

SEQ ID NO: 107120 - protein, 329 aa, Artificial sequence
  Variant (2)..(3): xaa in position 2 to 3 is any amino acid
  Variant (5)..(6): xaa in position 5 to 6 is any amino acid
  Variant (8)..(10): xaa in position 8 to 10 is any amino acid
  Variant (11)..(12): xaa in position 11 to 12 is any or no amino acid
  Variant (16)..(24): xaa in position 16 to 24 is any amino acid
  Variant (25)..(25): xaa in position 25 is any or no amino acid
  Variant (27)..(28): xaa in position 27 to 28 is any amino acid
  Variant (32)..(33): xaa in position 32 to 33 is any amino acid
  Variant (37)..(40): xaa in position 37 to 40 is any amino acid
  Variant (41)..(62): xaa in position 41 to 62 is any or no amino acid
  Variant (64)..(64): xaa in position 64 is any amino acid
  Variant (69)..(77): xaa in position 69 to 77 is any amino acid
  Variant (78)..(93): xaa in position 78 to 93 is any or no amino acid
  Variant (97)..(98): xaa in position 97 to 98 is any amino acid
  Variant (100)..(100): xaa in position 100 is any amino acid
  Variant (102)..(103): xaa in position 102 to 103 is any amino acid
  Variant (105)..(106): xaa in position 105 to 106 is any amino acid
  Variant (107)..(114): xaa in position 107 to 114 is any or no amino acid
  Variant (116)..(117): xaa in position 116 to 117 is any amino acid
  Variant (119)..(120): xaa in position 119 to 120 is any amino acid
  Variant (122)..(122): xaa in position 122 is any amino acid
  Variant (123)..(123): xaa in position 123 is any or no amino acid
  Variant (126)..(126): xaa in position 126 is any amino acid
  Variant (128)..(128): xaa in position 128 is any amino acid
  Variant (130)..(134): xaa in position 130 to 134 is any amino acid
  Variant (136)..(145): xaa in position 136 to 145 is any amino acid
  Variant (146)..(151): xaa in position 146 to 151 is any or no amino acid
  Variant (169)..(176): xaa in position 169 to 176 is any amino acid
  Variant (177)..(181): xaa in position 177 to 181 is any or no amino acid
  Variant (183)..(184): xaa in position 183 to 184 is any amino acid
  Variant (188)..(188): xaa in position 188 is any amino acid
  Variant (190)..(191): xaa in position 190 to 191 is any amino acid
  Variant (193)..(195): xaa in position 193 to 195 is any amino acid
  Variant (198)..(198): xaa in position 198 is any amino acid
  Variant (200)..(202): xaa in position 200 to 202 is any amino acid
  Variant (204)..(216): xaa in position 204 to 216 is any amino acid
  Variant (217)..(230): xaa in position 217 to 230 is any or no amino acid
  Variant (235)..(238): xaa in position 235 to 238 is any amino acid
  Variant (239)..(249): xaa in position 239 to 249 is any or no amino acid
  Variant (252)..(253): xaa in position 252 to 253 is any or no amino acid
  Variant (256)..(257): xaa in position 256 to 257 is any amino acid
  Variant (259)..(259): xaa in position 259 is any amino acid
  Variant (261)..(267): xaa in position 261 to 267 is any amino acid
  Variant (268)..(270): xaa in position 268 to 270 is any or no amino acid
  Variant (272)..(277): xaa in position 272 to 277 is any amino acid
  Variant (278)..(278): xaa in position 278 is any or no amino acid
  Variant (283)..(283): xaa in position 283 is any amino acid
  Variant (285)..(285): xaa in position 285 is any amino acid
  Variant (288)..(288): xaa in position 288 is any amino acid
  Variant (290)..(292): xaa in position 290 to 292 is any amino acid
  Variant (293)..(305): xaa in position 293 to 305 is any or no amino acid
  Variant (307)..(315): xaa in position 307 to 315 is any amino acid
  Variant (316)..(320): xaa in position 316 to 320 is any or no amino acid
  Variant (322)..(325): xaa in position 322 to 325 is any amino acid
  Variant (327)..(328): xaa in position 327 to 328 is any amino acid
VXXVXXWXXXXXLFSXXXXXXXXXXFXXGQFXXIGLXXXXXXXXXXXXXXXXXXXXXXXXXXLXRAYSXXXXXXXXXXXXXXXXXXXXXXXXXLEFXXIXVXXGXXXXXXXXXXTXXLXXLXXGDXIXVXXXXXGXXXXXXXXXXXXXXXXLWLLATGTGLAPFLSILXXXXXXXXXXXXXFXXVILXHXXRXXXELXYXXXIXXXXXXXXXXXXXXXXXXXXXXXXXXXVTREXXXXXXXXXXXXXXXRIXXLIXXGXLXXXXXXXXXXLXXXXXXXMLCGXPXMLXDXXXXXXXXXXXXXXXXLXXXXXXXXXXXXXXGXXXXEXXF

SEQ ID NO: 107121 - protein, 23 aa, Artificial sequence
  Variant (2)..(10): xaa in position 2 to 10 is any amino acid
  Variant (11)..(12): xaa in position 11 to 12 is any or no amino acid
  Variant (14)..(14): xaa in position 14 is any amino acid
  Variant (15)..(15): xaa in position 15 is Ala, Asn or Ser
  Variant (17)..(17): xaa in position 17 is any amino acid
  Variant (19)..(20): xaa in position 19 to 20 is any amino acid
  Variant (21)..(22): xaa in position 21 to 22 is any or no amino acid
FXXXXXXXXXXXFXXGXFXXXXL

SEQ ID NO: 107122 - protein, 8 aa, Artificial sequence
  Variant (5)..(5): xaa in position 5 is Phe, Ile, Leu, Met or Val
  Variant (6)..(6): xaa in position 6 is Ala, Cys or Val
  Variant (7)..(7): xaa in position 7 is Asn or Ser
  Variant (8)..(8): xaa in position 8 is Ala, Pro, Ser or Thr
RAYSXXXX

SEQ ID NO: 107123 - protein, 54 aa, Artificial sequence
  Variant (2)..(2): xaa in position 2 is any amino acid
  Variant (3)..(3): xaa in position 3 is Phe, Leu, Met or Val
  Variant (4)..(4): xaa in position 4 is Ser or Thr
  Variant (5)..(6): xaa in position 5 to 6 is any amino acid
  Variant (7)..(7): xaa in position 7 is Phe, Leu or Met
  Variant (8)..(12): xaa in position 8 to 12 is any amino acid
  Variant (13)..(13): xaa in position 13 is Asp, Gly or Thr
  Variant (14)..(14): xaa in position 14 is Asp, Gly, Asn, Gln or Ser
  Variant (15)..(15): xaa in position 15 is any amino acid
  Variant (16)..(16): xaa in position 16 is Ile, Leu or Val
  Variant (17)..(17): xaa in position 17 is any amino acid
  Variant (18)..(18): xaa in position 18 is Ile, Leu, Met or Val
  Variant (19)..(21): xaa in position 19 to 21 is any amino acid
  Variant (22)..(22): xaa in position 22 is Ala, Asn, Pro, Ser or Thr
  Variant (23)..(23): xaa in position 23 is any amino acid
  Variant (25)..(25): xaa in position 25 is any amino acid
  Variant (26)..(27): xaa in position 26 to 27 is any or no amino acid
  Variant (29)..(36): xaa in position 29 to 36 is any amino acid
  Variant (37)..(38): xaa in position 37 to 38 is any or no amino acid
  Variant (40)..(40): xaa in position 40 is any amino acid
  Variant (41)..(41): xaa in position 41 is Phe, Leu or Met
  Variant (42)..(42): xaa in position 42 is Phe, Ile or Leu
  Variant (43)..(43): xaa in position 43 is Ala, Cys, Gly or Ser
  Variant (44)..(44): xaa in position 44 is Ser or Thr
  Variant (46)..(46): xaa in position 46 is Ser or Thr
  Variant (47)..(47): xaa in position 47 is Ala or Gly
  Variant (48)..(48): xaa in position 48 is Ile, Leu, Met or Val
  Variant (49)..(49): xaa in position 49 is Ala, Gly or Ser
  Variant (50)..(50): xaa in position 50 is Ala or Pro
  Variant (51)..(51): xaa in position 51 is Phe, Trp or Tyr
  Variant (52)..(52): xaa in position 52 is any amino acid
  Variant (54)..(54): xaa in position 54 is Ile, Leu, Met or Val
GXXXXXXXXXXXXXXXXXXXXXXGXXXLXXXXXXXXXXLXXXXXGXXXXXXXSX

SEQ ID NO: 107124 - protein, 39 aa, Artificial sequence
  Variant (2)..(2): xaa in position 2 is Ile, Leu or Val
  Variant (5)..(5): xaa in position 5 is Gly, Asn or Ser
  Variant (6)..(7): xaa in position 6 to 7 is any amino acid
  Variant (9)..(10): xaa in position 9 to 10 is any amino acid
  Variant (11)..(11): xaa in position 11 is Asp, Glu, Gly, Gln or Ser
  Variant (12)..(15): xaa in position 12 to 15 is any amino acid
  Variant (17)..(22): xaa in position 17 to 22 is any amino acid
  Variant (23)..(30): xaa in position 23 to 30 is any or no amino acid
  Variant (32)..(35): xaa in position 32 to 35 is any amino acid
  Variant (37)..(38): xaa in position 37 to 38 is any amino acid
  Variant (39)..(39): xaa in position 39 is Phe or Trp
MXCGXXXMXXXXXXXLXXXXXXXXXXXXXXGXXXXEXXX

SEQ ID NO: 107125 - DNA, 453 bp, Escherichia coli K12
  CDS (1)..(453): transl_table=11
atgcacgcagataccgcgacccgccagcactggatgtccgtgctggcgcacagccaaccggctgaactggcagcacgcctgaacgcgctaaacatcaccgccgactatgaggtgatccgcgccgctgaaactggcctggtacagattcaggcgcggatgggcggcaccggcgaacgtttttttgccggcgacgccacgctgacccgcgccgccgtgcgcctgactgacggcacgctcggctacagctgggtgcaggggcgtgataaacagcacgccgaacgctgcgcgctgattgacgcgctgatgcagcaatctcgccactttcaaaacttatcagaaacccttattgccccgctggacgctgaccgtatggcacgcattgccgcacgccaggccgaagtgaacgccagccgggtcgacttctttacgatggttcgcggagacaacgcatga

SEQ ID NO: 107126 - protein, 150 aa, Escherichia coli K12
MHADTATRQHWMSVLAHSQPAELAARLNALNITADYEVIRAAETGLVQIQARMGGTGERFFAGDATLTRAAVRLTDGTLGYSWVQGRDKQHAERCALIDALMQQSRHFQNLSETLIAPLDADRMARIAARQAEVNASRVDFFTMVRGDNA

SEQ ID NO: 107127 - DNA, 465 bp, Mesorhizobium loti MAFF303099
  CDS (1)..(465): transl_table=11
atgcaagccgagtcggttgccattgcaaagcgctccgaatggctcgggattttgtcccgcagtgttggcagcgagcttaaggccttggcggccgacttggtgcgcggcgtgatctttgaatggcttcgcactcccaatgtcggcctggtgatggttcggggccgtgccggtgggacgggaaatgtgttcaacctcggcgagatgacggtcgcccgcgcctcggtccaactcaaagaggggacggttggccacggttacgtccagggacgtgacaagcgccaggcagaactggcagccatcgtcgatgcgctgttgcagcaaccggaccgccatgacgagatcataaccaaggtaatcgagccgctgcgccaaaaagccgaagtgcggcggatggagaaaagccgcaaggccgcatccaccaaagtcgatttcttcaccatggtgcgcggggaggatctgccgtga

SEQ ID NO: 107128 - protein, 154 aa, Mesorhizobium loti MAFF303099
MQAESVAIAKRSEWLGILSRSVGSELKALAADLVRGVIFEWLRTPNVGLVMVRGRAGGTGNVFNLGEMTVARASVQLKEGTVGHGYVQGRDKRQAELAAIVDALLQQPDRHDEIITKVIEPLRQKAEVRRMEKSRKAASTKVDFFTMVRGEDLP

SEQ ID NO: 107129 - DNA, 465 bp, Mesorhizobium loti MAFF303099
  CDS (1)..(465): transl_table=11
atggaagcggagcagcttgccatcgcagagcgctccgactggcttggtatcctgtcgcgcagtgttagcagtgagcttgaggccttggcggctgacctggcgaccggagtggcatttgaatggctgaggacttgcgatgtcggcctggtgatggtccgggggcgtgctggtggtacgggcaacgtgttcaatctcggcgagatgaccgtcacccgcgcctcggtccggcttgaagacggcactgtcgggcacggttacgtccagggccgcaacaagcgccaggcggagctggcggctatcatcgatgcgctgttgcagcagccggaccgccatgacgagaccatggcgaaggtggtcgagccgcttcgggaaaaagccgaagtccggcggctcgaaaaaagccgcaaggcggcagccaccaaggtcgagttcttcaccatggttcgcggggaggacccagcgtga

SEQ ID NO: 107130 - protein, 154 aa, Mesorhizobium loti MAFF303099
MEAEQLAIAERSDWLGILSRSVSSELEALAADLATGVAFEWLRTCDVGLVMVRGRAGGTGNVFNLGEMTVTRASVRLEDGTVGHGYVQGRNKRQAELAAIIDALLQQPDRHDETMAKVVEPLREKAEVRRLEKSRKAAATKVEFFTMVRGEDPA

SEQ ID NO: 107131 - DNA, 462 bp, Mesorhizobium loti MAFF303099
  CDS (1)..(462): transl_table=11
atgcgaggacaggaagcccgcgaccaggccgaacgcaaggccgccatggcgacgctggcgcaatcgagcggcgacgacatcgtccggctctggaacgaggccggcctgccgtcgcaagccgagctgctgcgcggccccgagaccgggctggtgacgctgcgcggccgcatcggcggcggcggcgcgccgttcaatatcggcgaggcgaccgtcacccgcgccaccgtccggttgccatccggacaggtcggccattgctacgcgcttggccgcgacaagcagaaggcgaagctggcggcgatagccgacgcgctctggcaggaccctgcccgccgcgccgaggtcgagaccaggctgatcgcgcctttgaggtcggcgatcgccactgcccaggaaaaacgccgtgccgagacggcggcaacgaaggtggatttcttaaccatggttcgcggagaagactga

SEQ ID NO: 107132 - protein, 153 aa, Mesorhizobium loti MAFF303099
MRGQEARDQAERKAAMATLAQSSGDDIVRLWNEAGLPSQAELLRGPETGLVTLRGRIGGGGAPFNIGEATVTRATVRLPSGQVGHCYALGRDKQKAKLAAIADALWQDPARRAEVETRLIAPLRSAIATAQEKRRAETAATKVDFLTMVRGED

SEQ ID NO: 107133 - DNA, 459 bp, Pseudomonas aeruginosa PAO1
  CDS (1)..(459): transl_table=11
atgaccgccttgcattccgatcccaccatcgccgcacgacagcgctggatgggcgtgctcgcccgcgcccgtcgcgaggagctggacgcccatgcggacgccctgcgcgatgccgactatcacctgctgcgcgccgccgagaccggcatgaccctggtgcgcggacgcatgggcggcaccggcagcccgttcaacctcggcgagatgaccgtgacccgctgcgtggtgcggctcggtgacggacgcaccggctacagctatgtcgccgggcgcgacaagcgccacgccgaactggccgccctggccgacgcgcacctgcagggcgccgacgcggcggcctggcaggcgcgcctgatcgaaccgctggcccgcacccaggccgagcgccgcgccgcccaggaggcggaaatcgccactaccaaggtggagttcttcaccctggtccgaggagaagattga

SEQ ID NO: 107134 - protein, 152 aa, Pseudomonas aeruginosa PAO1
MTALHSDPTIAARQRWMGVLARARREELDAHADALRDADYHLLRAAETGMTLVRGRMGGTGSPFNLGEMTVTRCVVRLGDGRTGYSYVAGRDKRHAELAALADAHLQGADAAAWQARLIEPLARTQAERRAAQEAEIATTKVEFFTLVRGED

SEQ ID NO: 107135 - DNA, 453 bp, Escherichia coli O157:H7
  CDS (1)..(453): transl_table=11
atgcacgcagataccgcgacccgccagcactggatgtccgtactggcacacagccaaccggcagaactggcagcccgcctgaacgcgctgaacatcaccgccaactatgaggtgatccgcgccgctgaaactggcctggtacagattcaggcgcggatgggcggcaccggcgaacgcttttttgccggcgacgccacgctgacccgcgccgccgtacgtctgactgacggcaccctcggctacagctgggtgctggggcgcgacaaacagcacgccgaacgctgcgcgctgattgacgcgctgatgcagcaaacccgccattttcaaaacttatcagaaacgcttattgccccgctggacgctgaccgtatggcacgcattgccgcacgccaggccgaagtgaacgccagccgggtcgacttctttacgatggttcgcggagacaacgcatga

SEQ ID NO: 107136 - protein, 150 aa, Escherichia coli O157:H7
MHADTATRQHWMSVLAHSQPAELAARLNALNITANYEVIRAAETGLVQIQARMGGTGERFFAGDATLTRAAVRLTDGTLGYSWVLGRDKQHAERCALIDALMQQTRHFQNLSETLIAPLDADRMARIAARQAEVNASRVDFFTMVRGDNA

SEQ ID NO: 107137 - DNA, 456 bp, Nostoc sp. PCC 7120
  CDS (1)..(456): transl_table=11
atgcctactgtgatgcagcgacaagcatggatggcaacattagctaaagctgagttagagctattagaaaaactagtaaacaaattaggtactttgcccaaatatagctttttgcgctgtccagagattggtctagcaatggtgcgaggacttgctgggggtacaggagaagcatttaatttaggagaaattaccatgactcgctgtgtcgtgcagttagagagtcaaggagaagacgcattagctggatttgggtatgtcgcagggcgatcgcaccgtcatgcagaactagcggctgtttgtgatgcgttactacaaaccccaaattggtatgaccagattcagactgaagtaattcaacccttgcaagcagaatatcaacagcagcaagaacttaagcagcgtcaagcagcagctactcaggttaatttcttcacgatggtgaggggggaatag

SEQ ID NO: 107138 - protein, 151 aa, Nostoc sp. PCC 7120
MPTVMQRQAWMATLAKAELELLEKLVNKLGTLPKYSFLRCPEIGLAMVRGLAGGTGEAFNLGEITMTRCVVQLESQGEDALAGFGYVAGRSHRHAELAAVCDALLQTPNWYDQIQTEVIQPLQAEYQQQQELKQRQAAATQVNFFTMVRGE

SEQ ID NO: 107139 - DNA, 462 bp, Agrobacterium tumefaciens str. C58
  CDS (1)..(462): transl_table=11
atgaataacgaagctgcgaatatagacagtgaaaggaaacgggtggcggcgcttcttgcccgcgccaccgttcaggaactggaaacggtctggagccgtcaggatgccagcccgcagacggaaaacgtgcgggggccggaaaccggtctcgtcatggtgaagggccgtatcggcggcggcggtgcgccctttaatctcggcgaaaccaccgtcacacgcgcgaccgtcaagctggcctcgggaaccgtcggccatgcgcatgttctcggcaccggccgcaagaaggcctggtatgccgccgttttcgacgcgctgtggcaggaaagccagacccggggcttcatcgaggccgagctcctttcaccggtcgaaaagagactgagcgaagagaagcaacggaaaaccaaagaaaccgcagccacgcgggtcgatttcttcaccatggttcgaggagaggattga

SEQ ID NO: 107140 - protein, 153 aa, Agrobacterium tumefaciens str. C58
MNNEAANIDSERKRVAALLARATVQELETVWSRQDASPQTENVRGPETGLVMVKGRIGGGGAPFNLGETTVTRATVKLASGTVGHAHVLGTGRKKAWYAAVFDALWQESQTRGFIEAELLSPVEKRLSEEKQRKTKETAATRVDFFTMVRGED

SEQ ID NO: 107141 - DNA, 453 bp, Escherichia coli CFT073
  CDS (1)..(453): transl_table=11
atgcacgcagataccgcgacccgccagcactggatgtccgtgctggcgcacagccaaccggctgaactggcagcccgcctgaacgcgctgaacatcaacgccgattatgaggtgatccgcgccgctgaaactggcctggtgcagattcaggcgcgaatgggcggcaccggcgaacgcttttttgctggcgacgccacgctcacccgcgccgccgtgcgtctgactgacggcacgctcggctatagctgggtgctggggcgcgacaaacagcacgccgaacgttgtgcgctgattgatgcgctgatgcagcaaaaccgccactttcaaaacttatcagaaacccttattaccccgctggacgctgaccgtatggcacgcattgccgcgcgtcaggccgaagtgaacgccagccgggtcgacttctttacgatggttcgcggagacaacgcatga

SEQ ID NO: 107142 - protein, 150 aa, Escherichia coli CFT073
MHADTATRQHWMSVLAHSQPAELAARLNALNINADYEVIRAAETGLVQIQARMGGTGERFFAGDATLTRAAVRLTDGTLGYSWVLGRDKQHAERCALIDALMQQNRHFQNLSETLITPLDADRMARIAARQAEVNASRVDFFTMVRGDNA

SEQ ID NO: 107143 - DNA, 510 bp, Bradyrhizobium japonicum USDA 110
  CDS (1)..(510)
atgaagttgtctactatcatagacaacttgagttcggcaagttcggtggatcgggtgacgcagcacaacaatcagcaagcccagcgcaaggccgcgatggccgtgctggcgcacgcggaggcgggcgagatcgccgttcgcctccgcgctttcgccctcccggcccatcaggatctgcgcgcgccggaaaacggcctcgtcatgctgcgcggccgggtcggcggcgacggcgccccgttcaacctcggcgaagccacggtgtcgcgtgccgcggtgcggctcgcgagcggcgaggtcggcttcggctacacgctcggacgcgacggtgagaaggcgcggctgatcgctctgtgcgatgcgctggtgcagtcgcgggatttttccgcatcggtcgagcgggacgttatcgcaccgttgcgcgagcagcttacgatccggcgcaagcaggcggcggccgagaccgccgcgacgaaggttgatttctacaccatggtgcgcggtgaggggtga

SEQ ID NO: 107144 - protein, 169 aa, Bradyrhizobium japonicum USDA 110
MKLSTIIDNLSSASSVDRVTQHNNQQAQRKAAMAVLAHAEAGEIAVRLRAFALPAHQDLRAPENGLVMLRGRVGGDGAPFNLGEATVSRAAVRLASGEVGFGYTLGRDGEKARLIALCDALVQSRDFSASVERDVIAPLREQLTIRRKQAAAETAATKVDFYTMVRGEG

SEQ ID NO: 107145 - DNA, 465 bp, Pseudomonas syringae pv. tomato str. DC3000
  CDS (1)..(465): transl_table=11
atgtcagcaagtcccgaaacagccgcgcgccagcactggatgggcgtattggcccgcgcccatgtcgatgagccgagccgcgaacagttgaaccgtcatgaagccgcactgcgcgataccgaataccagatgatccgcgccccggaaatcggcatgaccctggtgcgcggccggatgggcggcaccggctcggccttcaatctgggcgaaatgagcgtgacacgctgcgtggtgcgccttgccgacgggcgtaccggctacagctatctggccggacgcgacaagcgccacgctgaactggctgcactggccgacgcccacttgcagggcgcgcagcaggcctggtggctgaacgaactgatcgaacccctgacgcgtgcacaagccgagcgccgggcccgtaaggacgctgaaaccgctgcgaccaaagtggaattctttaccctggtccgaggagaagactga

SEQ ID NO: 107146 - protein, 154 aa, Pseudomonas syringae pv. tomato str. DC3000
MSASPETAARQHWMGVLARAHVDEPSREQLNRHEAALRDTEYQMIRAPEIGMTLVRGRMGGTGSAFNLGEMSVTRCVVRLADGRTGYSYLAGRDKRHAELAALADAHLQGAQQAWWLNELIEPLTRAQAERRARKDAETAATKVEFFTLVRGED

SEQ ID NO: 107147 - DNA, 435 bp, Chromobacterium violaceum ATCC 12472
  CDS (1)..(435): transl_table=11
atggacacctccacccgacagcgctgcttatcggtgctggccaacagcccgctcgaacggctgcaggaactgctgccgccggccctgccctcctgcacgcgctggctgcgccgcgccgaaaccggcctgatgatgctgcagggccgaagcggcggcgccggcgcccgcttcaacctgggcgagatcagcgtcagccgggccagctgccagatcggccagcatgtcggacacggctgggtgcgcggcggcgacggccgccatgccgagttgatcgcccaggccgacgcgctgctgcaagaccccgccctccacgactcgctgatgcgcgcatggatcgctccgctggaaaccgaactggccgagcgccgcgcagcccgctctcgggaagccgccgccagcaaggtcgagtttttcaccatggtccggggggcgtga

SEQ ID NO: 107148 - protein, 144 aa, Chromobacterium violaceum ATCC 12472
MDTSTRQRCLSVLANSPLERLQELLPPALPSCTRWLRRAETGLMMLQGRSGGAGARFNLGEISVSRASCQIGQHVGHGWVRGGDGRHAELIAQADALLQDPALHDSLMRAWIAPLETELAERRAARSREAAASKVEFFTMVRGA

SEQ ID NO: 107149 - DNA, 474 bp, Rhodopseudomonas palustris CGA009
  CDS (1)..(474): transl_table=11
atgcacgccgaaaccacaaacctccccgaacaagccgcgatcacgcgcaggcgcgccgcaatggcggtgctggccgcgtcggacaccgctgcgatcgacgcccgcgtcgaggccctgacgccgccggcgttcacactgctgcgcgagccggaacagggattggtgatgctgcgcggccggatcggcggcgatggctccgccttcaatatcggcgaggcgacggtgtcgcgcgctgcggtgcggctcgccagcggtgaggtcgggttcggctacaccttggggcgagaccgtaccaaggcgaagctgatcgcgctgtgcgacgcgctgctgcaatcggcggactatgcagcgtcggtcgaggccgaggtgatcgcgccgctgcgcaccaaagtcgaagccgcacgcgccgaaaaggccgcccagacggcggccaccaaagtcgatttctacacgctggtgcgcggagagggctga

SEQ ID NO: 107150 - protein, 157 aa, Rhodopseudomonas palustris CGA009
MHAETTNLPEQAAITRRRAAMAVLAASDTAAIDARVEALTPPAFTLLREPEQGLVMLRGRIGGDGSAFNIGEATVSRAAVRLASGEVGFGYTLGRDRTKAKLIALCDALLQSADYAASVEAEVIAPLRTKVEAARAEKAAQTAATKVDFYTLVRGEG

SEQ ID NO: 107151 - DNA, 444 bp, Erwinia carotovora subsp. atroseptica SCRI1043
  CDS (1)..(444)
atgtctgagttaacacagcgacagcgttggatgtccattctcgctcacagcgatcctgccgagctggaagaacactggaacacgctgcactttccagcgcactaccagctattacgcccaacacagattggtttgatccagttgcagggaagaatggaggtcgatggcccgcgttttattgtgggggatatgacggtgacccgtgctgcggtgcaactggaggatggaacgtgcggctacagctatatcgccggcagaaacaagccgcacgccgagctctgtgcctggatcgatgcactcctgcaaacccgatcctatttccatgaaatatgggagcgaatcatcacaccgttagcagaccaacagcttgctcaccgggaacagcaacagcatgaagttgctgccagtcgagtgaatttctttactttggtcaggggagaatga

SEQ ID NO: 107152 - protein, 147 aa, Erwinia carotovora subsp. atroseptica SCRI1043
MSELTQRQRWMSILAHSDPAELEEHWNTLHFPAHYQLLRPTQIGLIQLQGRMEVDGPRFIVGDMTVTRAAVQLEDGTCGYSYIAGRNKPHAELCAWIDALLQTRSYFHEIWERIITPLADQQLAHREQQQHEVAASRVNFFTLVRGE

SEQ ID NO: 107153 - DNA, 477 bp, Yersinia pseudotuberculosis IP 32953
  CDS (1)..(477): transl_table=11
atggaaagcacgttgatgacccggcaaaattggctgtcgatcttggcccatagccagcccacagaacttctcgcccactggcagcccttaaatctatccccggagtatcaggtgatccgggcacctgagatgggtcttaatcaattgcaggcgcggatgggggccaccggccgccgttttattctcggtgatatgacggtcacccgcgcggttatcaaactcaatgactgcaccgatatctatggctacagctacatcgccggacgtaataagccccatgccgaactctgcgcgttattggatgccttgctgcaatattcaacgctgaaaggcaggcccgcgggactgaacgaattattactgaaaaccgtgattcacccactcgccgcaatacagcagaaacgacgccaactgcgcgcccagcatatcgccgccagtaaagtcgatttcttcacattagttcggggagaagattga

SEQ ID NO: 107154 - protein, 158 aa, Yersinia pseudotuberculosis IP 32953
MESTLMTRQNWLSILAHSQPTELLAHWQPLNLSPEYQVIRAPEMGLNQLQARMGATGRRFILGDMTVTRAVIKLNDCTDIYGYSYIAGRNKPHAELCALLDALLQYSTLKGRPAGLNELLLKTVIHPLAAIQQKRRQLRAQHIAASKVDFFTLVRGED

SEQ ID NO: 107155 - DNA, 549 bp, Burkholderia mallei ATCC 23344
  CDS (1)..(549): transl_table=11
atgagcgcctcagccgtttcctccttgcatgccgcgcgacgcgactggctcgcggtgctggcgaagattccccgcgacgaactcgagcgggcgctcgatcgcgtgctcgacggcgcgcccgcacccgcgttcgactggctgcgcgccccggagatcgggctggcgatggtgcgcgggcgcatcggcggcacgggcgatccgttcaatctcggcgaggcgagcgtcacgcgcgccgcgctgcgcctgcgcggcgaccgcacgaacggcacgaccggcacgaccggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107156 - protein, 182 aa, Burkholderia mallei ATCC 23344
MSASAVSSLHAARRDWLAVLAKIPRDELERALDRVLDGAPAPAFDWLRAPEIGLAMVRGRIGGTGDPFNLGEASVTRAALRLRGDRTNGTTGTTGADGMNGANGANRPHGATVGIAYVLGRDKRRAELVALADALLQTPERHERLRAALIEPFRARLAQARAARSGEIATTRVEFFTMVRGE

SEQ ID NO: 107157 - DNA, 456 bp, Silicibacter pomeroyi DSS-3
  CDS (1)..(456): transl_table=11
atggcagaacaagagaaagagacggcggcgcggcagggctggatgggccttttggcgcgtgcgcccgaggcgatgctgatggcactgtggaaccgggtcgaggagcgccccgcgttcgactggctgcgcgcgcccgaaaccggtggcgtgatggtgcgcggccgcgccggcggcaccggcgcccccttcaacctgggtgagatgacggtgacccgctgcgccttggcgctggctgatggcacggtggggcatgcctatgtccagggtcgctcgcgtgccaaggccgaggcggcggcgctgatcgacgcgctgatgcagaccgccgccgccgacaccatccgcgccttggttctggacccgctggcggcgcagatggccgagcgctcagagggccgcgccgcgcgcgcagccgccaccaaggtcgagtttttcacgctggtcagaggagaggattga

SEQ ID NO: 107158 - protein, 151 aa, Silicibacter pomeroyi DSS-3
MAEQEKETAARQGWMGLLARAPEAMLMALWNRVEERPAFDWLRAPETGGVMVRGRAGGTGAPFNLGEMTVTRCALALADGTVGHAYVQGRSRAKAEAAALIDALMQTAAADTIRALVLDPLAAQMAERSEGRAARAAATKVEFFTLVRGED

SEQ ID NO: 107159 - DNA, 465 bp, Pseudomonas syringae pv. syringae B728a
  CDS (1)..(465)
atgcaagcaactcccgaaacaacggcgcgtcagcactggatgggcgtactggcccgcgctcatgccgatcagccgagccgcgagcagttaaaccgccacgaagcggcgctgcgcgacaccgattaccagatgatccgcgccccggaaatcggcatgaccctggtgcgtggccgtatgggcggcaccggttcagccttcaaccttggcgaaatgagcgtgacgcgctgtgtggtgcgtctggctgacggtcgcaccggctacagctatctggcgggacgcgacaagcgccacgctgaactggcggcgctggccgacgcccatttgcaaggcgcgcagcaggcctggtggctgtgcgaactgatcgagccgctggcgcgtgcacaagccgagcgtcgggcgcgcaaggacgccgaggccgcggcaaccaaagtcgaattctttaccctggtccgaggagaagactga

SEQ ID NO: 107160 - protein, 154 aa, Pseudomonas syringae pv. syringae B728a
MQATPETTARQHWMGVLARAHADQPSREQLNRHEAALRDTDYQMIRAPEIGMTLVRGRMGGTGSAFNLGEMSVTRCVVRLADGRTGYSYLAGRDKRHAELAALADAHLQGAQQAWWLCELIEPLARAQAERRARKDAEAAATKVEFFTLVRGED

SEQ ID NO: 107161 - DNA, 465 bp, Pseudomonas syringae pv. phaseolicola 1448A
  CDS (1)..(465): transl_table=11
atgcaagcaacccctgaaacggccgcacggcagcactggatgggcgtactggcgcgcgcccttgtcgatgagccgagccgcgaacagttgcagcgtcacgaggcggcgttgcgcgacaccgattaccagatgatccgcgccccggaaatcggcatgaccctggtgcgtggtcgcatgggcggcaccggttcggcgttcaatcttggcgagatgagcgttacccgctgcgtggtccgtctggccgatgggcgcacgggttacagctacctggccggacgcgacaagcgccatgccgaactggcggcgctggccgatgcccatttgcaaggcgcgcaacaggcctggtggctgtccgaactgatcgagcccctggcgcgtgcgcaagccgagcgtcgggcacgcaaggacgcagaagccgctgcaaccaaagtagaattctttaccctggtccgaggagaagactga

SEQ ID NO: 107162 - protein, 154 aa, Pseudomonas syringae pv. phaseolicola 1448A
MQATPETAARQHWMGVLARALVDEPSREQLQRHEAALRDTDYQMIRAPEIGMTLVRGRMGGTGSAFNLGEMSVTRCVVRLADGRTGYSYLAGRDKRHAELAALADAHLQGAQQAWWLSELIEPLARAQAERRARKDAEAAATKVEFFTLVRGED

SEQ ID NO: 107163 - DNA, 486 bp, Ralstonia eutropha JMP134
  CDS (1)..(486): transl_table=11
atgcaagacactaccattgcggatgctagcgctgcccgtgcgggctggctgcggattctggcgctagcgcagccggatgcgcttgacgcggcttacgcgcaactttccgggcaaggcgtactgcccgcctaccgcctgctgcgcaagccggaggccggcatggcgatggtgcgcggccgtgctggcggcactggcgcgcaattcaatctcggcgaagtctcggtgacacgctgcgcgatcgtcctcgaggacgcctcggctggcagcaccgcgggagtcgcctacgtacagggccgcggcacacgccacgccgaacaggcggccgtgctggacgccctgctccagcgcgccgactggcaccagcgcgtgcgcgacaccgtgctggccccgctagcgcaggctcacgctgcgcgtgctgccaatcgggcgggcgttgccgcacagacgcgcgtggagtttttcaccatggttcgaggagaagactga

SEQ ID NO: 107164 - protein, 161 aa, Ralstonia eutropha JMP134
MQDTTIADASAARAGWLRILALAQPDALDAAYAQLSGQGVLPAYRLLRKPEAGMAMVRGRAGGTGAQFNLGEVSVTRCAIVLEDASAGSTAGVAYVQGRGTRHAEQAAVLDALLQRADWHQRVRDTVLAPLAQAHAARAANRAGVAAQTRVEFFTMVRGED

SEQ ID NO: 107165 - DNA, 453 bp, Shigella sonnei Ss046
  CDS (1)..(453): transl_table=11
atgcacgcagataccgcgacccgccagcactggatgtccgtactggcgcacagccaaccggctgaactggcagcccgcctgaacgcgctgaacatcaccgccgactatgaagtgatccgcactgccgaaactggcctggtgcagattcaggcgcgaatgggcggtaccggcgaacgcttttttgccggcgacgccacgctgacccgtgccgccgtacgcctgactgacggcaccctcggctacagctgggtgctggggcgtgataaacagcacgccgaacgctgcgcgctgattgatgcgctgatgcagcaatctcgccactttcaaaacttatcagaaacccttattgccccgctggacgctgaccgtatggcacgcattgccgcacgccaggccgaagtgaacgccagccgggtcgacttctttacgatggttcgcggagacaacgcatga

SEQ ID NO: 107166 - protein, 150 aa, Shigella sonnei Ss046
MHADTATRQHWMSVLAHSQPAELAARLNALNITADYEVIRTAETGLVQIQARMGGTGERFFAGDATLTRAAVRLTDGTLGYSWVLGRDKQHAERCALIDALMQQSRHFQNLSETLIAPLDADRMARIAARQAEVNASRVDFFTMVRGDNA

SEQ ID NO: 107167 - DNA, 420 bp, Desulfovibrio desulfuricans G20
  CDS (1)..(420)
atgtccgtactggcacgggccccgctggccgagctggaagcagcctggaacagcctgccccgccgaccagaatatgcgctgctgcggcagcccgaaaccggactggccatggtgcaggcacgcaccaacggcagcggcgctccgttcaatatgggtgaaatgaccctgacccgctgtgcggtggatgtgaacggctttgccggacacgcctatgtggcgggccgcagcagccgccacgccgagctggccgcggtctttgacgggttgctgcaagaccctgaacacaccggcacgctcacacgcacggtcatactgcctctgcagcagcgcatagccgcaacccgccgcacgcaggcggcgcaggccgcggccaccagagtggaatttttcaccatggtacgcggggaggaccagccatga

SEQ ID NO: 107168 - protein, 139 aa, Desulfovibrio desulfuricans G20
MSVLARAPLAELEAAWNSLPRRPEYALLRQPETGLAMVQARTNGSGAPFNMGEMTLTRCAVDVNGFAGHAYVAGRSSRHAELAAVFDGLLQDPEHTGTLTRTVILPLQQRIAATRRTQAAQAAATRVEFFTMVRGEDQP

SEQ ID NO: 107169 - DNA, 459 bp, Pseudomonas aeruginosa UCBPP-PA14
  CDS (1)..(459)
atgaccgccttgcattccgatcccaccatcgccgcacgacagcgctggatgggcgtgctcgcccgcgcccgtcgcgaggagctggacgcccatgcggacgccctgcgcgatgccgactatcacctgctgcgcgccgccgagaccggcatgaccctggtgcgcggacgcatgggcggcaccggcagcccgttcaacttcggcgagatgaccgtgacccgctgcgtggtccgcctcgctgacggacgtaccggctacagctatgtcgccgggcgcgacaagcgccacgccgaactggccgccctggccgacgcgcacctgcagggcgccgatgcggcggcctggcaggcgcgcctgatcgaaccgctggcccgcacccaggccgagcgccgcgccgcccaggaggcggaaatcgccactaccaaggtggagttcttcaccctggtccgaggagaagattga

SEQ ID NO: 107170 - protein, 152 aa, Pseudomonas aeruginosa UCBPP-PA14
MTALHSDPTIAARQRWMGVLARARREELDAHADALRDADYHLLRAAETGMTLVRGRMGGTGSPFNFGEMTVTRCVVRLADGRTGYSYVAGRDKRHAELAALADAHLQGADAAAWQARLIEPLARTQAERRAAQEAEIATTKVEFFTLVRGED

SEQ ID NO: 107171 - DNA, 426 bp, Pseudomonas syringae pv. syringae B728a
  CDS (1)..(426)
atgggcgtactggcccgcgctcatgccgatcagccgagccgcgagcagttaaaccgccacgaagcggcgctgcgcgacaccgattaccagatgatccgcgccccggaaatcggcatgaccctggtgcgtggccgtatgggcggcaccggttcagccttcaaccttggcgaaatgagcgtgacgcgctgtgtggtgcgtctggctgacggtcgcaccggctacagctatctggcgggacgcgacaagcgccacgctgaactggcggcgctggccgacgcccatttgcaaggcgcgcagcaggcctggtggctgtgcgaactgatcgagccgctggcgcgtgcacaagccgagcgtcgggcgcgcaaggacgccgaggccgcggcaaccaaagtcgaattctttaccctggtccgaggagaagactga

SEQ ID NO: 107172 - protein, 141 aa, Pseudomonas syringae pv. syringae B728a
MGVLARAHADQPSREQLNRHEAALRDTDYQMIRAPEIGMTLVRGRMGGTGSAFNLGEMSVTRCVVRLADGRTGYSYLAGRDKRHAELAALADAHLQGAQQAWWLCELIEPLARAQAERRARKDAEAAATKVEFFTLVRGED

SEQ ID NO: 107173 - DNA, 501 bp, Rubrivivax gelatinosus PM1
  CDS (1)..(501)
atgacccaccactcattgatcggtcccgcacccgtgatcgaacggcgccacctggtcgcctgcctgtcggcggccggccgcgaggccgtgctgagcacggccgcccagctcagcgaaggcctgacagtgacgccgctgcagccggccgaggccggcctggcgctgatgcagtggcgcgacgccgtgcagcaccagcccttcttcctgggcgaggtgccgatggcgcgcgcggcagtcgcgctggtcgaccaccggggcgaacgcgccgagggcggcgccgtggtgatggccgacgacgccgagctggcccaggcgctggcgttgctggacgccgtcttcgcccaccgctggcccggcgccgacgcggtggacgccctcgcggcgcgcggcgcgcaggcccgcgaggctctccgcaccgtccggcaggcagggctgcagcgcacgcgcgtggactttgcgctgctggccgaggccgatgaggacgaggagggcgccgcatga

SEQ ID NO: 107174 - protein, 166 aa, Rubrivivax gelatinosus PM1
MTHHSLIGPAPVIERRHLVACLSAAGREAVLSTAAQLSEGLTVTPLQPAEAGLALMQWRDAVQHQPFFLGEVPMARAAVALVDHRGERAEGGAVVMADDAELAQALALLDAVFAHRWPGADAVDALAARGAQAREALRTVRQAGLQRTRVDFALLAEADEDEEGAA

SEQ ID NO: 107175 - DNA, 438 bp, Burkholderia fungorum LB400
  CDS (1)..(438)
atggccgtgctggcccgcacgccgcgcggcgatctcgaagccgcgctcgaacgcgcattgcgggacattcccacgccaccatacgactggctgcgcccgcctgaaatcggcctcgcgatggtgcgcgggcgtatcggcggcagcggcgacccgttcaatctcggcgaagccacggtcacacgcgccacgctgcgtttgcgcgcgtcggccggcgctgacgcgaccgttggggtggcgtgccacctgggccgcgaccgccgccgcgccgaactggcggcgctcgcggatgcgctcctgcaaatgccggagcatcacgccgtcttgcaagagcaactgatcgaaccgttagccgcgcagcaggccgcgaaacgcgccgtgcggcaacagggcgccgcggccacgcgcgtcgaattcttcacgatggtccggggcgactga

SEQ ID NO: 107176 - protein, 145 aa, Burkholderia fungorum LB400
MAVLARTPRGDLEAALERALRDIPTPPYDWLRPPEIGLAMVRGRIGGSGDPFNLGEATVTRATLRLRASAGADATVGVACHLGRDRRRAELAALADALLQMPEHHAVLQEQLIEPLAAQQAAKRAVRQQGAAATRVEFFTMVRGD

SEQ ID NO: 107177 - DNA, 525 bp, Burkholderia mallei 10229
  CDS (1)..(525)
ttgcatgccgcgcgacgcgactggctcgcggtgctggcgaagattccccgcgacgaactcgagcgggcgctcgatcgcgtgctcgacggcgcgcccgcacccgcgttcgactggctgcgcgccccggagatcgggctggcgatggtgcgcgggcgcatcggcggcacgggcgatccgttcaatctcggcgaggcgagcgtcacgcgcgccgcgctgcgcctgcgcggcgaccgcacgaacggcacgaccggcacgaccggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107178 - protein, 174 aa, Burkholderia mallei 10229
MHAARRDWLAVLAKIPRDELERALDRVLDGAPAPAFDWLRAPEIGLAMVRGRIGGTGDPFNLGEASVTRAALRLRGDRTNGTTGTTGADGMNGANGANRPHGATVGIAYVLGRDKRRAELVALADALLQTPERHERLRAALIEPFRARLAQARAARSGEIATTRVEFFTMVRGE

SEQ ID NO: 107179 - DNA, 534 bp, Burkholderia pseudomallei 1655
  CDS (1)..(534)
ttgcatgccgcgcgacgcgactggctcgcggtgctggcgaagattccccgcgacgaactcgagcgggcgctcgatcgcgtgctcgacggcgcgcccgcccccgcgttcgactggctgcgcgccccggagatcgggctggcgatggtgcgcgggcgcatcggcggcacgggcgatccgttcaatctcggcgaggcgagcgtcacgcgcgccgcgctgcgcctgcgcggcgacgcgtgcgaccgcacgaacggcacgaacggcacgaccggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107180 - protein, 177 aa, Burkholderia pseudomallei 1655
MHAARRDWLAVLAKIPRDELERALDRVLDGAPAPAFDWLRAPEIGLAMVRGRIGGTGDPFNLGEASVTRAALRLRGDACDRTNGTNGTTGADGMNGANGANRPHGATVGIAYVLGRDKRRAELVALADALLQTPERHERLRAALIEPFRARLAQARAARSGEIATTRVEFFTMVRGE

SEQ ID NO: 107181 - DNA, 534 bp, Burkholderia pseudomallei 1710a
  CDS (1)..(534)
ttgcatgccgcgcgacgcgactggctcgcggtgctggcgaagattccccgcgacgaactcgagcgggcactcgatcgcgtgctcgacggcgcgcccgcaccggcgttcgactggctgcgcgccccggagatcgggctggcgatggtgcgcgggcgcatcggcggcacgggcgatccgttcaatctcggcgaggcgagcgtcacgcgcgccgcgctgcgcctgcgcggcgaccgcacgaacggcacgaacggcacgaccggcacgaacggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107182 - protein, 177 aa, Burkholderia pseudomallei 1710a
MHAARRDWLAVLAKIPRDELERALDRVLDGAPAPAFDWLRAPEIGLAMVRGRIGGTGDPFNLGEASVTRAALRLRGDRTNGTNGTTGTNGADGMNGANGANRPHGATVGIAYVLGRDKRRAELVALADALLQTPERHERLRAALIEPFRARLAQARAARSGEIATTRVEFFTMVRGE

SEQ ID NO: 107183 - DNA, 561 bp, Burkholderia pseudomallei 668
  CDS (1)..(561)
ttgcatgccgcgcgacgcgactggctcgcggtgctggcgaagattccccgcgacgaactcgagcgggcgctcgatcgcgtgctcgacggcgcgcccgcgcccgcgttcgactggctgcgcgccccggagatcgggctggcgatggtgcgcgggcgcatcggcggcacgggcgatccgttcaatctcggcgaggcgagcgtcacgcgcgccgcgctgcgcctgcgcggcgacgcgcgcgaccgcacgaacggcgcgaccggcgcgaccggcacgaacggcacgaacggcacgaccggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107184 - protein, 186 aa, Burkholderia pseudomallei 668
MHAARRDWLAVLAKIPRDELERALDRVLDGAPAPAFDWLRAPEIGLAMVRGRIGGTGDPFNLGEASVTRAALRLRGDARDRTNGATGATGTNGTNGTTGADGMNGANGANRPHGATVGIAYVLGRDKRRAELVALADALLQTPERHERLRAALIEPFRARLAQARAARSGEIATTRVEFFTMVRGE

SEQ ID NO: 107185 - DNA, 525 bp, Burkholderia pseudomallei S13
  CDS (1)..(525)
ttgcatgccgcgcgacgcgactggctcgcggtgctggcgaagattccccgcgacgaactcgagcgggcgctcgatcgtgtgctcgacggcgcgcccgcacccgcgttcgactggctgcgcaccccggagatcgggctggcgatggtgcgcgggcgcatcggcggcacgggcgatccgttcaatctcggcgaggcgagcgtcacgcgcgccgcgctgcgcctgcgcggcgaccgcacgaacggcacgaacggcacgaccggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107186 - protein, 174 aa, Burkholderia pseudomallei S13
MHAARRDWLAVLAKIPRDELERALDRVLDGAPAPAFDWLRTPEIGLAMVRGRIGGTGDPFNLGEASVTRAALRLRGDRTNGTNGTTGADGMNGANGANRPHGATVGIAYVLGRDKRRAELVALADALLQTPERHERLRAALIEPFRARLAQARAARSGEIATTRVEFFTMVRGE

SEQ ID NO: 107187 - DNA, 489 bp, Ralstonia metallidurans CH34
  CDS (1)..(489): transl_table=11
atgcaaagcgaaaccgccaaccaggccaacgcggcacgggccgcgtggctgaggattctggcgctggcccaaacggatgcgctcgatgcggcctactcgcggctcggcgacgtggcggcactgcccggctaccgactgctgcgcaagcccgaatcgggcatggcgatggtccgggcccgcgcgggtggcaccggtgcccagttcaatctgggtgagatgtccgtcacgcgctgcgccgtggtgctcgacgagaccgaaggccaagccgccacggctggcgtggcctacatacagggacgcggcacgcgccacgccgaacaggccgccgtgctcgacgcactgctgcagcgcccggcctggcaccagcgcgtgcatgacgtggtcatcgcgccacttgcacagaccctgaccgagcgcgcggcccaccaggccgccaccgccgcgcaaacgcgcgtcgaattcttcacgatggcccgcggagaggattga

SEQ ID NO: 107188 - protein, 162 aa, Ralstonia metallidurans CH34
MQSETANQANAARAAWLRILALAQTDALDAAYSRLGDVAALPGYRLLRKPESGMAMVRARAGGTGAQFNLGEMSVTRCAVVLDETEGQAATAGVAYIQGRGTRHAEQAAVLDALLQRPAWHQRVHDVVIAPLAQTLTERAAHQAATAAQTRVEFFTMARGED

SEQ ID NO: 107189 - DNA, 453 bp, Silicibacter sp. TM1040
  CDS (1)..(453): transl_table=11
atgacacaagagagaacgcccgaggaccgcaaggcctggatgagcctgctggccaccgcgcccgaggctcggcttgccagcctgttcgaggccttcgggcatagccccgagcatgcttttctacgcgcgcccgaaaccggtggtgtgatggtccgcgggcgcacaggcgcaagcggcgcaccgtttaacctcggcgagatgaccgtcacccgctgcacgctcaaactcgtatctggcgaagtggggcatggctatgtgcagggtcgcagcaagcggcaggcggagatggccgccaaattggacgcgatgatgcaaacagaggccgccccggagctcgagaacaagatcctgacccccctgcgcacggagcgtgacgcggcccgagaggcccgcgctgccaaagccgccgcgaccaaggtggacttctttacgatggtgcgaggagaggactga

SEQ ID NO: 107190 - protein, 150 aa, Silicibacter sp. TM1040
MTQERTPEDRKAWMSLLATAPEARLASLFEAFGHSPEHAFLRAPETGGVMVRGRTGASGAPFNLGEMTVTRCTLKLVSGEVGHGYVQGRSKRQAEMAAKLDAMMQTEAAPELENKILTPLRTERDAAREARAAKAAATKVDFFTMVRGED

SEQ ID NO: 107191 - DNA, 453 bp, Paracoccus denitrificans PD1222
  CDS (1)..(453): transl_table=11
atgtcccaatcatcccaacccgaaaccactgcgcgccgcgaatggatctcggcgctggccaaggcaccgccgggccggctggcggcgctgctgcccgacttgcccgcgcatgagatgctgcgcgcacccgagatcggcaccgtgatggtgcagggccgcatcggcggcaccggcgtgcccttcaacctgggcgagatgaccgtcacccgctgctcggtccggctgtccgagggcgcggtgggccatgcctgcgtgcagggccgcgacaaggcgcatgccgcccgcgccgccgtcgccgatgcgctgatgcagaccggggccgcgccgcagatcgcgacgcaggtgctggcccccctgcgggccgcggccgccagggcgcgcgccacccgcgccgccaaggccgccgccacccgggtcgaattcttcaccatgctacgcggagaggacgcatga

SEQ ID NO: 107192 - protein, 150 aa, Paracoccus denitrificans PD1222
MSQSSQPETTARREWISALAKAPPGRLAALLPDLPAHEMLRAPEIGTVMVQGRIGGTGVPFNLGEMTVTRCSVRLSEGAVGHACVQGRDKAHAARAAVADALMQTGAAPQIATQVLAPLRAAAARARATRAAKAAATRVEFFTMLRGEDA

SEQ ID NO: 107193 - DNA, 441 bp, Burkholderia mallei FMH
  CDS (1)..(441)
atgggcgcgcccgcacccgcgttcgactggctgcgcgccccggagatcgggctggcgatggtgcgcgggcgcatcggcggcacgggcgatccgttcaatctcggcgaggcgagcgtcacgcgcgccgcgctgcgcctgcgcggcgaccgcacgaacggcacgaccggcacgaccggcgcggatgggatgaatggtgcgaacggtgcgaaccgcccgcacggcgcgacggtcggcatcgcttacgtgctcggccgcgacaagcggcgcgcggagctcgtcgcgctcgccgacgcgctattgcagacgccggagcgccatgagcggctgcgcgccgcgctgatcgagccgtttcgcgcacgccttgcgcaagcgcgtgcggcgcgctcgggggaaatcgcgacgacgcgcgtcgaattcttcacgatggtgcgaggcgaatga

SEQ ID NO: 107194 - protein, 146 aa, Burkholderia mallei FMH
MGAPAPAFDWLRAPEIGLAMVRGRIGGTGDPFNLGEASVTRAALRLRGDRTNGTTGTTGADGMNGANGANRPHGATVGIAYVLGRDKRRAELVALADALLQTPERHERLRAALIEPFRARLAQARAARSGEIATTRVEFFTMVRGE

SEQ ID NO: 107195 - DNA, 465 bp, Rhodoferax ferrireducens DSM 15236
  CDS (1)..(465): transl_table=11
atgacaagcaacatcctaacaagcgactacccgacgcgactggcatggctggcggtgctggcgcgcgccaccctgactcaactcgaagacatgctgcctgcagcgggcgagctgcctgagctcaagcccgtgcgagcgccggaaatcggcatggtgatgctgcgtggccgcgtgggtggcaccggcaaccccttcaacctgggcgaggccagcgtggtgcgctgcgccgtgcgcctggggaacggcccgctgggcgtgtcctatgcgctgggccgcgacaagcgccgcgctgaactggcggcgctgtttgacgccctgctgcaagacccgcagcatcacgacgacttgcagcgcgacctcattgcgccactggccttggggcaggcccaggcccgggcacaaaagcagcgcgacggggccggctccaaagtcgagtttttcaccttcgtgcgaggtgaggcatga

SEQ ID NO: 107196 - protein, 154 aa, Rhodoferax ferrireducens DSM 15236
MTSNILTSDYPTRLAWLAVLARATLTQLEDMLPAAGELPELKPVRAPEIGMVMLRGRVGGTGNPFNLGEASVVRCAVRLGNGPLGVSYALGRDKRRAELAALFDALLQDPQHHDDLQRDLIAPLALGQAQARAQKQRDGAGSKVEFFTFVRGEA

SEQ ID NO: 107197 - DNA, 447 bp, Pseudomonas stutzeri
  CDS (1)..(447): transl_table=11
atgcacacccgcgaacaatccccccgccagcgctggatggccgtgctggcccgcgccagcgccgccgacctggcgcctttcgagagcgccctgcgcgactgcgcctaccagttgatccgtcccgcggaaatcggcatgaccctggtgcgcggccgcatgggcggcaccggcgcgccgttcaacctcggcgagatgagcgtcacccgttgcgtggtgcgcctggccgacggcagcaccggctacagctaccgcgccggccgtgacaagcgccaggccgagctcgccgccctcgccgatgcccatctgcaaggcccgcaacaaagccgctggctcgccgagctgatcgaaccgctggccgccgcgcaggcccgacgcgccgcgcaaaaggctgccgaaaccgccactacccgcgtggagttcttcacgctgctgcgaggagaagactga

SEQ ID NO: 107198 - protein, 148 aa, Pseudomonas stutzeri
MHTREQSPRQRWMAVLARASAADLAPFESALRDCAYQLIRPAEIGMTLVRGRMGGTGAPFNLGEMSVTRCVVRLADGSTGYSYRAGRDKRQAELAALADAHLQGPQQSRWLAELIEPLAAAQARRAAQKAAETATTRVEFFTLLRGED

SEQ ID NO: 107199 - DNA, 456 bp, Rhizobium loti
  CDS (1)..(456): transl_table=11
gtgcggattgaagttgaaaagcggcagcgatggatggcggttctcgcgcgagcccgatgcgatgaacttgagcgggcctgggacaacctggccatccagccgcaatttgattggcttcgccgaccggaaaccggcctcgtgcttgtgcgtggacgcgccgggggtaccggcgccctattcaaccttggtgaggtcacgatgacccgatgtgccgttaggttggccgatggcatgacgggcttcgccttcgtcctcgggcgcgaccagcgtcatgcacaactggcggcagttttcgatgcgctgttgcaaggaacagatgacagtgcgagcggcgtacttcggttcgttaccgaatttggaatcgcgcaatccgcccgccgtgagatcaagagccgcaaagcggcttcgactaaggtccactttttcgcaatggctcgaggcatcagtccggaatga

SEQ ID NO: 107200 - protein, 151 aa, Rhizobium loti
MRIEVEKRQRWMAVLARARCDELERAWDNLAIQPQFDWLRRPETGLVLVRGRAGGTGALFNLGEVTMTRCAVRLADGMTGFAFVLGRDQRHAQLAAVFDALLQGTDDSASGVLRFVTEFGIAQSARREIKSRKAASTKVHFFAMARGISPE

SEQ ID NO: 107201 - DNA, 471 bp, Rhizobium meliloti
  CDS (1)..(471): transl_table=11
atgatggacgcagcgaagacaagtgacgatgcaggcgtcgctcagcgccgggaaggcatgcggctgctggcgcgcgcgacgctcggcgaactttccttggcctgggacgcgatcgacgacaagccggaggtcgcgccggtgcgcggtccggaaaccgggctcgtcatggtgcgcggcaagatcggcggcggcggcgatcctttcaatctcggcgaggccaccgtttcacgcgccaccgtgcggctttcgaccggcgaggtcggccatgggcagctgctcggcaccgacaaggcacgcgcccgccttgccgcgatcttcgacgcgctttttcagagcgctgcgcatcgcgcaagcgtcgaggcgctgcacgagcaggtggccgctcgtctcgatgcggaagaccgtcgcaaggccgaggaaacggccgcgacccgcgtcgacttcttcaccatggtccgcggagaggattga

SEQ ID NO: 107202 - protein, 156 aa, Rhizobium meliloti
MMDAAKTSDDAGVAQRREGMRLLARATLGELSLAWDAIDDKPEVAPVRGPETGLVMVRGKIGGGGDPFNLGEATVSRATVRLSTGEVGHGQLLGTDKARARLAAIFDALFQSAAHRASVEALHEQVAARLDAEDRRKAEETAATRVDFFTMVRGED

SEQ ID NO: 107203 - DNA, 21 bp, Artificial sequence
  primer
atgcacgcagataccgcgacc

SEQ ID NO: 107204 - DNA, 24 bp, Artificial sequence
  primer
ttatgcgttgtctccgcgaaccat

SEQ ID NO: 107205 - protein, 194 aa, Artificial sequence
  Variant (2)..(4): xaa in position 2 to 4 is any amino acid
  Variant (6)..(6): xaa in position 6 is any amino acid
  Variant (10)..(15): xaa in position 10 to 15 is any amino acid
  Variant (16)..(20): xaa in position 16 to 20 is any or no amino acid
  Variant (22)..(34): xaa in position 22 to 34 is any amino acid
  Variant (35)..(39): xaa in position 35 to 39 is any or no amino acid
  Variant (42)..(43): xaa in position 42 to 43 is any amino acid
  Variant (45)..(45): xaa in position 45 is any amino acid
  Variant (48)..(48): xaa in position 48 is any amino acid
  Variant (51)..(51): xaa in position 51 is any amino acid
  Variant (54)..(54): xaa in position 54 is any amino acid
  Variant (57)..(57): xaa in position 57 is any amino acid
  Variant (59)..(60): xaa in position 59 to 60 is any amino acid
  Variant (66)..(66): xaa in position 66 is any amino acid
  Variant (71)..(72): xaa in position 71 to 72 is any amino acid
  Variant (74)..(74): xaa in position 74 is any amino acid
  Variant (76)..(79): xaa in position 76 to 79 is any amino acid
  Variant (80)..(118): xaa in position 80 to 118 is any or no amino acid
  Variant (120)..(121): xaa in position 120 to 121 is any amino acid
  Variant (124)..(124): xaa in position 124 is any amino acid
  Variant (127)..(130): xaa in position 127 to 130 is any amino acid
  Variant (132)..(134): xaa in position 132 to 134 is any amino acid
  Variant (137)..(137): xaa in position 137 is any amino acid
  Variant (143)..(152): xaa in position 143 to 152 is any amino acid
  Variant (153)..(160): xaa in position 153 to 160 is any or no amino acid
  Variant (163)..(163): xaa in position 163 is any amino acid
  Variant (165)..(175): xaa in position 165 to 175 is any amino acid
  Variant (177)..(180): xaa in position 177 to 180 is any amino acid
  Variant (182)..(182): xaa in position 182 is any amino acid
RXXXMXVLAXXXXXXXXXXXLXXXXXXXXXXXXXXXXXXLRXXEXGLXMVXGRXGGXGXXFNLGEXTVTRXXVXLXXXXXXXXXXXXXXXXXXXXXXXXXXXXXXXXXXXXXXXXXXXGXXYVXGRXXXXAXXXALXDALLQXXXXXXXXXXXXXXXXXXLIXPXXXXXXXXXXXRXXXXAXTRVEFFTMVRGE

SEQ ID NO: 107206 - protein, 35 aa, Artificial sequence
  Variant (2)..(3): xaa in position 2 to 3 is any amino acid
  Variant (5)..(5): xaa in position 5 is any amino acid
  Variant (7)..(9): xaa in position 7 to 9 is any amino acid
  Variant (10)..(10): xaa in position 10 is Ile, Leu or Val
  Variant (11)..(11): xaa in position 11 is any amino acid
  Variant (12)..(12): xaa in position 12 is Ala or Gly
  Variant (14)..(14): xaa in position 14 is any amino acid
  Variant (16)..(16): xaa in position 16 is Ala or Gly
  Variant (17)..(17): xaa in position 17 is Ala, Asp, Gly, Ser or Thr
  Variant (19)..(20): xaa in position 19 to 20 is any amino acid
  Variant (22)..(23): xaa in position 22 to 23 is any amino acid
  Variant (25)..(25): xaa in position 25 is Asp or Glu
  Variant (26)..(26): xaa in position 26 is any amino acid
  Variant (27)..(27): xaa in position 27 is Ser or Thr
  Variant (28)..(28): xaa in position 28 is Leu, Met or Val
  Variant (29)..(29): xaa in position 29 is Ser, Thr or Val
  Variant (31)..(31): xaa in position 31 is Ala or Cys
  Variant (32)..(32): xaa in position 32 is Ala, Ser, Thr or Val
  Variant (33)..(34): xaa in position 33 to 34 is any amino acid
  Variant (35)..(35): xaa in position 35 is Ile or Leu
RXXEXGXXXXXXRXGXXGXXFXXGXXXXXRXXXXX

SEQ ID NO: 107207 - protein, 26 aa, Artificial sequence
  Variant (2)..(3): xaa in position 2 to 3 is any or no amino acid
  Variant (5)..(6): xaa in position 5 to 6 is any amino acid
  Variant (7)..(8): xaa in position 7 to 8 is any or no amino acid
  Variant (11)..(11): xaa in position 11 is Asp, Gly, Asn or Ser
  Variant (12)..(14): xaa in position 12 to 14 is any amino acid
  Variant (16)..(16): xaa in position 16 is Glu, Lys or Arg
  Variant (17)..(18): xaa in position 17 to 18 is any amino acid
  Variant (20)..(21): xaa in position 20 to 21 is any amino acid
  Variant (23)..(23): xaa in position 23 is Ala or Gly
  Variant (24)..(25): xaa in position 24 to 25 is any amino acid
GXXYXXXXGRXXXXAXXXAXXDXXXQ

SEQ ID NO: 107208 - protein, 14 aa, Artificial sequence
  Variant (2)..(2): xaa in position 2 is Ala, Gln, Ser or Thr
  Variant (3)..(3): xaa in position 3 is Ser or Thr
  Variant (4)..(4): xaa in position 4 is any amino acid
  Variant (6)..(6): xaa in position 6 is Asp, Glu or Asn
  Variant (8)..(8): xaa in position 8 is any amino acid
  Variant (10)..(10): xaa in position 10 is Leu or Met
  Variant (11)..(11): xaa in position 11 is Ala, Leu or Val
  Variant (14)..(14): xaa in position 14 is Ala, Asp or Glu
AXXXVXFXTXXRGX

SEQ ID NO: 107209 - DNA, 669 bp, Escherichia coli K12; identical to SEQ ID NO: 106240
  CDS (1)..(669): transl_table=11

SEQ ID NO: 107210 - protein, 222 aa, Escherichia coli K12; identical to SEQ ID NO: 106241

SEQ ID NO: 107211 - DNA, 696 bp, Mesorhizobium loti MAFF303099
  CDS (1)..(696): transl_table=11
atgcgtgttctgctgatagaagatgacagtgcaaccgcacaaagcatcgaactgatgctgaaatcggagagtttcaatgtctatacgacggacctcggcgaagagggtgtcgatctgggcaaactctacgactacgacatcatccttctcgatctcaacctgcccgacatgtccggctacgaggtcttgagaacgcttcgcctctccaaggtaaagacgccgatcctgatcctctccggcatggccggcatcgaggacaaggtccgtggcctcggcttcggcgctgacgactacatgaccaagccgttccacaaggacgagctggtggcccgcatccatgccatcgtgcgacgctccaagggccatgcccagtcggtcatcaccaccggtgacctggtggtcaacctcgacgccaagaccgtcgaggtcggcggccagcgcgtgcacctcaccggcaaggaataccagatgctggagctgctctcgctgcgcaagggcacaacgctcaccaaggaaatgttcctcaaccacctctatggcggcatggacgagccggaattgaagatcatcgacgtcttcatctgcaaattgcgcaagaagctcgacgccgcatccggtggccagaactacatcgagacggtctggggccgcggctacgtgctgcgcgaacccgaagacatccgcgtcagcgcctga

SEQ ID NO: 107212 - protein, 231 aa, Mesorhizobium loti MAFF303099
MRVLLIEDDSATAQSIELMLKSESFNVYTTDLGEEGVDLGKLYDYDIILLDLNLPDMSGYEVLRTLRLSKVKTPILILSGMAGIEDKVRGLGFGADDYMTKPFHKDELVARIHAIVRRSKGHAQSVITTGDLVVNLDAKTVEVGGQRVHLTGKEYQMLELLSLRKGTTLTKEMFLNHLYGGMDEPELKIIDVFICKLRKKLDAASGGQNYIETVWGRGYVLREPEDIRVSA

SEQ ID NO: 107213 - DNA, 675 bp, Mesorhizobium loti MAFF303099; identical to SEQ ID NO: 105856
  CDS (1)..(675): transl_table=11

SEQ ID NO: 107214 - protein, 224 aa, Mesorhizobium loti MAFF303099; identical to SEQ ID NO: 105857

SEQ ID NO: 107215 - DNA, 666 bp, Mesorhizobium loti MAFF303099; identical to SEQ ID NO: 105858
  CDS (1)..(666): transl_table=11

SEQ ID NO: 107216 - protein, 221 aa, Mesorhizobium loti MAFF303099; identical to SEQ ID NO: 105859

SEQ ID NO: 107217 - DNA, 666 bp, Mesorhizobium loti MAFF303099; identical to SEQ ID NO: 105860
  CDS (1)..(666): transl_table=11

SEQ ID NO: 107218 - protein, 221 aa, Mesorhizobium loti MAFF303099; identical to SEQ ID NO: 105861

SEQ ID NO: 107219 - DNA, 672 bp, Mesorhizobium loti MAFF303099; identical to SEQ ID NO: 105862
  CDS (1)..(672): transl_table=11

SEQ ID NO: 107220 - protein, 223 aa, Mesorhizobium loti MAFF303099; identical to SEQ ID NO: 105863

SEQ ID NO: 107221 - DNA, 762 bp, Mycobacterium tuberculosis H37Rv
  CDS (1)..(762): transl_table=11
gtggcagatgaaacgacgatgagagctggtcgcggcccgggccgggcatgcggcagggtgtcgggtgtgcgcatcctggtggtcgaggacgagcccaagatgacggcgctgctggcgcgggcgctgaccgaggagggccacacggtcgacaccgttgccgacggccgccatgcggtggcggccgtcgacggcggtgactacgacgcggtggtgctggatgtgatgctgcccggtatcgacgggttcgaggtatgcgcgcggctgcgacggcagcgggtgtggacaccggtgctgatgcttaccgcccgcggcgcggtcaccgaccgcatcgcgggcctagacggcggcgccgacgattacctcaccaaaccgttcaacctcgacgaactgttcgcccggttgcgcgcgctgtcacggcgcgggcccatcccacgcccaccgacgctggaggccggcgatctacgcctggacccgagcgaacaccgagtctggcgtgccgacaccgaaatccggctcagtcacaaggaattcaccctgctggaagccctgatccgccgtcccggcatcgtccacacccgcgcccagctgctggaacgctgctgggacgccgcctacgaggcccgctccaacatcgtcgacgtctacatccgctacctgcgcgacaagatcgaccggcccttcggcgtcacctcgctggaaaccattcgcggtgccggataccggctgcgcaaggacggaggacggcatgcgctcccccgctga

SEQ ID NO: 107222 - protein, 253 aa, Mycobacterium tuberculosis H37Rv
MADETTMRAGRGPGRACGRVSGVRILVVEDEPKMTALLARALTEEGHTVDTVADGRHAVAAVDGGDYDAVVLDVMLPGIDGFEVCARLRRQRVWTPVLMLTARGAVTDRIAGLDGGADDYLTKPFNLDELFARLRALSRRGPIPRPPTLEAGDLRLDPSEHRVWRADTEIRLSHKEFTLLEALIRRPGIVHTRAQLLERCWDAAYEARSNIVDVYIRYLRDKIDRPFGVTSLETIRGAGYRLRKDGGRHALPR

SEQ ID NO: 107223 - DNA, 660 bp, Vibrio cholerae O1 biovar eltor str. N16961; identical to SEQ ID NO: 105866
  CDS (1)..(660): transl_table=11

SEQ ID NO: 107224 - protein, 219 aa, Vibrio cholerae O1 biovar eltor str. N16961; identical to SEQ ID NO: 105867

SEQ ID NO: 107225 - DNA, 657 bp, Vibrio cholerae O1 biovar eltor str. N16961; identical to SEQ ID NO: 105868
  CDS (1)..(657): transl_table=11

SEQ ID NO: 107226 - protein, 218 aa, Vibrio cholerae O1 biovar eltor str. N16961; identical to SEQ ID NO: 105869

SEQ ID NO: 107227 - DNA, 669 bp, Bacillus halodurans C-125
  CDS (1)..(669): transl_table=11
gtggctcgtatattaatcattgaggatgaaaagaaaattgcccgtgtccttcagcttgaattggagcatgaagggtacgagacggacgctgctttttcaggcagtgatggactcgaaacgtttcaagcacacgcgtgggatttagtgttgcttgacgtgatgctgccagagcttagtgggcttgaagtccttaggcggattcggatgacagatccggtcaccccgattattttgttaaccgcacgaaattcgatccctgacaaagtaagcggcctcgatttaggggcaaatgattatattacgaagccctttgagattgaagagctattagcgagagttcgagcgtgccttcgtacagtgcaaacgagggagcgagtagaagacacgctgatgtttcaagagttaacgatcaatgaaaaaacgagggatgtgcagcgcgggaatgaaaccattgagcttactccaaaagagtttgaacttctcgtattttttattaaaaataaagggcaagtgctgagccgggagcaaattttaaccaacgtctggggctttgactattatggcgacacgaatgtaatcgatgtctacgttcggtatttgcggaaaaagctgtccttaacggaggcgctccaaaccgtccgcggggtcggctaccggctaaaggagtaa

SEQ ID NO: 107228 - protein, 222 aa, Bacillus halodurans C-125
MARILIIEDEKKIARVLQLELEHEGYETDAAFSGSDGLETFQAHAWDLVLLDVMLPELSGLEVLRRIRMTDPVTPIILLTARNSIPDKVSGLDLGANDYITKPFEIEELLARVRACLRTVQTRERVEDTLMFQELTINEKTRDVQRGNETIELTPKEFELLVFFIKNKGQVLSREQILTNVWGFDYYGDTNVIDVYVRYLRKKLSLTEALQTVRGVGYRLKE

SEQ ID NO: 107229 - DNA, 672 bp, Pasteurella multocida subsp. multocida str. Pm70; identical to SEQ ID NO: 105870
  CDS (1)..(672): transl_table=11

SEQ ID NO: 107230 - protein, 223 aa, Pasteurella multocida subsp. multocida str. Pm70; identical to SEQ ID NO: 105871

SEQ ID NO: 107231 - DNA, 672 bp, Pseudomonas aeruginosa PAO1; identical to SEQ ID NO: 105872
  CDS (1)..(672): transl_table=11

SEQ ID NO: 107232 - protein, 223 aa, Pseudomonas aeruginosa PAO1; identical to SEQ ID NO: 105873

SEQ ID NO: 107233 - DNA, 678 bp, Pseudomonas aeruginosa PAO1
  CDS (1)..(678): transl_table=11
atgaaactgctggtagtggaagacgaggcgctgttgcgccaccacctctatacccgcctgggtgaacaggggcacgtggtggacgcggtaccggatgccgaggaagccctctaccgggtcagcgaataccaccacgacctggcggtgatcgacctcggcctgccgggcatgagcggcctggacctgatccgcgagctgcgttcgcagggcaagtccttcccgatcctgatcctcaccgcccgcggcaactggcaggacaaggtcgaaggcctggccgccggggccgacgactacgtggtcaagccgttccagttcgaggaactggaagcgcgcctgaacgcgttgctgcgacgctcctcggggttcgtccagtcgaccatcgaggccggccccctggtcctcgacctgaaccgcaagcaggcgctggtcgaggagcaaccggtggcgctgaccgcctacgaataccgcatcctcgaatacctcatgcggcatcaccagcaggtggtggccaaggaacgcctgatggaacagctctatcccgacgacgaggagcgcgacgccaacgtcatcgaggtgctggtcggccgcctgcggcgcaagctggaggcctgcggcggcttcaagccgatcgatacggtgcgcggccagggctacctgttcaccgagcgctgccggtga

SEQ ID NO: 107234 - protein, 225 aa, Pseudomonas aeruginosa PAO1
MKLLVVEDEALLRHHLYTRLGEQGHVVDAVPDAEEALYRVSEYHHDLAVIDLGLPGMSGLDLIRELRSQGKSFPILILTARGNWQDKVEGLAAGADDYVVKPFQFEELEARLNALLRRSSGFVQSTIEAGPLVLDLNRKQALVEEQPVALTAYEYRILEYLMRHHQQVVAKERLMEQLYPDDEERDANVIEVLVGRLRRKLEACGGFKPIDTVRGQGYLFTERCR

SEQ ID NO: 107235 - DNA, 681 bp, Pseudomonas aeruginosa PAO1; identical to SEQ ID NO: 105876
  CDS (1)..(681): transl_table=11

SEQ ID NO: 107236 - protein, 226 aa, Pseudomonas aeruginosa PAO1; identical to SEQ ID NO: 105877

SEQ ID NO: 107237 - DNA, 672 bp, Pseudomonas aeruginosa PAO1; identical to SEQ ID NO: 105878
  CDS (1)..(672): transl_table=11

SEQ ID NO: 107238 - protein, 223 aa, Pseudomonas aeruginosa PAO1; identical to SEQ ID NO: 105879

SEQ ID NO: 107239 - DNA, 681 bp, Pseudomonas aeruginosa PAO1; identical to SEQ ID NO: 105880
  CDS (1)..(681): transl_table=11

SEQ ID NO: 107240 - protein, 226 aa, Pseudomonas aeruginosa PAO1; identical to SEQ ID NO: 105881

SEQ ID NO: 107241 - DNA, 666 bp, Pseudomonas aeruginosa PAO1; identical to SEQ ID NO: 105882
  CDS (1)..(666): transl_table=11

SEQ ID NO: 107242 - protein, 221 aa, Pseudomonas aeruginosa PAO1; identical to SEQ ID NO: 105883

SEQ ID NO: 107243 - DNA, 693 bp, Lactococcus lactis subsp. lactis Il1403
  CDS (1)..(693): transl_table=11
atgacttcaaagaaaattttgattattgaggatgaaaagaatttagcgcgattcgtctcattagaattagaacatgaaggctatgcgactgagattaaagataatggtcgttctggtcttgaagaagcaacttcaaaagattatgatttaatcttgcttgatttgatgcttcctgaacttgacggttttgaggtagcccgtcgtttacgaaaagaaaaagatacaccaatcattatgatgacggcacgtgattcaacgatggaccgtgttgctggtcttgatattggggctgatgattatatcactaaaccttttgcgattgaggaacttttggcgcgtgttcgtgctttcttccgtcgtgaagagcatggtcatgccgttgaacgtgctgaaaatacttctttccgtgatcttgtgattgacaaaacgaatcgcacagttcatcgtggtaaaaaagtaattgatttaacacgtcgtgagtatgacctccttttgacattgatgcaaaatgttggcgatgttgtgactcgtgaacatttagtttcacaagtttggggatatgaagaaggaacagaaacaaatgttgtggatgtttatattcgttatcttagaaataaaattgatgttgaaggtcaagatagctatattcaaactgttcgtggcttaggttatgtaatgcgtgaacgcaaataa

SEQ ID NO: 107244 - protein, 230 aa, Lactococcus lactis subsp. lactis Il1403
MTSKKILIIEDEKNLARFVSLELEHEGYATEIKDNGRSGLEEATSKDYDLILLDLMLPELDGFEVARRLRKEKDTPIIMMTARDSTMDRVAGLDIGADDYITKPFAIEELLARVRAFFRREEHGHAVERAENTSFRDLVIDKTNRTVHRGKKVIDLTRREYDLLLTLMQNVGDVVTREHLVSQVWGYEEGTETNVVDVYIRYLRNKIDVEGQDSYIQTVRGLGYVMRERK

SEQ ID NO: 107245 - DNA, 696 bp, Xylella fastidiosa 9a5c; identical to SEQ ID NO: 105886
  CDS (1)..(696): transl_table=11

SEQ ID NO: 107246 - protein, 231 aa, Xylella fastidiosa 9a5c; identical to SEQ ID NO: 105887

SEQ ID NO: 107247 - DNA, 744 bp, Mycobacterium tuberculosis CDC1551
  CDS (1)..(744): transl_table=11
atgagagctggtcgcggcccgggccgggcatgcggcagggtgtcgggtgtgcgcatcctggtggtcgaggacgagcccaagatgacggcgctgctggcgcgggcgctgaccgaggagggccacacggtcgacaccgttgccgacggccgccatgcggtggcggccgtcgacggcggtgactacgacgcggtggtgctggatgtgatgctgcccggtatcgacgggttcgaggtatgcgcgcggctgcgacggcagcgggtgtggacaccggtgctgatgcttaccgcccgcggcgcggtcaccgaccgcatcgcgggcctagacggcggcgccgacgattacctcaccaaaccgttcaacctcgacgaactgttcgcccggttgcgcgcgctgtcacggcgcgggcccatcccacgcccaccgacgctggaggccggcgatctacgcctggacccgagcgaacaccgagtctggcgtgccgacaccgaaatccggctcagtcacaaggaattcaccctgctggaagccctgatccgccgtcccggcatcgtccacacccgcgcccagctgctggaacgctgctgggacgccgcctacgaggcccgctccaacatcgtcgacgtctacatccgctacctgcgcgacaagatcgaccggcccttcggcgtcacctcgctggaaaccattcgcggtgccggataccggctgcgcaaggacggaggacggcatgcgctcccccgctga

SEQ ID NO: 107248 - protein, 247 aa, Mycobacterium tuberculosis CDC1551
MRAGRGPGRACGRVSGVRILVVEDEPKMTALLARALTEEGHTVDTVADGRHAVAAVDGGDYDAVVLDVMLPGIDGFEVCARLRRQRVWTPVLMLTARGAVTDRIAGLDGGADDYLTKPFNLDELFARLRALSRRGPIPRPPTLEAGDLRLDPSEHRVWRADTEIRLSHKEFTLLEALIRRPGIVHTRAQLLERCWDAAYEARSNIVDVYIRYLRDKIDRPFGVTSLETIRGAGYRLRKDGGRHALPR

SEQ ID NO: 107249 - DNA, 702 bp, Agrobacterium tumefaciens str. C58; identical to SEQ ID NO: 105894
  CDS (1)..(702): transl_table=11

SEQ ID NO: 107250 - protein, 233 aa, Agrobacterium tumefaciens str. C58; identical to SEQ ID NO: 105895

SEQ ID NO: 107251 - DNA, 738 bp, Agrobacterium tumefaciens str. C58; identical to SEQ ID NO: 105896
  CDS (1)..(738): transl_table=11

SEQ ID NO: 107252 - protein, 245 aa, Agrobacterium tumefaciens str. C58; identical to SEQ ID NO: 105897

SEQ ID NO: 107253 - DNA, 672 bp, Sinorhizobium meliloti 1021; identical to SEQ ID NO: 105898
  CDS (1)..(672): transl_table=11

SEQ ID NO: 107254 - protein, 223 aa, Sinorhizobium meliloti 1021; identical to SEQ ID NO: 105899

SEQ ID NO: 107255 - DNA, 678 bp, Caulobacter crescentus CB15; identical to SEQ ID NO: 105902
  CDS (1)..(678): transl_table=11

SEQ ID NO: 107256 - protein, 225 aa, Caulobacter crescentus CB15; identical to SEQ ID NO: 105903

SEQ ID NO: 107257 - DNA, 672 bp, Sinorhizobium meliloti 1021
  CDS (1)..(672): transl_table=11
atgcgtttactcctcgtcgaggacagtcctcgcctcaccgaactcatcaacgagaccatgcatgacgcgggttggcggctcgacggcgtttcgacgctgcgcgatgccgaggccgccattgccgcgcgcgagcacgacctggttctcctcgatctcggccttcccgacggcgacggcctgcagctgctgcaatggattcggcgggagcatgtcggcctgccggtgctgatcatcaccgcccgcggatcggtcgacgagcgtatcgccgggctcgacgccggcgccgacgattatctcgtcaagccgtttcaccatcgcgaacttctgtctcgctgcagggcgatgctgaggcgaaatcccaacgctatacagccggtcctcgaggccggtgccctgcgctatgatcctgcaacggcggagcttacctgcgagggcgccgttctgcctcttcctccgcgcgagcgctctctgatcgagatcctgttgcgcgaggtcgggcgtgtcgtcccgaagcgcaggctcgaaacggcgctttcggaatatggccaggaactgagctcgaatgcgctggaactcgccgtctccagggtacgcaagcgactgcagtcggtggaaaccggcgtgcagatcgaaaccgtgcgcggcatcggctatctgctgcggaccgtttga

SEQ ID NO: 107258 - protein, 223 aa, Sinorhizobium meliloti 1021
MRLLLVEDSPRLTELINETMHDAGWRLDGVSTLRDAEAAIAAREHDLVLLDLGLPDGDGLQLLQWIRREHVGLPVLIITARGSVDERIAGLDAGADDYLVKPFHHRELLSRCRAMLRRNPNAIQPVLEAGALRYDPATAELTCEGAVLPLPPRERSLIEILLREVGRVVPKRRLETALSEYGQELSSNALELAVSRVRKRLQSVETGVQIETVRGIGYLLRTV

SEQ ID NO: 107259 - DNA, 678 bp, Sinorhizobium meliloti 1021; identical to SEQ ID NO: 105904
  CDS (1)..(678): transl_table=11

SEQ ID NO: 107260 - protein, 225 aa, Sinorhizobium meliloti 1021; identical to SEQ ID NO: 105905

SEQ ID NO: 107261 - DNA, 705 bp, Synechocystis sp. PCC 6803; identical to SEQ ID NO: 105906
  CDS (1)..(705): transl_table=11

SEQ ID NO: 107262 - protein, 234 aa, Synechocystis sp. PCC 6803; identical to SEQ ID NO: 105907

SEQ ID NO: 107263 - DNA, 669 bp, Nostoc sp. PCC 7120; identical to SEQ ID NO: 105912
  CDS (1)..(669): transl_table=11

SEQ ID NO: 107264 - protein, 222 aa, Nostoc sp. PCC 7120; identical to SEQ ID NO: 105913

SEQ ID NO: 107265 - DNA, 1833 bp, Nostoc sp. PCC 7120; identical to SEQ ID NO: 105914
  CDS (1)..(1833): transl_table=11

SEQ ID NO: 107266 - protein, 610 aa, Nostoc sp. PCC 7120; identical to SEQ ID NO: 105915

SEQ ID NO: 107267 - DNA, 699 bp, Ralstonia solanacearum GMI1000; identical to SEQ ID NO: 105916
  CDS (1)..(699): transl_table=11

SEQ ID NO: 107268 - protein, 232 aa, Ralstonia solanacearum GMI1000; identical to SEQ ID NO: 105917

SEQ ID NO: 107269 - DNA, 708 bp, Ralstonia solanacearum GMI1000; identical to SEQ ID NO: 105920
  CDS (1)..(708): transl_table=11

SEQ ID NO: 107270 - protein, 235 aa, Ralstonia solanacearum GMI1000; identical to SEQ ID NO: 105921

SEQ ID NO: 107271 - DNA, 675 bp, Ralstonia solanacearum GMI1000
  CDS (1)..(675): transl_table=11
atgaagctgctcctgatcgaggacaacgcacccctggcgcagtggttgtccgaagccctgcgccgtgcgcagtttacggtcgatcatgccagtgatggcgaatcggccgataccctgttgctgacgcagcactacgacgtcgtgctgcttgacctgcagttgccgtcgctgtccggccgcgccgtgctgcagcgtctgcgcgatcgacgcaacgccgtgccggtgatgatcctgaccgccgccggcggcatcgatgacaaggttgcctgtctgggcgccggcgcggacgactatctcgtcaagccgttcgagatccgcgaactgatcgcccgcatccaggtactggtgcgccgcaacacgccggccaacgcggtcgagctgcagtgcggtgacctgtcctatcacaccggcagccgcacgtttgcgctgtccggccggccgctggtgctgccggcgcgcgaacacaccgtgctggagatcctgatgctcaagctcgggcgcacggtgtccaagccggcgctggtcaacggcgtgttcgggctggaggacgacgccagccccgaggcgatcgagatctacatccatcggctgcgcaagaagctcgaacattccgctgccaccatcgttaccctgcgcgggctcggctatctgttgcgcgatgcgtcgacccagtag

SEQ ID NO: 107272 - protein, 224 aa, Ralstonia solanacearum GMI1000
MKLLLIEDNAPLAQWLSEALRRAQFTVDHASDGESADTLLLTQHYDVVLLDLQLPSLSGRAVLQRLRDRRNAVPVMILTAAGGIDDKVACLGAGADDYLVKPFEIRELIARIQVLVRRNTPANAVELQCGDLSYHTGSRTFALSGRPLVLPAREHTVLEILMLKLGRTVSKPALVNGVFGLEDDASPEAIEIYIHRLRKKLEHSAATIVTLRGLGYLLRDASTQ

SEQ ID NO: 107273 - DNA, 666 bp, Ralstonia solanacearum GMI1000; identical to SEQ ID NO: 105922
  CDS (1)..(666): transl_table=11

SEQ ID NO: 107274 - protein, 221 aa, Ralstonia solanacearum GMI1000; identical to SEQ ID NO: 105923

SEQ ID NO: 107275 - DNA, 666 bp, Ralstonia solanacearum GMI1000; identical to SEQ ID NO: 105926
  CDS (1)..(666): transl_table=11

SEQ ID NO: 107276 - protein, 221 aa, Ralstonia solanacearum GMI1000; identical to SEQ ID NO: 105927

SEQ ID NO: 107277 - DNA, 684 bp, Ralstonia solanacearum GMI1000; identical to SEQ ID NO: 8571
  CDS (1)..(684): transl_table=11

SEQ ID NO: 107278 - protein, 227 aa, Ralstonia solanacearum GMI1000; identical to SEQ ID NO: 8572

SEQ ID NO: 107279 - DNA, 741 bp, Ralstonia solanacearum GMI1000; identical to SEQ ID NO: 105930
  CDS (1)..(741): transl_table=11

SEQ ID NO: 107280 - protein, 246 aa, Ralstonia solanacearum GMI1000; identical to SEQ ID NO: 105931

SEQ ID NO: 107281 - DNA, 672 bp, Agrobacterium tumefaciens str. C58; identical to SEQ ID NO: 105934
  CDS (1)..(672): transl_table=11

SEQ ID NO: 107282 - protein, 223 aa, Agrobacterium tumefaciens str. C58; identical to SEQ ID NO: 105935

SEQ ID NO: 107283 - DNA, 681 bp, Agrobacterium tumefaciens str. C58; identical to SEQ ID NO: 105936
  CDS (1)..(681): transl_table=11

SEQ ID NO: 107284 - protein, 226 aa, Agrobacterium tumefaciens str. C58; identical to SEQ ID NO: 105937

SEQ ID NO: 107285 - DNA, 675 bp, Agrobacterium tumefaciens str. C58
  CDS (1)..(675): transl_table=11
ttgcgaatcttgcttcttgaggatgaacctgaaatggcgcgcgcgcttctggaggccttgcgccggcgggatgtgcttgccgatcatgtcagcaccatcagcgacgccgatgcccttgcgcgggacggctcttacgatgtcctggttctggaccgccgtcttcccgatggtgaggggctgaatcttgtggcttcgcttcgccgcagcaaaaattccgtgccgatccttgttctgaccgcgctcggaaatgtcgatcaccgtgtcgacgggctggatgccggggcggatgattatcttgccaagccctttgcgatcgaagaattgctcgcccgtctcagggctctccacaggcgtggcccgtcgcttgccgacaaatatacgcggttcggaaatctgggcattgatccgcgcagcaatgaggtcagcgttgcaggttccagtatcgaattgcggcggcgggagtatctggtactggaggccctgatgcggcgtccgaaccgcatcgtcacgcggtcgagcctgatcgaggccgtctatacgctcgatgacgagatcgagtccaatgctctcgatgcgcatatttcccgtatccgcaagaagctggcgcaggcggaagcgacggtggagataagagccgtgcgcaatattggttacctcgtccggttgaagacatga

SEQ ID NO: 107286 - protein, 224 aa, Agrobacterium tumefaciens str. C58
MRILLLEDEPEMARALLEALRRRDVLADHVSTISDADALARDGSYDVLVLDRRLPDGEGLNLVASLRRSKNSVPILVLTALGNVDHRVDGLDAGADDYLAKPFAIEELLARLRALHRRGPSLADKYTRFGNLGIDPRSNEVSVAGSSIELRRREYLVLEALMRRPNRIVTRSSLIEAVYTLDDEIESNALDAHISRIRKKLAQAEATVEIRAVRNIGYLVRLKT

SEQ ID NO: 107287 - DNA, 654 bp, Agrobacterium tumefaciens str. C58; identical to SEQ ID NO: 105938
  CDS (1)..(654): transl_table=11

SEQ ID NO: 107288 - protein, 217 aa, Agrobacterium tumefaciens str. C58; identical to SEQ ID NO: 105939

SEQ ID NO: 107289 - DNA, 687 bp, Streptococcus pyogenes MGAS8232
  CDS (1)..(687): transl_table=11
atgacaaagaaaattttaattattgaagatgaaaagaatctggctagattcgtttctcttgagctgcaacatgagggttatgaagtcattgttgaggtcaatggtcgtgaagggttagaaactgctttggaaaaagagtttgatttaatcctgcttgacttaatgttaccagagatggatggttttgaagtgacccgtcgtttgcaaaccgaaaaaacaacgtatatcatgatgatgactgcgcgtgattctattatggatgtggttgcaggtttagaccgcggtgcagacgactatattgttaaaccgtttgccattgaagaactacttgcccgtattcgtgctactttccgccgtcaagatattgaatctgagaagaaagtgcctagtcaaggcatttatcgagatctagttttaaatccacaaaaccgttcagttaatcgtggcgacgatgagattcctctcactaaacgtgaatatgatttgcttaatattttgatgactaacatgaatcgtgtcatgacacgtgaagaattattgtcaaatgtttggaaatatgatgaagccgttgagactaatgttgtagatgtctatattcgttatctccgcggcaaaattgacattccaggcaaggaatcttatatccaaacagtgcgtggcatgggatacgttattcgtgagaaataa

SEQ ID NO: 107290 - protein, 228 aa, Streptococcus pyogenes MGAS8232
MTKKILIIEDEKNLARFVSLELQHEGYEVIVEVNGREGLETALEKEFDLILLDLMLPEMDGFEVTRRLQTEKTTYIMMMTARDSIMDVVAGLDRGADDYIVKPFAIEELLARIRATFRRQDIESEKKVPSQGIYRDLVLNPQNRSVNRGDDEIPLTKREYDLLNILMTNMNRVMTREELLSNVWKYDEAVETNVVDVYIRYLRGKIDIPGKESYIQTVRGMGYVIREK

SEQ ID NO: 107291 - DNA, 666 bp, Streptomyces coelicolor A3(2)
  CDS (1)..(666): transl_table=11
atgaaccgcatcctcatcgtcgaggacgaggaacgcatcgcctccttcgtccagaagggcctgcgcgccaacggcttcaccaccaccgcggtcgccgacggcgacgccgcctacgagtacgccctcaccggcggcttcgacctcgtcgtcctggacatcggactgcccggccgggacggcttcacggtcctgcgcgagctgcgcgaggcccgggtgacgaccccggtgatcgtgctgaccgcacgggactcggtacgggacacggtggccggcctggagggcggcgccgacgactggatgaccaagccgttccgcttcgaggagctgctcgcccgggtccggctgcgcctgcggacggcggccagggcgccggaggtgacggtgctgaggtcggggccgctcagcctcgacctgcgcacccgccgcgcccggtccgagggccgcacggtggacctgacggcgcgtgagttcgtgctcctggagctgttcctgcgccacccggggcaggtactgtcccgcgagcagatcctgtcgcacgtgtggggctacgacttcgacccgggctccaacatcgtggacgtctacgtgcgggccctgcgcaagaagctcggcgcgcggcaggtggagaccgtgcgcgggatggggtaccggctgccgacctggtga

SEQ ID NO: 107292 - protein, 221 aa, Streptomyces coelicolor A3(2)
MNRILIVEDEERIASFVQKGLRANGFTTTAVADGDAAYEYALTGGFDLVVLDIGLPGRDGFTVLRELREARVTTPVIVLTARDSVRDTVAGLEGGADDWMTKPFRFEELLARVRLRLRTAARAPEVTVLRSGPLSLDLRTRRARSEGRTVDLTAREFVLLELFLRHPGQVLSREQILSHVWGYDFDPGSNIVDVYVRALRKKLGARQVETVRGMGYRLPTW

SEQ ID NO: 107293 - DNA, 678 bp, Streptomyces coelicolor A3(2)
  CDS (1)..(678): transl_table=11
atgacccgtgtactgctcgccgaggacgacgcgtccatctcggagccgctggcccgcgcactgcgcagggaagggtacgaggtcgaggtgcgtgaggacggacccaccgcagtcgacgcggggttgcagggcggtatcgacctggtcgtgctggacctgggcctgccgggcatggacggactcgaggtcgcccgccggctgcggtccgagggccacgccgtgccgatcctgatcctgaccgcgcgcgccgacgaggtggacaccgtcgtcggcctggacgcgggcgccgacgactacgtcaccaagcccttccgcctcgccgagctgctggcccgggtccgggccctgctgcggcgcggtgccgccgagccgccgcagccgcccgccacccacggtgtgcgcatcgacgtcgagtcgcaccgggcctggatgggagaggaggagctccagctcaccgcgaaggagttcgacctgctgcgggtcctggtgcgcgacgccggccgggtcgtcacccgcgaccagctgatgcgcgaggtctgggacaccacctggtggtcgtcgaccaagaccctcgacatgcacatctcctggctgcgcaagaagctgggcgacgacgcggccaacccgcgctacatcgccaccgtgcgcggcgtgggcttccgtttcgagaagaactga

SEQ ID NO: 107294 - protein, 225 aa, Streptomyces coelicolor A3(2)
MTRVLLAEDDASISEPLARALRREGYEVEVREDGPTAVDAGLQGGIDLVVLDLGLPGMDGLEVARRLRSEGHAVPILILTARADEVDTVVGLDAGADDYVTKPFRLAELLARVRALLRRGAAEPPQPPATHGVRIDVESHRAWMGEEELQLTAKEFDLLRVLVRDAGRVVTRDQLMREVWDTTWWSSTKTLDMHISWLRKKLGDDAANPRYIATVRGVGFRFEKN

SEQ ID NO: 107295 - DNA, 666 bp, Xanthomonas axonopodis pv. citri str. 306; identical to SEQ ID NO: 105948
  CDS (1)..(666): transl_table=11

SEQ ID NO: 107296 - protein, 221 aa, Xanthomonas axonopodis pv. citri str. 306; identical to SEQ ID NO: 105949

SEQ ID NO: 107297 - DNA, 663 bp, Chlorobium tepidum TLS; identical to SEQ ID NO: 105950
  CDS (1)..(663): transl_table=11

SEQ ID NO: 107298 - protein, 220 aa, Chlorobium tepidum TLS; identical to SEQ ID NO: 105951

SEQ ID NO: 107299 - DNA, 711 bp, Chlorobium tepidum TLS; identical to SEQ ID NO: 8527
  CDS (1)..(711): transl_table=11

SEQ ID NO: 107300 - protein, 236 aa, Chlorobium tepidum TLS; identical to SEQ ID NO: 8528

SEQ ID NO: 107301 - DNA, 690 bp, Thermosynechococcus elongatus BP-1
  CDS (1)..(690): transl_table=11
gtgaaagttttagttatcgaagatgataggacaattgcgggcttagttgctgaatctctagcacatcagcagtatattgttgaaattgcctatgatgccgagacaggactggactatttagaagccaccgcttttgacctccttatcttagacctcggcttacctggcatggacggtctcagcttttgccaaacaattcgccaaagaggtcactcgcttcctattctgattctgactgctcgagacactagcagcgacaaagtgatgggccttgatgctggggccgatgattacatggtcaagccctttgatctccctgagctattggcccgagttcgtgccctattgaggcgcaagccactgccctttgcccctattctccactggggtgccctcattcttgatcccgatagggctaaagtgacctataaccatcaagagctgcatcttacacccaaagagtatgccatcttagaggtgctcttgcgccatggcagccgtattctgagccgctcagccattatggattatgcttggccactggatgagatgccaggcgaggaaacggttaaagtacacttaagaagcctgcgtcataagttgaaagcagtaggcgctcccgccaatttgattgagactgtctatggttttggctatcggcttaatccaaactttcaatcggcaacttag

SEQ ID NO: 107302 - protein, 229 aa, Thermosynechococcus elongatus BP-1
MKVLVIEDDRTIAGLVAESLAHQQYIVEIAYDAETGLDYLEATAFDLLILDLGLPGMDGLSFCQTIRQRGHSLPILILTARDTSSDKVMGLDAGADDYMVKPFDLPELLARVRALLRRKPLPFAPILHWGALILDPDRAKVTYNHQELHLTPKEYAILEVLLRHGSRILSRSAIMDYAWPLDEMPGEETVKVHLRSLRHKLKAVGAPANLIETVYGFGYRLNPNFQSAT

SEQ ID NO: 107303 - DNA, 672 bp, Streptococcus agalactiae 2603V/R
  CDS (1)..(672): transl_table=11
atgaaaatccttgttgttgaagatgagtttgacttgaaccgtagtattgtaaaacttttaaaaaagcaacactacagtgttgacagtgcttcaaatggtgaagaagccttacaatttgtttcagtggcagaatatgatgtgattatcttagatgtaatgatgccaaaaatggacggcttcacctttttaaaactgcttcgcaacaaaggaagtcaagtatctattcttatgttgactgctcgagatgccgttgaagatcgtatcgcaggtctagattttggtgcggatgattaccttgtaaaaccatttgaatttggagaactcatggcccgaattcgagctatgttacgacgtgcaaatagacaagtatcttctgatgatattcaaattcaagatataacaatcaatttatctacaaagcaagtttggagaaacgacaatttgattgatttaacagctaaggaatacgaagtccttgagtatttggcacgtcacagagaccaagtcctctctcgtcatcaaattcgtgaacacgtttgggattatgattattatggagagtccaatattattgatgtccttatcaaaaaccttcgtcgaaaactagataacaatcgagatggatcactaataaaaactaaacgaggtttaggatatgttattccaaagtaa

SEQ ID NO: 107304 - protein, 223 aa, Streptococcus agalactiae 2603V/R
MKILVVEDEFDLNRSIVKLLKKQHYSVDSASNGEEALQFVSVAEYDVIILDVMMPKMDGFTFLKLLRNKGSQVSILMLTARDAVEDRIAGLDFGADDYLVKPFEFGELMARIRAMLRRANRQVSSDDIQIQDITINLSTKQVWRNDNLIDLTAKEYEVLEYLARHRDQVLSRHQIREHVWDYDYYGESNIIDVLIKNLRRKLDNNRDGSLIKTKRGLGYVIPK

SEQ ID NO: 107305 - DNA, 690 bp, Brucella suis 1330; identical to SEQ ID NO: 105956
  CDS (1)..(690): transl_table=11

SEQ ID NO: 107306 - protein, 229 aa, Brucella suis 1330; identical to SEQ ID NO: 105957

SEQ ID NO: 107307 - DNA, 660 bp, Shigella flexneri 2a str. 301
  CDS (1)..(660): transl_table=11
atgcgaattttactgatagaagatgacatgctgattggtgacggcatcaaaactggccttagtaaaatgggttttagtgtcgactggtttacacaaggtcgtcagggaaaagaggcgctttatagcgcaccttatgatgcggtgatcctggatttaaccttaccaggcatggatggtcgcgatattttgcgcgaatggcgagagaaaggtcagcgtgagccggtactgaacctgaccgcgcgtgatgcgttagcggaacgtgtagaagggctgcgtctgggagctgacgattatctgtgtaaaccttttgcgttgatagaagtcgccgccaggctggaggctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggtagtgattttattcgtaccgtgcatggtattggctacacattaggtgagaaatga

SEQ ID NO: 107308 - protein, 219 aa, Shigella flexneri 2a str. 301
MRILLIEDDMLIGDGIKTGLSKMGFSVDWFTQGRQGKEALYSAPYDAVILDLTLPGMDGRDILREWREKGQREPVLNLTARDALAERVEGLRLGADDYLCKPFALIEVAARLEALMRRTNGQASNELRHGNVMLDPGKRIATLAGEPLTLKPKEFALLELLMRNAGRVLPRKLIEEKLYTWDEEVTSNAVEVHVHHLRRKLGSDFIRTVHGIGYTLGEK

SEQ ID NO: 107309 - DNA, 660 bp, Shewanella oneidensis MR-1; identical to SEQ ID NO: 105960
  CDS (1)..(660): transl_table=11

SEQ ID NO: 107310 - protein, 219 aa, Shewanella oneidensis MR-1; identical to SEQ ID NO: 105961

SEQ ID NO: 107311 - DNA, 678 bp, Pseudomonas putida KT2440
  CDS (1)..(678): transl_table=11
atgaaactgctggtggtcgaggacgaagccctgcttcgccatcacctctacacccgcctgggcgaaagcggccatgtggtcgaggcggtcgctgatgccgaagaggcgctgtaccaggccgagcagtaccatttcgaccttgccatcatcgacctgggcctgcccggtatcagcggcctggagctgatcacgcgcctgcgcagccaggacaagaccttccccattctcatcctcacagcccgtggcaactggcaagacaaggtcgagggcctggccgccggtgccgacgactacctggtcaagccgttccagttcgaggagcttgaagcacggctcaatgccctgttgcgccgctccagtggtttcacccagtcgaccatcgccgctggccccttggtgcttgacctcaaccgcaagcaggccaccctcgacgaacaagccttggccctgaccgcctacgaataccgcatcctcgaatacctcatgcgccatcaccagcaggtggtggccaaggatcgcctgatggagcagttgtacccaggagacgaagagcgcgaccccaatgtcatcgaagtgctggttggccgcctgcgccgcaagcttgaaggcgagcgcggcttcaaacccatcgacacggtgcgcggcctgggctacctgttcaccgagcgctgccgatga

SEQ ID NO: 107312 - protein, 225 aa, Pseudomonas putida KT2440
MKLLVVEDEALLRHHLYTRLGESGHVVEAVADAEEALYQAEQYHFDLAIIDLGLPGISGLELITRLRSQDKTFPILILTARGNWQDKVEGLAAGADDYLVKPFQFEELEARLNALLRRSSGFTQSTIAAGPLVLDLNRKQATLDEQALALTAYEYRILEYLMRHHQQVVAKDRLMEQLYPGDEERDPNVIEVLVGRLRRKLEGERGFKPIDTVRGLGYLFTERCR

SEQ ID NO: 107313 - DNA, 672 bp, Pseudomonas putida KT2440; identical to SEQ ID NO: 105966
  CDS (1)..(672): transl_table=11

SEQ ID NO: 107314 - protein, 223 aa, Pseudomonas putida KT2440; identical to SEQ ID NO: 105967

SEQ ID NO: 107315 - DNA, 669 bp, Pseudomonas putida KT2440; identical to SEQ ID NO: 105970
  CDS (1)..(669): transl_table=11

SEQ ID NO: 107316 - protein, 222 aa, Pseudomonas putida KT2440; identical to SEQ ID NO: 105971

SEQ ID NO: 107317 - DNA, 663 bp, Pseudomonas putida KT2440; identical to SEQ ID NO: 105972
  CDS (1)..(663): transl_table=11

SEQ ID NO: 107318 - protein, 220 aa, Pseudomonas putida KT2440; identical to SEQ ID NO: 105973

SEQ ID NO: 107319 - DNA, 684 bp, Pseudomonas putida KT2440; identical to SEQ ID NO: 105974
  CDS (1)..(684): transl_table=11

SEQ ID NO: 107320 - protein, 227 aa, Pseudomonas putida KT2440; identical to SEQ ID NO: 105975

SEQ ID NO: 107321 - DNA, 660 bp, Vibrio vulnificus CMCP6; identical to SEQ ID NO: 105980
  CDS (1)..(660): transl_table=11

SEQ ID NO: 107322 - protein, 219 aa, Vibrio vulnificus CMCP6; identical to SEQ ID NO: 105981

SEQ ID NO: 107323 - DNA, 696 bp, Vibrio vulnificus CMCP6
  CDS (1)..(696): transl_table=11
atgaaacttctgatcattgaagacgaaaagaaaaccgggacgtatttaagaaaaggactttcagaagcaggctatctcgtcaatcttgcctgcgatggggttgatggcctctatcaagccaccagccaacgctatgatttaattgtattggacgtgatgttgccccacctcaatggttggcaagtgttgcgcgctctgcgcagtaaccaagtcgacaccccggtgattctgctcaccgcacgcgatcaagtcgaagatcgagtcaaaggactggaactgggcgctgatgattacatcgttaaacccttcgcctttgtcgaactgttggcgcgcattcgcaccgtgctcaaacgccaacaacccaccacccaaagcaccacccggctttccatcgccaatctccatctggatctgttgcgacgcaaagtgtttcgcgacaaagaacccattgccctcaccgccaaagagtttgccttgttggagctgtttatgcgcaaaacgggggaagtgatgtcgcgcagccaaatcgcctcttccgtttgggacatgaatttcgacagtgacaccaatgtcatcgacgtggccgtgcggcggctgcgcaataaagtcgacaaaccgtttgagccgaaattgattcacactgaacgtggcatgggctacgtgcttgaggagcgagagccttgttatgggatttag

SEQ ID NO: 107324 - protein, 231 aa, Vibrio vulnificus CMCP6
MKLLIIEDEKKTGTYLRKGLSEAGYLVNLACDGVDGLYQATSQRYDLIVLDVMLPHLNGWQVLRALRSNQVDTPVILLTARDQVEDRVKGLELGADDYIVKPFAFVELLARIRTVLKRQQPTTQSTTRLSIANLHLDLLRRKVFRDKEPIALTAKEFALLELFMRKTGEVMSRSQIASSVWDMNFDSDTNVIDVAVRRLRNKVDKPFEPKLIHTERGMGYVLEEREPCYGI

SEQ ID NO: 107325 - DNA, 657 bp, Vibrio vulnificus CMCP6; identical to SEQ ID NO: 105982
  CDS (1)..(657): transl_table=11

SEQ ID NO: 107326 - protein, 218 aa, Vibrio vulnificus CMCP6; identical to SEQ ID NO: 105983

SEQ ID NO: 107327 - DNA, 702 bp, Bradyrhizobium japonicum USDA 110
  CDS (1)..(702): transl_table=11
atgcgcgttttgctgattgaagatgacagcgccgtcgcgcagtcgatcgagctgatgctgaagtctgagagcttcaacgtctatacgaccgatttgggggaagaaggcgtcgatctcggtaaattatacgattacgacattatccttctcgacctcaacctgcctgacatgtccggctacgacgtgctcaagcaactccgggtctccaagatcaagaccccgattctgatcctctccggcctcgccggcatcgaggacaaggtcaagggtctcggcgtcggcgccgacgactacatgaccaagcccttccacaaggacgagctggtggcccgcatccacgcgatcgtgcgccgctccaagggccatgcccagtcggtcatccagaccggcgacctcgtcgtcaacctcgacaccaagacggtcgaagtcggcggccagcgcgtgcatctgaccggcaaggaataccagatgctggagctcctctcgctccgcaagggcacgaccctcaccaaggaaatgttcctcaaccacctctatggcggcatggacgagcccgagctgaagatcatcgacgtcttcatctgcaagctccgcaagaagctcgccaacgcctccgaaggccgcaacttcatcgagaccgtgtggggccgcggctacgtgctgcgcgagccgcacgagcacgaagagcgcattcccgcctga

SEQ ID NO: 107328 - protein, 233 aa, Bradyrhizobium japonicum USDA 110
MRVLLIEDDSAVAQSIELMLKSESFNVYTTDLGEEGVDLGKLYDYDIILLDLNLPDMSGYDVLKQLRVSKIKTPILILSGLAGIEDKVKGLGVGADDYMTKPFHKDELVARIHAIVRRSKGHAQSVIQTGDLVVNLDTKTVEVGGQRVHLTGKEYQMLELLSLRKGTTLTKEMFLNHLYGGMDEPELKIIDVFICKLRKKLANASEGRNFIETVWGRGYVLREPHEHEERIPA

SEQ ID NO: 107329 - DNA, 675 bp, Bradyrhizobium japonicum USDA 110
  CDS (1)..(675): transl_table=11
gtgcgcctgctcgttgttgaggacgaccccgatctcaatcgccagctcaccaaggcgctgacggacgccggctatgtcgtcgaccgcgccttcgacggggaggaggggcactatctcggcgacaacgagccgtacgatgccgtcgtactcgacatcggcctgccgaagaaggacggcatctcggtgctggaggcctggcgccgcaacggccgcaccatgccggtcctgatcctcaccgcgcgcgaccgctggagcgacaaggtccagggcttcgatgccggcgccgacgactatgtcgcaaagccgttccatctcgaggaggtgctggcgcgcatccgcgcgctgctgcgccgttccaccggccatgcccagagcgaactcagctgcggcccggtcacgctcgacaccaggaccggccgggtcagcgtgtccggcaatcccgtcaagatgacctcgcacgaatatcggcttctggcctacctgatgcaccattccggacgcgtggtctcccgcaccgagctggtcgagcatctctacgaccaggacttcgaccgcgactccaacaccatcgaggtcttcgtcggccgtattcgcaagaagctcgacgtcgacatcatccagaccgtccgcggcctcggctatctcctgaccccgccgcccgctccgggcgcctga

SEQ ID NO: 107330 - protein, 224 aa, Bradyrhizobium japonicum USDA 110; identical to SEQ ID NO: 105985

SEQ ID NO: 107331 - DNA, 744 bp, Bradyrhizobium japonicum USDA 110
  CDS (1)..(744): transl_table=11
atgcgattgccgctcgcgccatgtttagagaaggtgacctccttgaccgccgccgaacgcacgatgcgcctcctcatcattgaagacgaccgcgaatccgccgactacctcgtgaaggcgtttcgcgaagtcggacacattgccgaccacgcccccgacggcgaggaaggcctcgccatggccgagaacggggactacgacgtgctggtggtcgaccgcatgctgcccaagcgcgacggcttgtcgttgatcggcgcgctgcgcgacaagggcaacaccgcgccggtgctgattctctccgcgctcgggcaggtcgacgaccgcatcaagggcctgcgcgccggcggcgacgactatctgcccaagccctattccttcgccgagctcctggcgcgggtcgaggtgctgtcgcgccgccgcggcggcccggcggaggacacgctctatcgtgtcggcgatctcgagctcgaccggctctcccatcgcgtcgcccgcggcaaggacgaattgacgcttcagccgcgcgaattccgcctgctcgaatacctcatgaagcacgccggccaggtggtgacgcgcaccatgctgttggagaacgtctgggactatcatttcgatccgcagaccaacgtgatcgacgtgcacatttcgcggctgcgctccaagatcgacaagggttttgagcggccgctgctgcacacgatccgcggcgccgggtatatgatccgtgacggcattcggtaa

SEQ ID NO: 107332 - protein, 247 aa, Bradyrhizobium japonicum USDA 110
MRLPLAPCLEKVTSLTAAERTMRLLIIEDDRESADYLVKAFREVGHIADHAPDGEEGLAMAENGDYDVLVVDRMLPKRDGLSLIGALRDKGNTAPVLILSALGQVDDRIKGLRAGGDDYLPKPYSFAELLARVEVLSRRRGGPAEDTLYRVGDLELDRLSHRVARGKDELTLQPREFRLLEYLMKHAGQVVTRTMLLENVWDYHFDPQTNVIDVHISRLRSKIDKGFERPLLHTIRGAGYMIRDGIR

SEQ ID NO: 107333 - DNA, 675 bp, Bradyrhizobium japonicum USDA 110; identical to SEQ ID NO: 105986
  CDS (1)..(675): transl_table=11

SEQ ID NO: 107334 - protein, 224 aa, Bradyrhizobium japonicum USDA 110; identical to SEQ ID NO: 105987

SEQ ID NO: 107335 - DNA, 675 bp, Bradyrhizobium japonicum USDA 110
  CDS (1)..(675): transl_table=11
atgcggattttgctcgtcgaggatgaggcggagatggcgggcgcgctggcgtcggcgctaaagcgctacgacatggtggtagaccatgcccctacccttgccgacgctgaagaggccatttccgccgacgtccatgtcgcggtcctgctcgaccgccagctccccgacggcgacggccttgcactgattccgaagctccgggcgcgcgccgacggcgtgccgatcatcgtcctgaccgcgcgcggcgagctcgccgaccggatcgccgggctcgacagcggcgccgacgattatctggccaagccgttcgcggtcgaggagctgctggcgcgcctgcgcgccgtgatgcggcgccccgctggacttacgccggatgtcatccgcgcgggccgcctcgccttcgatgtcggccatcgcgaggcgagcatcgacggccagccgttcgagctgccgcgtcgcgagctgttggtgctcgaggcgctgatccgccgcatcggccgcaccgtgatacgctcggcgctggaagaggccgtctacaatttcgacgacgagatccagtcgaacgcgctggacacgcatatctcgcggctacgccgcaagctcgccgaggcggatgccggcatcgagatccacggcattcgcggcgtcggctatctcctgaagaagctgccatga

SEQ ID NO: 107336 - protein, 224 aa, Bradyrhizobium japonicum USDA 110
MRILLVEDEAEMAGALASALKRYDMVVDHAPTLADAEEAISADVHVAVLLDRQLPDGDGLALIPKLRARADGVPIIVLTARGELADRIAGLDSGADDYLAKPFAVEELLARLRAVMRRPAGLTPDVIRAGRLAFDVGHREASIDGQPFELPRRELLVLEALIRRIGRTVIRSALEEAVYNFDDEIQSNALDTHISRLRRKLAEADAGIEIHGIRGVGYLLKKLP

SEQ ID NO: 107337 - DNA, 696 bp, Xylella fastidiosa Temecula1; identical to SEQ ID NO: 105988
  CDS (1)..(696): transl_table=11

SEQ ID NO: 107338 - protein, 231 aa, Xylella fastidiosa Temecula1; identical to SEQ ID NO: 105989

SEQ ID NO: 107339 - DNA, 687 bp, Lactobacillus plantarum WCFS1
  CDS (1)..(687): transl_table=11
atgagtcgaatattaattattgaggatgaaaaaaacctcgcacgcttcgttgaattagaattaaaacacgaaggctatgatattcaagtcgaatataacggccgtaaagggttagacgcagcgttagctgaagattttgatgccatcctattagacctgatgttaccagaactgaacggtttggaagtctgccggcgggttcgtgaagtcaagaacacgccgattattatgatgacggcccgtgactccgtgattgatcgagtttccggcctggatcatggggcagatgattacattgttaagccatttgctatcgaagaattacttgcccgcttacgagcactattgcggcgaatcgatttggaaagtgaacaacaaagcactaaacaaacgaccgtcacttataaagacttgacgattgaaaaggaaaacttagtcgttaaacgcggcgacgaagtcatcaacttgacgaagcgtgaatatgaactgttattaactttaatggaaaatattaacgttgtcctcgctcgtgatgtcttactaaacaaagtatggggttacgaatcagaagttgaaacgaatgtcgtcgacgtttatatccgttacttacggaacaagattgaccgaccaggagaaaagagttacatccaaactgttcgtgggactggatacgtgattcgttcttaa

SEQ ID NO: 107340 - protein, 228 aa, Lactobacillus plantarum WCFS1
MSRILIIEDEKNLARFVELELKHEGYDIQVEYNGRKGLDAALAEDFDAILLDLMLPELNGLEVCRRVREVKNTPIIMMTARDSVIDRVSGLDHGADDYIVKPFAIEELLARLRALLRRIDLESEQQSTKQTTVTYKDLTIEKENLVVKRGDEVINLTKREYELLLTLMENINVVLARDVLLNKVWGYESEVETNVVDVYIRYLRNKIDRPGEKSYIQTVRGTGYVIRS

SEQ ID NO: 107341 - DNA, 678 bp, Pseudomonas syringae pv. tomato str. DC3000
  CDS (1)..(678): transl_table=11
atgaagttgttggtagtcgaggatgaagcgctgctgcgccatcacctgcgtacccgtctgaccgaagcggggcacgtggtggaagcggtggccaacgccgaagaagcgctgtatcaggttgcccaattcaatcacgatctggccgtgatcgacctcggcttgccgggcatcggcgggctggacctgattcgtcagttgcgcgcgctgggcaaggcttttccgatcctgatcctgaccgcgcgcggtaactggcaggacaaggtcgaggggctggccgccggggctgacgattacgtggtcaaaccgttccagttcgaagagctggaagcgcggctcaacgccttgttacgccgctccagcggctttattcagtcaaccatcaccgctggcccgctgttgctggacctcaaccgcaagcacgccgcgctgggcgagcagccgctggcgctgacggcctacgaataccgcattctcgaatacctgatgcttcatcatcagcaagtggtgcccaaagagcgcttgatggagcagttgtaccccgatgacgacgagcgcgatccgaacgtgatcgaagtgctggttggccggctgcgtcgtaaactggacagcagcgtggcgttcaaacccatcgaaaccgtgcgcggcatgggctatctgttcaatgagcgctgtacgtga

SEQ ID NO: 107342 - protein, 225 aa, Pseudomonas syringae pv. tomato str. DC3000
MKLLVVEDEALLRHHLRTRLTEAGHVVEAVANAEEALYQVAQFNHDLAVIDLGLPGIGGLDLIRQLRALGKAFPILILTARGNWQDKVEGLAAGADDYVVKPFQFEELEARLNALLRRSSGFIQSTITAGPLLLDLNRKHAALGEQPLALTAYEYRILEYLMLHHQQVVPKERLMEQLYPDDDERDPNVIEVLVGRLRRKLDSSVAFKPIETVRGMGYLFNERCT

SEQ ID NO: 107343 - DNA, 663 bp, Pseudomonas syringae pv. tomato str. DC3000; identical to SEQ ID NO: 105990
  CDS (1)..(663): transl_table=11

SEQ ID NO: 107344 - protein, 220 aa, Pseudomonas syringae pv. tomato str. DC3000; identical to SEQ ID NO: 105991

SEQ ID NO: 107345 - DNA, 684 bp, Pseudomonas syringae pv. tomato str. DC3000; identical to SEQ ID NO: 105992
  CDS (1)..(684): transl_table=11

SEQ ID NO: 107346 - protein, 227 aa, Pseudomonas syringae pv. tomato str. DC3000; identical to SEQ ID NO: 105993

SEQ ID NO: 107347 - DNA, 669 bp, Pseudomonas syringae pv. tomato str. DC3000; identical to SEQ ID NO: 105994
  CDS (1)..(669): transl_table=11

SEQ ID NO: 107348 - protein, 222 aa, Pseudomonas syringae pv. tomato str. DC3000; identical to SEQ ID NO: 105995

SEQ ID NO: 107349 - DNA, 672 bp, Pseudomonas syringae pv. tomato str. DC3000; identical to SEQ ID NO: 105996
  CDS (1)..(672): transl_table=11

SEQ ID NO: 107350 - protein, 223 aa, Pseudomonas syringae pv. tomato str. DC3000; identical to SEQ ID NO: 105997

SEQ ID NO: 107351 - DNA, 660 bp, Vibrio parahaemolyticus RIMD 2210633
  CDS (1)..(660): transl_table=11
atgaaaatacttgttgtcgaagatgatcctcgtctaggcgagcaaattatcgaaacgttggaaaataacggttgggtacctgagctatcacaagatggcattgacgcgctctaccgagcgacatccgaagaatgggacgcgattgtgctcgaccttggtctaccaaaactcgatggcttgaccgttttaaagggcattcgagatgaaaacatcaacactccggtcgtgatcctaagtgcgcgtgataccttaactcaacgagtagaaggcctaaacgctggcgcagatgattacctgactaaaccgtttgaaatggttgagcttatcgctcgtcttcgcgcccaactgcgcagagcatctggtaacgcttctccggtcatgcaaataggcgatttaagcctagataccagaacctcaaaagtgatgtggcaaggccaagcagtgagcctaacagcgctggaatataaagtagtcgcttactttatgcataatcctgaaaaagtcatttcacgcacggagcttgtggagcacatttacaagcaagactttgatcgtgactccaacacaattgaagtatttatcggtcgtattcgtaagaaaatcgccccaaaaatcatcaaaaccgtgcgtggcttagggtatcaactgaatgccgaataa

SEQ ID NO: 107352 - protein, 219 aa, Vibrio parahaemolyticus RIMD 2210633
MKILVVEDDPRLGEQIIETLENNGWVPELSQDGIDALYRATSEEWDAIVLDLGLPKLDGLTVLKGIRDENINTPVVILSARDTLTQRVEGLNAGADDYLTKPFEMVELIARLRAQLRRASGNASPVMQIGDLSLDTRTSKVMWQGQAVSLTALEYKVVAYFMHNPEKVISRTELVEHIYKQDFDRDSNTIEVFIGRIRKKIAPKIIKTVRGLGYQLNAE

SEQ ID NO: 107353 - DNA, 657 bp, Vibrio parahaemolyticus RIMD 2210633
  CDS (1)..(657): transl_table=11
atgcgcttattactcgtagaagatgacaaactactcggtcaatccatggtgacttcattaagtcgccatgggtacaccgtggattgggtggaaaaagggtctggcgtgactagcgcactcaaaacagaagcgttcactgccgtaattttggatctcactctacccgatatcgatggattggaagttctgcgtaatattcgcaaaggcggatttaagctcccagtgatgatacttaccgcacgagacgacattcgcgatcgcgttcaaggccttgatggcggcgcagatgattacctcggaaaaccgtttgcactcgaagagttgctcgctcgcttgcgtgtgttgattcgccgtcaatccggtagtgcagaagaaatcattcaagttgggcagttgtctttatccttatcggaacaaagcattcgctacgatgacgcgccgcttaaactcacgcgcaacgaatttaaaatcctcaccagcttgatgacgaacgccggacgcgtgcaaagtaaggagcaattgcaacaatcactgcacggctgggatgaaggttcaagcgacaacgcgatagaagttcacattcataacctacgtaaaaaagcccccaacgtcgccatcaaaaacattcgtggtgtggggtacattcttgaaaaataa

SEQ ID NO: 107354 - protein, 218 aa, Vibrio parahaemolyticus RIMD 2210633
MRLLLVEDDKLLGQSMVTSLSRHGYTVDWVEKGSGVTSALKTEAFTAVILDLTLPDIDGLEVLRNIRKGGFKLPVMILTARDDIRDRVQGLDGGADDYLGKPFALEELLARLRVLIRRQSGSAEEIIQVGQLSLSLSEQSIRYDDAPLKLTRNEFKILTSLMTNAGRVQSKEQLQQSLHGWDEGSSDNAIEVHIHNLRKKAPNVAIKNIRGVGYILEK

SEQ ID NO: 107355 - DNA, 687 bp, Streptococcus pyogenes SSI-1
  CDS (1)..(687): transl_table=11
atgacaaagaaaattttaattattgaagatgaaaagaatctggctagattcgtttctcttgagctgcaacatgaggggtatgaagtcattgttgaggtcaatggtcgtgaagggttagaaactgctttggaaaaagagtttgatttaatcctgcttgacttaatgttaccagagatggatggttttgaagtgacccgtcgtttgcaaaccgaaaaaacaacgtatatcatgatgatgactgcgcgtgattctattatggatgtggttgcaggtttagaccgcggtgcagacgactatattgttaaaccgtttgccattgaagaactacttgcccgtattcgtgctattttctgccgtcaagatattgaatctgagaagaaagtgcctagtcaaggcatttatcgagatctagttttaaatccacaaaaccgttcagttaatcgtggcgacgatgagatttctctcactaaacgtgaatatgatttgcttaatattttgatgactaatatgaatcgtgtcatgacacgtgaagaattattgtcaaatgtttggaaatatgatgaagccgttgagactaatgttgtagatgtctatattcgttatctccgcggcaaaattgacattccaggcaaggaatcttatatccaaacagtgcgtggcatgggatacgttattcgtgagaaataa

SEQ ID NO: 107356 - protein, 228 aa, Streptococcus pyogenes SSI-1
MTKKILIIEDEKNLARFVSLELQHEGYEVIVEVNGREGLETALEKEFDLILLDLMLPEMDGFEVTRRLQTEKTTYIMMMTARDSIMDVVAGLDRGADDYIVKPFAIEELLARIRAIFCRQDIESEKKVPSQGIYRDLVLNPQNRSVNRGDDEISLTKREYDLLNILMTNMNRVMTREELLSNVWKYDEAVETNVVDVYIRYLRGKIDIPGKESYIQTVRGMGYVIREK

SEQ ID NO: 107357 - DNA, 675 bp, Salmonella enterica subsp. enterica serovar Typhi Ty2; identical to SEQ ID NO: 105998
  CDS (1)..(675): transl_table=11

SEQ ID NO: 107358 - protein, 224 aa, Salmonella enterica subsp. enterica serovar Typhi Ty2; identical to SEQ ID NO: 105999

SEQ ID NO: 107359 - DNA, 669 bp, Salmonella enterica subsp. enterica serovar Typhi Ty2; identical to SEQ ID NO: 106000
  CDS (1)..(669): transl_table=11

SEQ ID NO: 107360 - protein, 222 aa, Salmonella enterica subsp. enterica serovar Typhi Ty2; identical to SEQ ID NO: 106001

SEQ ID NO: 107361 - DNA, 687 bp, Enterococcus faecalis V583
  CDS (1)..(687): transl_table=11
atgagcaacattttaattattgaagatgaaaagaacttagcgagattcgttgagcttgaattaaaacatgaggggtatacgacagaagtacactacaatggtcgtacaggattggaagccgctcttaacaacgaatgggatgctatccttcttgatttgatgttaccagaattaaatggattagaagtatgtcgccgtgttcgccaagtgaaaaatacaccaattattatgatgactgcgcgtgattcagtaattgaccgtgtttctggcttagaccatggagcggatgattatattgttaaaccatttgcaattgaagaattgttagctcgtttacgtgcgttacttcgtcgtattgatattgagggcgataaaaacgttgcaaaacaaacaacgattacatatcgtgacttaacaattgaaaaagaaaatcgtgtcgttcgtcgtaattctgaaatgattgaattaacaaaacgcgaatacgaattactattaacgctaatggaaaacgtgaacgttgtcttggcacgtgatgtgttactaaataaagtttggggctatgaaacagaagtagaaacaaacgttgtggatgtgtatatccgctacttacgaaataaaattgacgtacctggagaagaaagctacatccaaactgtccgtggaactggctacgttatgcgttcgtga

SEQ ID NO: 107362 - protein, 228 aa, Enterococcus faecalis V583
MSNILIIEDEKNLARFVELELKHEGYTTEVHYNGRTGLEAALNNEWDAILLDLMLPELNGLEVCRRVRQVKNTPIIMMTARDSVIDRVSGLDHGADDYIVKPFAIEELLARLRALLRRIDIEGDKNVAKQTTITYRDLTIEKENRVVRRNSEMIELTKREYELLLTLMENVNVVLARDVLLNKVWGYETEVETNVVDVYIRYLRNKIDVPGEESYIQTVRGTGYVMRS

SEQ ID NO: 107363 - DNA, 672 bp, Coxiella burnetii RSA 493; identical to SEQ ID NO: 106002
  CDS (1)..(672): transl_table=11

SEQ ID NO: 107364 - protein, 223 aa, Coxiella burnetii RSA 493; identical to SEQ ID NO: 106003

SEQ ID NO: 107365 - DNA, 678 bp, Streptomyces avermitilis MA-4680
  CDS (1)..(678): transl_table=11
atgacccgtgtactgctcgccgaggacgacgcgtccatctcggagccgctggcccgcgccctgcgccgggaaggttacgaggtcgaggtgcgcgaggacggacccaccgcactcgacgccggaatgcagggcggcgtcgacctggtcgtcctggacctcggtctgcccggcatggacggcctggaagtggcccgccggctgcgcgccgagggacacaccatcccgatcctcatcctgaccgcgcgcgccgacgaggtggacaccgtcgtcggcctcgacgcgggcgccgacgactacgtcaccaagccgttccgcctcgccgaactgctggcccgggtacgggccctgctgcggcgcggcgccgccgagccccagcagccgcccgccacgcacggcgtgcgcatcgacgtcgagtcgcaccgcgcgtggatgggggacgaggaactccagctgaccgcgaaggagttcgacctgctgcgcgtcctcgtccgggacgcgggccgggtcgtcacccgcgaccagctgatgcgcgaggtctgggacaccacctggtggtcgtccacgaagacgctggacatgcacatctcctggctgcgcaagaagctgggcgacgacgcggcgaacccccgctacatcgcgacggtgcgcggcgtgggcttccgcttcgagaagagctga

SEQ ID NO: 107366 - protein, 225 aa, Streptomyces avermitilis MA-4680
MTRVLLAEDDASISEPLARALRREGYEVEVREDGPTALDAGMQGGVDLVVLDLGLPGMDGLEVARRLRAEGHTIPILILTARADEVDTVVGLDAGADDYVTKPFRLAELLARVRALLRRGAAEPQQPPATHGVRIDVESHRAWMGDEELQLTAKEFDLLRVLVRDAGRVVTRDQLMREVWDTTWWSSTKTLDMHISWLRKKLGDDAANPRYIATVRGVGFRFEKS

SEQ ID NO: 107367 - DNA, 732 bp, Streptomyces avermitilis MA-4680
  CDS (1)..(732): transl_table=11
atgagccccgccgaaggcgaccgtgaaccccagcgcatcctgatcgtcgacgacgagcccgcggtgcgcgaagcactccagcgcagcctcgccttcgaggggtacgacaccgaggtggccgtcgacggcgcggacgctctggagaaggcgacggcataccagcccgacctggtcgtcctcgacatccagatgccccggatggacggcctcaccgccgcccgccgtatccgcggcgcgggcacgacgaccccgatcctgatgctgacggcccgcgacacggtgggcgaccgcgtcaccggcctggacgccggcgcggacgactacctggtcaagcccttcgagctggacgagctcttcgcccgtatccgcgccctgctgcgccgcagctcgtacgcggcgacggcggtgggcgtgccggaggacgacgcgctgacgttcggcgatctgcggatggacctggcgacgcgcgaggtcacgcgcggcggccggtcggtggagctgatccgtacggagttcacgctcctggagatgttcctggcgcacccccgccaggtcctcacccgggagcagatcctgaaggcggtctggggcttcgacttcgagccgtcctccaactccctggacgtgtacgtcatgtacctgcgccgcaagacggaggcgggcggtgagccgcgcctcgtccacacggtacggggcgtggggtatgtgctgcggtcgggcggcgcggaatga

SEQ ID NO: 107368 - protein, 243 aa, Streptomyces avermitilis MA-4680
MSPAEGDREPQRILIVDDEPAVREALQRSLAFEGYDTEVAVDGADALEKATAYQPDLVVLDIQMPRMDGLTAARRIRGAGTTTPILMLTARDTVGDRVTGLDAGADDYLVKPFELDELFARIRALLRRSSYAATAVGVPEDDALTFGDLRMDLATREVTRGGRSVELIRTEFTLLEMFLAHPRQVLTREQILKAVWGFDFEPSSNSLDVYVMYLRRKTEAGGEPRLVHTVRGVGYVLRSGGAE

SEQ ID NO: 107369 - DNA, 675 bp, Bacillus cereus ATCC 14579; identical to SEQ ID NO: 106004
  CDS (1)..(675): transl_table=11

SEQ ID NO: 107370 - protein, 224 aa, Bacillus cereus ATCC 14579; identical to SEQ ID NO: 106005

SEQ ID NO: 107371 - DNA, 672 bp, Nitrosomonas europaea ATCC 19718; identical to SEQ ID NO: 106006
  CDS (1)..(672): transl_table=11

SEQ ID NO: 107372 - protein, 223 aa, Nitrosomonas europaea ATCC 19718; identical to SEQ ID NO: 106007

SEQ ID NO: 107373 - DNA, 762 bp, Mycobacterium bovis AF2122/97
  CDS (1)..(762): transl_table=11
gtggcagatgaaacgacgatgagagctggtcgcggcccgggccgggcatgcggcagggtgtcgggtgtgcgcatcctggtgatcgaggacgagcccaagatgacggcgctgctggcgcgggcgctgaccgaggagggccacacggtcgacaccgttgccgacggccgccatgcggtggcggccgtcgacggcggtgactacgacgcggtggtgctggatgtgatgctgcccggtatcgacgggttcgaggtatgcgcgcggctgcgacggcagcgggtgtggacaccggtgctgatgcttaccgcccgcggcgcggtcaccgaccgcatcgcgggcctagacggcggcgccgacgattacctcaccaaaccgttcaacctcgacgaactgttcgcccggttgcgcgcgctgtcacggcgcgggcccatcccacgcccaccgacgctggaggccggcgatctacgcctggacccgagcgaacaccgagtctggcgtgccgacaccgaaatccggctcagtcacaaggaattcaccctgctggaagccctgatccgccgtcccggcatcgtccacacccgcgcccagctgctggaacgctgctgggacgccgcctacgaggcccgctccaacatcgtcgacgtctacatccgctacctgcgcgacaagatcgaccggcccttcggcgtcacctcgctggaaaccattcgcggtgccggataccggctgcgcaaggacggaggacggcatgcgctcccccgctga

SEQ ID NO: 107374 - protein, 253 aa, Mycobacterium bovis AF2122/97
MADETTMRAGRGPGRACGRVSGVRILVIEDEPKMTALLARALTEEGHTVDTVADGRHAVAAVDGGDYDAVVLDVMLPGIDGFEVCARLRRQRVWTPVLMLTARGAVTDRIAGLDGGADDYLTKPFNLDELFARLRALSRRGPIPRPPTLEAGDLRLDPSEHRVWRADTEIRLSHKEFTLLEALIRRPGIVHTRAQLLERCWDAAYEARSNIVDVYIRYLRDKIDRPFGVTSLETIRGAGYRLRKDGGRHALPR

SEQ ID NO: 107375 - DNA, 687 bp, Bordetella pertussis Tohama I; identical to SEQ ID NO: 106012
  CDS (1)..(687): transl_table=11

SEQ ID NO: 107376 - protein, 228 aa, Bordetella pertussis Tohama I; identical to SEQ ID NO: 106013

SEQ ID NO: 107377 - DNA, 681 bp, Bordetella pertussis Tohama I; identical to SEQ ID NO: 106014
  CDS (1)..(681): transl_table=11

SEQ ID NO: 107378 - protein, 226 aa, Bordetella pertussis Tohama I; identical to SEQ ID NO: 106015

SEQ ID NO: 107379 - DNA, 690 bp, Bordetella parapertussis 12822; identical to SEQ ID NO: 106016
  CDS (1)..(690): transl_table=11

SEQ ID NO: 107380 - protein, 229 aa, Bordetella parapertussis 12822; identical to SEQ ID NO: 106017

SEQ ID NO: 107381 - DNA, 654 bp, Bordetella parapertussis 12822
  CDS (1)..(654): transl_table=11
atggcggcctggctgatgcgggcgctggcgcagagcgggttcatgcccgaccacgcgccggacgcccgtacggccgaaggcctgatggcaggcaacgaatatgatgcggtggtcatggacctgcgcctgcccgacaagcacgggctggtgctgctgcgcgaaatgcgcaaccgggacgatcgtaccccggtgctgctgctgaccgcccagggcgcgctgcaggaccgggtgcgcgggctcaatctcggcgccgacgatttcctgaccaagccgttcgcgctcgaagagctggaggcccgcctgaccgccctggtgcggcgcagccgcggccggcagcccccccgcctgcaatgcggctcgctgtcgtacgacggcgaaagccgcgccttcaccctggacggtgcgttgctgttcctgacgccgcgcgagcatgccgccctggcggcgctgctgacccgcagcggctatccggtcgacaagtcgcagcttttcggcaaagtgttcacgcacgaaagcgaggccaatcccgacgccatcgaagtggtgctgcaccgcctgcgcaagaaactgacgggcagcgacgtgcgcatcgtcacggtgcgcggcctgggatacatgctggaaagcaccgtcagtgaatcctccgaaagctga

SEQ ID NO: 107382 - protein, 217 aa, Bordetella parapertussis 12822
MAAWLMRALAQSGFMPDHAPDARTAEGLMAGNEYDAVVMDLRLPDKHGLVLLREMRNRDDRTPVLLLTAQGALQDRVRGLNLGADDFLTKPFALEELEARLTALVRRSRGRQPPRLQCGSLSYDGESRAFTLDGALLFLTPREHAALAALLTRSGYPVDKSQLFGKVFTHESEANPDAIEVVLHRLRKKLTGSDVRIVTVRGLGYMLESTVSESSES

SEQ ID NO: 107383 - DNA, 672 bp, Bordetella bronchiseptica RB50
  CDS (1)..(672): transl_table=11
atgcgagtactcgtaatcgaagatgacaccaccctgggccacgcgctccaggagttcctggccgaccaggggtatgcggtcgattggctgaccgagggcgacaaggtcctgggagccctggcgggccagccctacgatctcctcctgctggacctcaacctgcccggcatgagcggcctcgacgtactgcgccaattgcgccaggacggcaaccaggtgccggtactgatcctcaccgcgcgcgacggcctggacgaccgcgtggcgggtctggatgccggcgccgacgactatgtcaccaagcctttcgacctgcccgaactggcggcgcgcgtgcgcgccctgggacgccgccggtccgggcaggcgcagccccagatcgaggtcggcccgctggtgttcgacaccgttgggcgcgaggtgcgcgccaacggcacgcgcctggcgttgtcggtgcgtgaactgtccgtgctggaaatgctgatggcgcgctccggccgggtcgtgaccaaacgccagatcgtcaattccctgtctgcctgggatgccgatttcagcgagaatgccgtcgaggtgtatgtctaccgcctgcgcaagcggctcgagggatccggcgccagcatacagacggtgcgcggcttcggctacatgctggacgtggaagcggcgtga

SEQ ID NO: 107384 - protein, 223 aa, Bordetella bronchiseptica RB50; identical to SEQ ID NO: 106019

SEQ ID NO: 107385 - DNA, 690 bp, Bordetella bronchiseptica RB50; identical to SEQ ID NO: 106020
  CDS (1)..(690): transl_table=11

SEQ ID NO: 107386 - protein, 229 aa, Bordetella bronchiseptica RB50; identical to SEQ ID NO: 106021

SEQ ID NO: 107387 - DNA, 672 bp, Bordetella bronchiseptica RB50; identical to SEQ ID NO: 106022
  CDS (1)..(672): transl_table=11

SEQ ID NO: 107388 - protein, 223 aa, Bordetella bronchiseptica RB50; identical to SEQ ID NO: 106023

SEQ ID NO: 107389 - DNA, 654 bp, Bordetella bronchiseptica RB50
  CDS (1)..(654): transl_table=11
atggcggcctggctgatgcgggcgctggcgcagagcgggttcacgcccgaccacgcgccggacgcccgtacggccgaaggcctgatggcgggcaacgaatatgatgcggtggtcatggacctgcgcctgcccgacaagcacgggctggtgctgctgcgcgaaatgcgcaaccgggacgaccgtacgccggtgctgctgctgaccgcccagggcgcgctgcaggaccgggtgcgcgggctcaatctcggcgccgacgatttcctgaccaagccgttcgcgctcgaagagctggaggcccgcctgaccgccctggtgcggcgcagccgcggccggcagcccccccgcctgcaatgcggctcgctgtcgtacgacggcgaaagccgcgccttcaccctggacggtgcgctgctgttcctgacgccgcgcgagcatgccgccctggcggcgctgctgacccgcagcggctatccggtcgacaagtcgcagcttttcggcaaagtgttcacgcacgaaagcgaggccaatcccgacgccatcgaagtggtgctgcaccgcctgcgcaagaaactgacgggcagcgacgtgcgcatcgtcacggtgcgcggcctgggatacatgctggaaagcaccgtcagtgaatcctccgaaagctga

SEQ ID NO: 107390 - protein, 217 aa, Bordetella bronchiseptica RB50
MAAWLMRALAQSGFTPDHAPDARTAEGLMAGNEYDAVVMDLRLPDKHGLVLLREMRNRDDRTPVLLLTAQGALQDRVRGLNLGADDFLTKPFALEELEARLTALVRRSRGRQPPRLQCGSLSYDGESRAFTLDGALLFLTPREHAALAALLTRSGYPVDKSQLFGKVFTHESEANPDAIEVVLHRLRKKLTGSDVRIVTVRGLGYMLESTVSESSES

SEQ ID NO: 107391 - DNA, 681 bp, Bordetella bronchiseptica RB50
  CDS (1)..(681): transl_table=11
atgcgcattctgttgatcgaagacgaagccgaactcgcccgctggctatcgcgcagccttgcccgccatgccgggttcgtggtcgaatgggccgatgacggcctgctggccgaacgccgcctggccgtggaagagttcgatgccatcatcctggacctcggcctgcccggcatggacggccataccctgttgacccgcatccgcgcccgcgacgaccgtacgccagtcctggtcctgaccgcgcgcgattcgctggccgaaagagtgggtaccctgcaccagggcgccgacgacttcctgcccaagcctttcgtgctggaggagctcgaagcccgcctgaccgcactgatccgccgcagccgcggacgggaacatccccgcctgacgctgggcgacctggcactggataccgcgtcacagcgattcaccgtcaaagggcagccgctggcgctttcgccccgggaacatgcggtgctgcgcgccctgatccagcgcagcggcgaaccgttgaacaagcaacagatcctcgatcgcatccagtccagcgacagcgatgtcaacctggaggccatcgaggtcctggtccatcggctgcgcaagaagctggccgacaccggcgtacagatcgtcaccatgcgcggcatgggctattgcctggagaacgctgttgacaacccgtag

SEQ ID NO: 107392 - protein, 226 aa, Bordetella bronchiseptica RB50; identical to SEQ ID NO: 106029

SEQ ID NO: 107393 - DNA, 657 bp, Chromobacterium violaceum ATCC 12472
  CDS (1)..(657): transl_table=11
atgcatttattgatcattgaggatgatttggatctgggtcgggccttgcaggccgcgctgaaggctgaggcggcgacgaccgagtgggcgcgcaagctggcggatgccgatgccttgttcgagccggaccgtttcgattgcgtgttgctggatttgagcctgccagacggcagcggcttggaattattgcgcgcctggcgcgccaggcaaatcaccgtgccggtgatcatgatcacggccagcgccgatttgagcgacaaattggcggggctggacgatggcgccgatgattatctgtgcaagccattcgcggtgtcggaaatggtgtcgcgggtgcgggcggtgtgccgccgcagcgcgcggcaggctagcgaaatatggagtctgggcgcgctcagcctcaaacccagcgcgcatctggcttggctggatggttcggcgctggacttgtcgccgcgtgagttccgcttgctagtggaactggcgcgcgatcccagccgcatcgtgtcgaaaactttgttgggccagcgcctggagccgctgggcgatgtcgtggatggcgcgaccatagaagtgcatctgtcgaatctgcggcgcaagataggcgccgaacgcatccgcaccgtgcgcggcgtgggttatcaatatgtggtttaa

SEQ ID NO: 107394 - protein, 218 aa, Chromobacterium violaceum ATCC 12472
MHLLIIEDDLDLGRALQAALKAEAATTEWARKLADADALFEPDRFDCVLLDLSLPDGSGLELLRAWRARQITVPVIMITASADLSDKLAGLDDGADDYLCKPFAVSEMVSRVRAVCRRSARQASEIWSLGALSLKPSAHLAWLDGSALDLSPREFRLLVELARDPSRIVSKTLLGQRLEPLGDVVDGATIEVHLSNLRRKIGAERIRTVRGVGYQYVV

SEQ ID NO: 107395 - DNA, 663 bp, Chromobacterium violaceum ATCC 12472; identical to SEQ ID NO: 106030
  CDS (1)..(663): transl_table=11

SEQ ID NO: 107396 - protein, 220 aa, Chromobacterium violaceum ATCC 12472; identical to SEQ ID NO: 106031

SEQ ID NO: 107397 - DNA, 666 bp, Chromobacterium violaceum ATCC 12472; identical to SEQ ID NO: 106032
  CDS (1)..(666): transl_table=11

SEQ ID NO: 107398 - protein, 221 aa, Chromobacterium violaceum ATCC 12472; identical to SEQ ID NO: 106033

SEQ ID NO: 107399 - DNA, 675 bp, Wolinella succinogenes DSM 1740
  CDS (1)..(675): transl_table=11
gtgaagattttgctcgttgaagacgatttggacctctccttggttctcaaaaaagctctacaaaaagaactctacaccattgatattgccccatgtctagcggatgcttctcatctcttaacccattttcgctacgatcttattcttcttgacttaatgcttcccgatggcaatgggatcaccttttgccaaaaactccgagcacgtggagagggaatccctctgattatactcacagccaaagacacgattatggatcgtgtctttggcttggatagtggcgcagatgactatttggccaagcccttctcactggctgaactcatggcaagaattcgagccaggctacgcaatccaataactccagaaaatcctctggcattaaagattgccgatttagaaatagaccaacgcactaaaaaggtaacccgcggaggcaagctcattctcttgacccccaaagagtatcgcctcttggaatttcttgctcttaatcaagacgcgactctctccgaagagattatcaaagaggctttactagattttgaagaacaaaccctgagcaatgttataagcgtctatatttaccgccttaggaacaaaatcgacaaagatcattccgttaagttaattcacactcttcgaggaatcggttatcgatttggatacctttga

SEQ ID NO: 107400 - protein, 224 aa, Wolinella succinogenes DSM 1740
MKILLVEDDLDLSLVLKKALQKELYTIDIAPCLADASHLLTHFRYDLILLDLMLPDGNGITFCQKLRARGEGIPLIILTAKDTIMDRVFGLDSGADDYLAKPFSLAELMARIRARLRNPITPENPLALKIADLEIDQRTKKVTRGGKLILLTPKEYRLLEFLALNQDATLSEEIIKEALLDFEEQTLSNVISVYIYRLRNKIDKDHSVKLIHTLRGIGYRFGYL

SEQ ID NO: 107401 - DNA, 669 bp, Gloeobacter violaceus PCC 7421
  CDS (1)..(669): transl_table=11
atgaaccggattttgattgccgaggatgagacgcgcattgccgcatttctagaaaaaggtctgcgcgccaacggctacaccaccatcgtcgtgcgcaacggcgtcgaagcggcccagatggcctcctgcgacgactttgacctgatgattctcgatttggggctaccgggcaaagcagggctcgtggtgctcgaggagatgcgtggccgcggcgagcggctgccggtgattatcctgaccgcccgcgacgacattgccgataaagtggcgggactcgaatcgggggcggacgattatgtgaccaaaccctttcgctttgaagaattgctcgcccgcgtgcgcgcccgcctgcgcgacaccggcaacggccgcacccaggagcaactggtcttgcgctcgggagaaatcagcctcgatctgcgcacgcgcaaggtgagcgccggggggcgcaccgtcgagttgtcggcgcgcgaattcacgctggcggagacgtttatgcgccacccgggccaggtgatgagccgcgagcatctgttgagccgcgtctggggctacgactacgatccgggctccaacatcgtcgatgtctacgtgggttacttgcgccgcaagctcaacaccgaccgtatcgagacggtgcgcggcatgggctaccgcctgcgcgcctga

SEQ ID NO: 107402 - protein, 222 aa, Gloeobacter violaceus PCC 7421
MNRILIAEDETRIAAFLEKGLRANGYTTIVVRNGVEAAQMASCDDFDLMILDLGLPGKAGLVVLEEMRGRGERLPVIILTARDDIADKVAGLESGADDYVTKPFRFEELLARVRARLRDTGNGRTQEQLVLRSGEISLDLRTRKVSAGGRTVELSAREFTLAETFMRHPGQVMSREHLLSRVWGYDYDPGSNIVDVYVGYLRRKLNTDRIETVRGMGYRLRA

SEQ ID NO: 107403 - DNA, 678 bp, Photorhabdus luminescens subsp. laumondii TTO1
  CDS (1)..(678): transl_table=11
atgcgtttacttttagtggaagaccaccctgaattattgcattggctgcaaaaagcactgagtagttcaggatttgccgtagatgttgctagtgatggtatagttgctgatcaattattacagacagaaaactatgcattattgattctggatgtttctttgcctaggttggatgggctttctctattagttcgtttgcgtaagcgtgggcaaaatttgccggtattattattaacggcgaaaactgatgtttctgagcgagtgaaagggcttaattctggtgccgatgattatctgacgaaaccttttgatttacaggaattggaagcacgtatccgggcattacttcgtcgtagtgcaggtgttctacaggagacgctgacattcggctcccttgtttatcaggatgatggttactttgttctgaacgatgagccattggctttgacaccaagggaactttcggttttgacaacattgttccatcgtcgggggaggcctgtttctaaacaacagctctttgaacaggtatttgcactgtcagatgaagcgaatccacaaagtattgaactttatgtgcaccggattcggaaaaaattatcaggcagtaatgtggggatcagtacattacggggattaggctatcgtctggagcgtcagaaagatgacatggtttaa

SEQ ID NO: 107404 - protein, 225 aa, Photorhabdus luminescens subsp. laumondii TTO1
MRLLLVEDHPELLHWLQKALSSSGFAVDVASDGIVADQLLQTENYALLILDVSLPRLDGLSLLVRLRKRGQNLPVLLLTAKTDVSERVKGLNSGADDYLTKPFDLQELEARIRALLRRSAGVLQETLTFGSLVYQDDGYFVLNDEPLALTPRELSVLTTLFHRRGRPVSKQQLFEQVFALSDEANPQSIELYVHRIRKKLSGSNVGISTLRGLGYRLERQKDDMV

SEQ ID NO: 107405 - DNA, 660 bp, Vibrio vulnificus YJ016; identical to SEQ ID NO: 106036
  CDS (1)..(660): transl_table=11

SEQ ID NO: 107406 - protein, 219 aa, Vibrio vulnificus YJ016; identical to SEQ ID NO: 106037

SEQ ID NO: 107407 - DNA, 657 bp, Vibrio vulnificus YJ016; identical to SEQ ID NO: 106038
  CDS (1)..(657): transl_table=11

SEQ ID NO: 107408 - protein, 218 aa, Vibrio vulnificus YJ016; identical to SEQ ID NO: 106039

SEQ ID NO: 107409 - DNA, 696 bp, Vibrio vulnificus YJ016
  CDS (1)..(696): transl_table=11
atgaaacttctgatcattgaagacgaaaagaaaaccgggacgtatttaagaaaaggactttcagaagcaggctatctcgtcaatctcgcctgcgatggggttgatggcctctatcaagccaccagccagcgctatgatttaattgtattggacgtgatgttgccccacctcaatggttggcaagtgttgcgcgctctgcgcagtagccaagtcgacaccccagtgattctgctcaccgcacgcgaccaagtcgaagatcgagtcaaaggactggagctgggcgccgatgattacatcgttaaacccttcgcctttgtcgaactgttggcgcgcattcgcaccgtgctcaaacgccagcaaccgactacccaaagcaccacccggctttccatcgccaatctccatctggacctgttgcgacgcaaagtgtttcgcgacaaagaacccattgccctcaccgccaaagagtttgccttgttggagctgtttatgcgcaaaacgggggaagtgatgtcgcgcagccaaatagcctcttccgtttgggacatgaatttcgacagtgacaccaatgtcatcgacgtggccgtgcggcggctgcgcaataaagtcgacaaaccgtttgagccgaaattgattcacactgaacgtggcatgggctacgtgcttgaggagcgagagccttgttatgggatttag

SEQ ID NO: 107410 - protein, 231 aa, Vibrio vulnificus YJ016
MKLLIIEDEKKTGTYLRKGLSEAGYLVNLACDGVDGLYQATSQRYDLIVLDVMLPHLNGWQVLRALRSSQVDTPVILLTARDQVEDRVKGLELGADDYIVKPFAFVELLARIRTVLKRQQPTTQSTTRLSIANLHLDLLRRKVFRDKEPIALTAKEFALLELFMRKTGEVMSRSQIASSVWDMNFDSDTNVIDVAVRRLRNKVDKPFEPKLIHTERGMGYVLEEREPCYGI

SEQ ID NO: 107411 - DNA, 687 bp, Klebsiella pneumoniae
  CDS (1)..(687): transl_table=11
ttgaccatgcagcgtattttaatcgttgaagacgaacaaaaaacaggtcgttacctgcagcagggactggttgaggaaggctatcaggccgatctctttaataatggccgcgatggtctcggggccgcgtcgaagggacagtatgatttgataatactggacgtgatgctgcctttcctcgacgggtggcaaatcatcagcgcactgagggagtccgggcacgaagaaccggtcctgtttttaaccgcaaaggacaacgtgcgggacaaagtgaaaggactggagcttggcgcagatgactacctgattaagccctttgattttacggagctggttgcacgtgtaagaaccctactgcgccgggcacgctcgcaggccgcaacagtctgcaccatcgccgatatgaccgttgatatggtgcgccggaccgtgatccgttcggggaagaagatccatctcaccggtaaagaatacgttctgcttgagttgctgctgcaacgcaccggagaagtgttacccaggagtcttatctcgtccctggtctggaacatgaattttgacagtgatacgaatgtgattgatgtcgccgtgagacgtctgagaagtaaaattgatgatgactttgagccaaaactgatccataccgttcgcggtgccggatatgtcctggagatcagagaagagtga

SEQ ID NO: 107412 - protein, 228 aa, Klebsiella pneumoniae
MTMQRILIVEDEQKTGRYLQQGLVEEGYQADLFNNGRDGLGAASKGQYDLIILDVMLPFLDGWQIISALRESGHEEPVLFLTAKDNVRDKVKGLELGADDYLIKPFDFTELVARVRTLLRRARSQAATVCTIADMTVDMVRRTVIRSGKKIHLTGKEYVLLELLLQRTGEVLPRSLISSLVWNMNFDSDTNVIDVAVRRLRSKIDDDFEPKLIHTVRGAGYVLEIREE

SEQ ID NO: 107413 - DNA, 702 bp, Rhodopseudomonas palustris CGA009
  CDS (1)..(702): transl_table=11
atgcgcgtattgctgattgaagatgacagcgccactgcgcagtcgatcgaattgatgctcaaatccgagagtttcaatgtctacacgacggatctcggagaagaaggcgtcgacctcggcaagctgtacgactacgacatcatcctgcttgatctgaacctgccggacatgtccggctatgacgttctcaagcagctgcgcgtctccaagatcaaaaccccgatcctgatcctgtccggcctcgccggcatcgaggacaaggtgaagggcctgggcgtcggtgccgacgactacatgaccaagccgttccacaaggacgagctggtcgcgcgcatccacgcgatcgtccgccgctccaagggccacgctcagtcggtgatccagaccggcgatctcgtcgtcaatctcgacaccaagaccgtcgaagtcggcggccagcgcgtgcatctgaccggcaaggaatatcagatgctggaactgctctccctgcggaagggcaccacgctgacgaaggaaatgttcctcaaccacctctacggtggcatggacgagccggaactgaagatcatcgacgtcttcatctgcaagctgcgcaagaagctcgccaacgcctccgacggccgcaacttcatcgagacggtgtggggccgcggttacgtgctccgcgagccgtccgaggacgacgtccgcatcccggcctga

SEQ ID NO: 107414 - protein, 233 aa, Rhodopseudomonas palustris CGA009
MRVLLIEDDSATAQSIELMLKSESFNVYTTDLGEEGVDLGKLYDYDIILLDLNLPDMSGYDVLKQLRVSKIKTPILILSGLAGIEDKVKGLGVGADDYMTKPFHKDELVARIHAIVRRSKGHAQSVIQTGDLVVNLDTKTVEVGGQRVHLTGKEYQMLELLSLRKGTTLTKEMFLNHLYGGMDEPELKIIDVFICKLRKKLANASDGRNFIETVWGRGYVLREPSEDDVRIPA

SEQ ID NO: 107415 - DNA, 675 bp, Rhodopseudomonas palustris CGA009; identical to SEQ ID NO: 106046
  CDS (1)..(675): transl_table=11

SEQ ID NO: 107416 - protein, 224 aa, Rhodopseudomonas palustris CGA009; identical to SEQ ID NO: 106047

SEQ ID NO: 107417 - DNA, 726 bp, Rhodopseudomonas palustris CGA009
  CDS (1)..(726): transl_table=11
atgttgcatcagagcccgcagagtttgaagaaatccgacagcaatatgcgtctgttgatcattgaggacgaccgcgaatccgccgactatctggtcaaggcgtttcgcgaggtcggccacatcgccgatcttgccagcgatggcgaagagggcctcgcgatggcggagagcggcgactacgacgtgctggtggtcgatcgcatgctgccgaagcgcgacggcctgtcggtgatcggaagcctgcgcgacaagggcaaccgcacgccggtgctgatcctgtccgcgctcggccaggtcgacgaccgtatcaagggcctgcgtgccggcggcgacgactatctgccgaagccctacgcctttgccgaactgctggcgcgcgtcgaggtgctgtcgcgccgtcatggcggcccggcggaagaaaccagctaccgcgtcgccgatctcgaactcgaccggctgtcgcatcgcgtcacccgcggcggcgaggagctgacgctgcagccgcgcgaattcaggctgctcgaatatctgatgaagcacgccgggcaggtggtgacccgcaccatgctgctggagaatgtctgggattatcacttcgatccgcagaccaacgtcatcgacgtccacatctcccggctgcgctcgaagatcgacaagggcttcgatcacccgctgctgcacaccatccgcggcgccggctacatgatccgcgacgggctgcgctga

SEQ ID NO: 107418 - protein, 241 aa, Rhodopseudomonas palustris CGA009
MLHQSPQSLKKSDSNMRLLIIEDDRESADYLVKAFREVGHIADLASDGEEGLAMAESGDYDVLVVDRMLPKRDGLSVIGSLRDKGNRTPVLILSALGQVDDRIKGLRAGGDDYLPKPYAFAELLARVEVLSRRHGGPAEETSYRVADLELDRLSHRVTRGGEELTLQPREFRLLEYLMKHAGQVVTRTMLLENVWDYHFDPQTNVIDVHISRLRSKIDKGFDHPLLHTIRGAGYMIRDGLR

SEQ ID NO: 107419 - DNA, 666 bp, Rhodopseudomonas palustris CGA009; identical to SEQ ID NO: 106048
  CDS (1)..(666): transl_table=11

SEQ ID NO: 107420 - protein, 221 aa, Rhodopseudomonas palustris CGA009; identical to SEQ ID NO: 106049

SEQ ID NO: 107421 - DNA, 675 bp, Geobacter sulfurreducens PCA; identical to SEQ ID NO: 106050
  CDS (1)..(675): transl_table=11

SEQ ID NO: 107422 - protein, 224 aa, Geobacter sulfurreducens PCA; identical to SEQ ID NO: 106051

SEQ ID NO: 107423 - DNA, 771 bp, Wolbachia endosymbiont of Drosophila melanogaster
  CDS (1)..(771): transl_table=11
atgcgtatattattaattgaagatgatcaagtaagtgcaaagactgtagttaacgccttaacttctgatggacacttctgtgacgttgttacttctgcacaagattataacaataatatggtttcctcaaacggagattactatgacctagttattttagatatacacttacctggtgatattgacggatatgatatattgttaagactaagaagtgcaaaaatcaaagttcctgtcttaatactttcatgcatatccgctgtcaatcacaaagctaaaggactcgggtatggtgccgatgattacttaaccaagccatttcataaaagcgagttattagctcgaattaaggccatagtgcgtcgtactaaaggccatcctgaatcggtgataaagattggtaatataaatatcaattttgatcacagggttgttgaggtgaaaggtaaaacggttcaccttactaataaagagtattctatgatagaattgctagcactgcgtaaaggaacagtactaacaaaagaaatgttcttaaatcatctttacaatggcttggatgaaccttcagataacaagatagttgatgtttttatgtgcaaattacgtaagaaacttgaaagtgcaaatgatggaaaaagccacatagaaaccgtttggggcagagggtatgttctgaaagagtatattgatgatgatgaatattctaatgttaatgtaggcgaaagtagtgatggctatcaagcagaacaagtgaaggacaacgcatga

SEQ ID NO: 107424 - protein, 256 aa, Wolbachia endosymbiont of Drosophila melanogaster
MRILLIEDDQVSAKTVVNALTSDGHFCDVVTSAQDYNNNMVSSNGDYYDLVILDIHLPGDIDGYDILLRLRSAKIKVPVLILSCISAVNHKAKGLGYGADDYLTKPFHKSELLARIKAIVRRTKGHPESVIKIGNININFDHRVVEVKGKTVHLTNKEYSMIELLALRKGTVLTKEMFLNHLYNGLDEPSDNKIVDVFMCKLRKKLESANDGKSHIETVWGRGYVLKEYIDDDEYSNVNVGESSDGYQAEQVKDNA

SEQ ID NO: 107425 - DNA, 684 bp, Bacillus anthracis str. Sterne
  CDS (1)..(684): transl_table=11
atgggagaaagaattttaatcgttgaggatgaagaaaaaattgctcgtgtcgtgcagttagaattagaatttgaaggatatgaaagtgaaattgcaaaaacaggtacagaggcaatggaaaagttcggaaatggtaattgggatttaatattacttgatgtaatgcttccaaatataagtgggttagaagttcttcgaagaatacgtttgaaaaatgctgtaatacctattattttattaactgctcgtgattcagttgttgacaaggttagtggtttagatcaaggagcaagtgactatatcacaaagccttttcaaatagaagaattattagcgagaattcgtgcttgtttaagaatttcaaatgtagtaaaagaagaggaaaatagtagttatcaaattgcagatttatatttagatgagaaaacgagagaagtgaaaagagggaatagtctaatcgacttaacaccacgtgagtttgatttattactatttttaatgaagcatgaaaatcaagtgttaaaccgtgagcaaattgtaacgaatgtttggggatttgattattatggcgatacaaatgttgttgacgtatatattcgatatttgcgcaaaaaagtagattgtaatgtggacgtaccacttattcacactgttagaggtgttgggtatgtcttaaaggtgtaa

SEQ ID NO: 107426 - protein, 227 aa, Bacillus anthracis str. Sterne
MGERILIVEDEEKIARVVQLELEFEGYESEIAKTGTEAMEKFGNGNWDLILLDVMLPNISGLEVLRRIRLKNAVIPIILLTARDSVVDKVSGLDQGASDYITKPFQIEELLARIRACLRISNVVKEEENSSYQIADLYLDEKTREVKRGNSLIDLTPREFDLLLFLMKHENQVLNREQIVTNVWGFDYYGDTNVVDVYIRYLRKKVDCNVDVPLIHTVRGVGYVLKV

SEQ ID NO: 107427 - DNA, 675 bp, Bacillus anthracis str. Sterne; identical to SEQ ID NO: 106056
  CDS (1)..(675): transl_table=11

SEQ ID NO: 107428 - protein, 224 aa, Bacillus anthracis str. Sterne; identical to SEQ ID NO: 106057

SEQ ID NO: 107429 - DNA, 669 bp, Bartonella quintana str. Toulouse; identical to SEQ ID NO: 106058
  CDS (1)..(669): transl_table=11

SEQ ID NO: 107430 - protein, 222 aa, Bartonella quintana str. Toulouse; identical to SEQ ID NO: 106059

SEQ ID NO: 107431 - DNA, 669 bp, Bartonella henselae str. Houston-1; identical to SEQ ID NO: 106060
  CDS (1)..(669): transl_table=11

SEQ ID NO: 107432 - protein, 222 aa, Bartonella henselae str. Houston-1; identical to SEQ ID NO: 106061

SEQ ID NO: 107433 - DNA, 681 bp, Acinetobacter sp. ADP1
  CDS (1)..(681): transl_table=11
atgattaaaattttatacattgaagatgatgtcatgattggcaagaccacttatcagttattgcgccatgaaaaatttgaagtcgactgggctaaaaccggacttgaagcactggattttctatttagacaaacctatcacctcgttttacttgatcttggactgcccgagcttgaaggcttggatgtcctcaaacacatccgaaaaaaaatcgagctcaataagattgcagttattattatcagtgcgcgagatcaaagccgcgacaagattcaagggctaaaacttggtgcagacgattatattgtcaaaccgtatgattttgacgaattggtcgcgcgtatcgaatctgtgttaaggcgtggtaattacgcctcactcaatgaattgaactttaatgtaggacaagttcagctctttccaaatacgcatcgtatattgaaagatgggcagccgattaacctgtctacaaaagaatggtcaattttagaaccaatgatgatgtatcccaaccagattttctccaaacagatgcttgaagaaaaactgtacgattgtgatgatgagatcaatagcaataccattgaagtacatattcataatttacgacaaaagcttggaaaagattttatccgaaatgtacgaggcttaggctattgtgttgaaactcaagaaaaataa

SEQ ID NO: 107434 - protein, 226 aa, Acinetobacter sp. ADP1
MIKILYIEDDVMIGKTTYQLLRHEKFEVDWAKTGLEALDFLFRQTYHLVLLDLGLPELEGLDVLKHIRKKIELNKIAVIIISARDQSRDKIQGLKLGADDYIVKPYDFDELVARIESVLRRGNYASLNELNFNVGQVQLFPNTHRILKDGQPINLSTKEWSILEPMMMYPNQIFSKQMLEEKLYDCDDEINSNTIEVHIHNLRQKLGKDFIRNVRGLGYCVETQEK

SEQ ID NO: 107435 - DNA, 657 bp, Acinetobacter sp. ADP1; identical to SEQ ID NO: 106062
  CDS (1)..(657): transl_table=11

SEQ ID NO: 107436 - protein, 218 aa, Acinetobacter sp. ADP1; identical to SEQ ID NO: 106063

SEQ ID NO: 107437 - DNA, 681 bp, Acinetobacter sp. ADP1
  CDS (1)..(681): transl_table=11
atgaccaaaatattgattattgaagatgatttcatgatcgctgaatctaccattaccttattgaaatatcatcaatttgaggtggaatgggtcaataatggatttgatggcttggcacaccttgcaaaacaaagttttgatttggtattactcgatcttggcctgcctatgatggatggtatgcaggtacttaagcagattcgtcagaaaactggcgtaccagttttaattatttcagcacgtgatcaacttgaaaatcgtgttgaaggtctaaatcagggcgcagatgattatttaatcaagccttatgaatttgatgaattacttgcacgtattaatgcattgttacgccgtaccaacagcaaagatgcatcttcattgcaacaagatcaggtcttgagcaatggtgaagtgattttgaatgttgaaaaacatattgcaacttttcaaggtaaggaaattgaactttctaatcgtgaatgggcgattctgattccattgatgacgcaccccaacaagattttttctaaagccaatcttgaagataaactgtacgattttgatagtgaagtgaccagtaataccattgaagtgtatattcatcacttgcgctcgaagctaggcaaaaattttattcgtactattcgtggattaggctaccgactgggtcagacatcataa

SEQ ID NO: 107438 - protein, 226 aa, Acinetobacter sp. ADP1
MTKILIIEDDFMIAESTITLLKYHQFEVEWVNNGFDGLAHLAKQSFDLVLLDLGLPMMDGMQVLKQIRQKTGVPVLIISARDQLENRVEGLNQGADDYLIKPYEFDELLARINALLRRTNSKDASSLQQDQVLSNGEVILNVEKHIATFQGKEIELSNREWAILIPLMTHPNKIFSKANLEDKLYDFDSEVTSNTIEVYIHHLRSKLGKNFIRTIRGLGYRLGQTS

SEQ ID NO: 107439 - DNA, 663 bp, Erwinia carotovora subsp. atroseptica SCRI1043; identical to SEQ ID NO: 106064
  CDS (1)..(663): transl_table=11

SEQ ID NO: 107440 - protein, 220 aa, Erwinia carotovora subsp. atroseptica SCRI1043; identical to SEQ ID NO: 106065

SEQ ID NO: 107441 - DNA, 669 bp, Erwinia carotovora subsp. atroseptica SCRI1043
  CDS (1)..(669): transl_table=11
atgaaattattgattgttgaagacgataagctgttgcaggaaggattattattggcactgagtcatgaaggttatgcctgcgattgcgcaggcacggccaaagaagcggacgcgctcatcaacagcgcgcactatagtctggtgattctcgatcttggtttaccggacgacgacgggctcgcgttgttatcacgctggcgtaagaataattaccaacatcccgtactcatcttaacggcacgggacaaggtcaacgatcgcgtcagcgggttggatgtcggtgcagacgattatctcgccaagccttttgcactgacggaattacaggcgcgcgtacgcgcgctgattcgccgcaatcagggatcgagtaacagcaagatacaggtcgacaacattacgctggatttaaacaaccagcaggtattgttggacgaaaagccggtggtactgacgccgaaagagttcgcgatactttcccgcttgatgctgaaagccggttctcaggtacaccgagagcttctgcatcaggatatttatgcctggaacgacgacccgtcctcgaattcgcttgaggtacatatccacaacctgcgtcaaaagataggcaaagaccgtatccggaccctgcgaggctttggctacctgctgaccaaaggggaacaaccatga

SEQ ID NO: 107442 - protein, 222 aa, Erwinia carotovora subsp. atroseptica SCRI1043
MKLLIVEDDKLLQEGLLLALSHEGYACDCAGTAKEADALINSAHYSLVILDLGLPDDDGLALLSRWRKNNYQHPVLILTARDKVNDRVSGLDVGADDYLAKPFALTELQARVRALIRRNQGSSNSKIQVDNITLDLNNQQVLLDEKPVVLTPKEFAILSRLMLKAGSQVHRELLHQDIYAWNDDPSSNSLEVHIHNLRQKIGKDRIRTLRGFGYLLTKGEQP

SEQ ID NO: 107443 - DNA, 687 bp, Streptococcus pyogenes MGAS10394
  CDS (1)..(687): transl_table=11
atgacaaagaaaattttaattattgaagatgaaaagaatctggctagattcgtttctcttgagctgcaacatgagggttatgaagtcattgttgaggtcaatggtcgcgaagggttagaaactgctttggaaaaagagtttgatttaatcctgcttgacttaatgttaccagagatggatggttttgaagtgacccgtcgtttgcaaaccgaaaaaacaacgtatatcatgatgatgactgcgcgtgattctattatggatgtggttgcaggtttagaccgcggtgcagacgactatattgttaaaccgtttgccattgaagaactacttgcccgtattcgtgctattttccgccgtcaagatattgaatctgagaagaaagtgcctagtcaaggtatttatcgagatctagttttaaatccacaaaaccgttcagttaatcgtggcgacgatgagatttctctcactaaacgtgaatatgatttgcttaatattttgatgactaacatgaatcgcgtcatgacacgtgaagaattattgtcaaatgtttggaaatatgatgaagccgttgagactaatgttgtagatgtctatattcgctatctccgcggcaaaattgacattccaggcaaggaatcttatatccaaacagtgcgtggcatgggatacgttattcgtgagaaataa

SEQ ID NO: 107444 - protein, 228 aa, Streptococcus pyogenes MGAS10394
MTKKILIIEDEKNLARFVSLELQHEGYEVIVEVNGREGLETALEKEFDLILLDLMLPEMDGFEVTRRLQTEKTTYIMMMTARDSIMDVVAGLDRGADDYIVKPFAIEELLARIRAIFRRQDIESEKKVPSQGIYRDLVLNPQNRSVNRGDDEISLTKREYDLLNILMTNMNRVMTREELLSNVWKYDEAVETNVVDVYIRYLRGKIDIPGKESYIQTVRGMGYVIREK

SEQ ID NO: 107445 - DNA, 663 bp, Yersinia pseudotuberculosis IP 32953; identical to SEQ ID NO: 106066
  CDS (1)..(663): transl_table=11

SEQ ID NO: 107446 - protein, 220 aa, Yersinia pseudotuberculosis IP 32953; identical to SEQ ID NO: 106067

SEQ ID NO: 107447 - DNA, 687 bp, Symbiobacterium thermophilum IAM 14863
  CDS (1)..(687): transl_table=11
atgtcgctccgggttctggttgtggacgacgatcccaagatcaccgccttcctgcgcaggagcctgacgctggagggatacgacgtcgccgtcgccaacagcggcacggaggcgttgcgcagcgtcacggcctccccgcctgacctcatggtgctggacatcatgatgcccgacgtcgacgggctggaggtgtgccgtcgcattcgggcggccggggagacctttcccatcctgatgctgacggcgcgggacgctgtcagcgaccgggtgaaggggctcgaccagggcgccgacgactacctggtcaagccgttcgccctggaggaactgctggcccggctgcgggccctgagccgccggggcgcccccgcccagggggaagacgggcaccgggtgctgcagtacgcggacctgcggctggacaccgccacgcgcgaggcctaccgcggcgaccggcagatctcgctcacggccaaggaatacgaactgcttcacctctttctctcgcacccgcgccaggtgctcacccgcgacaccctgatggagaaggtgtggggctacgactactccggcgaatccaatgtgctggaggtctacgtggcctacctccgcaacaagctcgaagccggaggggagccgcggctgatccagacggtgcggggcgtcgggtacgttctgaaggagtga

SEQ ID NO: 107448 - protein, 228 aa, Symbiobacterium thermophilum IAM 14863
MSLRVLVVDDDPKITAFLRRSLTLEGYDVAVANSGTEALRSVTASPPDLMVLDIMMPDVDGLEVCRRIRAAGETFPILMLTARDAVSDRVKGLDQGADDYLVKPFALEELLARLRALSRRGAPAQGEDGHRVLQYADLRLDTATREAYRGDRQISLTAKEYELLHLFLSHPRQVLTRDTLMEKVWGYDYSGESNVLEVYVAYLRNKLEAGGEPRLIQTVRGVGYVLKE

SEQ ID NO: 107449 - DNA, 681 bp, Mannheimia succiniciproducens MBEL55E; identical to SEQ ID NO: 106070
  CDS (1)..(681): transl_table=11

SEQ ID NO: 107450 - protein, 226 aa, Mannheimia succiniciproducens MBEL55E; identical to SEQ ID NO: 106071

SEQ ID NO: 107451 - DNA, 678 bp, Legionella pneumophila subsp. pneumophila str. Philadelphia 1; identical to SEQ ID NO: 106072
  CDS (1)..(678): transl_table=11

SEQ ID NO: 107452 - protein, 225 aa, Legionella pneumophila subsp. pneumophila str. Philadelphia 1; identical to SEQ ID NO: 106073

SEQ ID NO: 107453 - DNA, 744 bp, Burkholderia mallei ATCC 23344; identical to SEQ ID NO: 106074
  CDS (1)..(744): transl_table=11

SEQ ID NO: 107454 - protein, 247 aa, Burkholderia mallei ATCC 23344; identical to SEQ ID NO: 106075

SEQ ID NO: 107455 - DNA, 663 bp, Burkholderia mallei ATCC 23344; identical to SEQ ID NO: 106076
  CDS (1)..(663): transl_table=11

SEQ ID NO: 107456 - protein, 220 aa, Burkholderia mallei ATCC 23344; identical to SEQ ID NO: 106077

SEQ ID NO: 107457 - DNA, 678 bp, Burkholderia mallei ATCC 23344
  CDS (1)..(678): transl_table=11
atgaaactgctgctcgtggaagacaacgcggaactcgcgcactggatcgtcgatctgctgcgcggcgaaggcttcggcgtcgattcggcgcccgacggcgagagcgcggacaccgtgctgaaggcgcagcgctacgacgcgctgctgctcgacatgcggctgcccggcatgagcggcaaggagttgctcgcgcggctgcgccgccgcggcgacaacgtccccgtgctgatgctgaccgcgcacggctcggtcgacgacaaggtcgactgcttcagcgcgggcgccgacgactacgtcgtgaagcctttcgaatcgcgcgagctcgtcgcgcgcattcgcgcgttgatccggcggcaatgcggcgtcggcgcgacgcagctcgcatgcggcgatctcgtttatctgttcgcgacgcgagaattccagtgcggcggcgcgccgctcgcgctgcgccgccgcgagcacgcgattctcgaaacgctgatgctccagcagggcaagacggtctcgaaggcgcgcctcatggacagcgtgtacggcctcgacgacgagccgagcgccgatgcgatcgacatctacatccaccgtctgcgcaagcatctgtccggctcgctcgcgcagatcatcacgctgcgcgggctcggctacattcttcgaacccaggacgcggccgaataa

SEQ ID NO: 107458 - protein, 225 aa, Burkholderia mallei ATCC 23344
MKLLLVEDNAELAHWIVDLLRGEGFGVDSAPDGESADTVLKAQRYDALLLDMRLPGMSGKELLARLRRRGDNVPVLMLTAHGSVDDKVDCFSAGADDYVVKPFESRELVARIRALIRRQCGVGATQLACGDLVYLFATREFQCGGAPLALRRREHAILETLMLQQGKTVSKARLMDSVYGLDDEPSADAIDIYIHRLRKHLSGSLAQIITLRGLGYILRTQDAAE

SEQ ID NO: 107459 - DNA, 693 bp, Burkholderia mallei ATCC 23344; identical to SEQ ID NO: 106078
  CDS (1)..(693): transl_table=11

SEQ ID NO: 107460 - protein, 230 aa, Burkholderia mallei ATCC 23344; identical to SEQ ID NO: 106079

SEQ ID NO: 107461 - DNA, 660 bp, Burkholderia mallei ATCC 23344; identical to SEQ ID NO: 106080
  CDS (1)..(660): transl_table=11

SEQ ID NO: 107462 - protein, 219 aa, Burkholderia mallei ATCC 23344; identical to SEQ ID NO: 106081

SEQ ID NO: 107463 - DNA, 663 bp, Burkholderia mallei ATCC 23344; identical to SEQ ID NO: 106082
  CDS (1)..(663): transl_table=11

SEQ ID NO: 107464 - protein, 220 aa, Burkholderia mallei ATCC 23344; identical to SEQ ID NO: 106083

SEQ ID NO: 107465 - DNA, 672 bp, Burkholderia mallei ATCC 23344; identical to SEQ ID NO: 106084
  CDS (1)..(672): transl_table=11

SEQ ID NO: 107466 - protein, 223 aa, Burkholderia mallei ATCC 23344; identical to SEQ ID NO: 106085

SEQ ID NO: 107467 - DNA, 744 bp, Burkholderia pseudomallei K96243; identical to SEQ ID NO: 106086
  CDS (1)..(744): transl_table=11

SEQ ID NO: 107468 - protein, 247 aa, Burkholderia pseudomallei K96243; identical to SEQ ID NO: 106087

SEQ ID NO: 107469 - DNA, 672 bp, Burkholderia pseudomallei K96243; identical to SEQ ID NO: 106088
  CDS (1)..(672): transl_table=11

SEQ ID NO: 107470 - protein, 223 aa, Burkholderia pseudomallei K96243; identical to SEQ ID NO: 106089

SEQ ID NO: 107471 - DNA, 675 bp, Methylococcus capsulatus str. Bath; identical to SEQ ID NO: 106092
  CDS (1)..(675): transl_table=11

SEQ ID NO: 107472 - protein, 224 aa, Methylococcus capsulatus str. Bath; identical to SEQ ID NO: 106093

SEQ ID NO: 107473 - DNA, 666 bp, Methylococcus capsulatus str. Bath; identical to SEQ ID NO: 106094
  CDS (1)..(666): transl_table=11

SEQ ID NO: 107474 - protein, 221 aa, Methylococcus capsulatus str. Bath; identical to SEQ ID NO: 106095

SEQ ID NO: 107475 - DNA, 687 bp, Methylococcus capsulatus str. Bath; identical to SEQ ID NO: 106096
  CDS (1)..(687): transl_table=11

SEQ ID NO: 107476 - protein, 228 aa, Methylococcus capsulatus str. Bath; identical to SEQ ID NO: 106097

SEQ ID NO: 107477 - DNA, 678 bp, Legionella pneumophila str. Lens; identical to SEQ ID NO: 106100
  CDS (1)..(678): transl_table=11

SEQ ID NO: 107478 - protein, 225 aa, Legionella pneumophila str. Lens; identical to SEQ ID NO: 106101

SEQ ID NO: 107479 - DNA, 678 bp, Photobacterium profundum SS9
  CDS (1)..(678): transl_table=11
atgaaaatactggttatcgaagatgatctgaccacacgtgaatttatcgcgaaagggttacgtgagcatggctttgtcgtcgacgaggcaggcgacggtcatcaaggcttaatgatggccaccagttgcgaataccaactgatcattttagatcgcatgctgcctattttagatggcataaaggttttggcagctatacgcgcaactgaaaatcaaactcccatattgatcctcagtgccatggatagtgtggaagatcgtgtaacaggactgacagcaggtagcgatgattacttaaccaaaccttttgccctcgcagagttgattgctcgcgctcaaatattagtaaaacgccaccactcatcaacaaaagtcgtgactgaatatatttacgatgatctacgattagatatgaaatcacaccgagtatggcgaggcgaacgtttacttaatctacaacagaaagaatttttattactgcaatacttaatggagcacgctgaaaatgttgtctctagaatgagcttatttgaatcagtgtggagttatcacttcgaccctaaaaccaatgtgattgatgtacatattgcaaacctgcgtaaaaaattagaagaaaatggtgagttaggtttaatccatacaatccgaggtgcaggctatgtccttcgcaggtcctga

SEQ ID NO: 107480 - protein, 225 aa, Photobacterium profundum SS9
MKILVIEDDLTTREFIAKGLREHGFVVDEAGDGHQGLMMATSCEYQLIILDRMLPILDGIKVLAAIRATENQTPILILSAMDSVEDRVTGLTAGSDDYLTKPFALAELIARAQILVKRHHSSTKVVTEYIYDDLRLDMKSHRVWRGERLLNLQQKEFLLLQYLMEHAENVVSRMSLFESVWSYHFDPKTNVIDVHIANLRKKLEENGELGLIHTIRGAGYVLRRS

SEQ ID NO: 107481 - DNA, 687 bp, Ralstonia metallidurans CH34; identical to SEQ ID NO: 106102
  CDS (1)..(687): transl_table=11

SEQ ID NO: 107482 - protein, 228 aa, Ralstonia metallidurans CH34; identical to SEQ ID NO: 106103

SEQ ID NO: 107483 - DNA, 663 bp, Idiomarina loihiensis L2TR; identical to SEQ ID NO: 106104
  CDS (1)..(663): transl_table=11

SEQ ID NO: 107484 - protein, 220 aa, Idiomarina loihiensis L2TR; identical to SEQ ID NO: 106105

SEQ ID NO: 107485 - DNA, 666 bp, Idiomarina loihiensis L2TR
  CDS (1)..(666): transl_table=11
atgcgtctactactccttgaagatgacaaaaccttggcagaaggtatcattaagggcctgaatcgtatgggttatatggtcgaactcgctatgaatctgtcgcaagcggaaagtgcccttaaaactgaccaattcgaactggcaatttttgatcttggcctgcctgatggcaatgccgtatccttgatcaaaaaactgagaaaggcaggacaacccgttcctattgtcgtactcaccgcttgggatgatgttgatacgaaggtgctggcactgaatgagggcgccaatgattacgtagtaaagccgtttgagctacgtgagttagaagcccgtgttcgggttcaggtgcgaaaagcaaacctccaacttaatgatgttataaattgcggcgatctgagcgttgatattgcatcacaacaatgtcgctttcagcgcaaactcattaatttaacccggttagaatggatattactcaaacaactcgcgttgcatgtcggaaagatagtgagtaaagagcagttagaaactgcatgttatggctgggatagcgataacgaaagcaattcgttagaggtccatattcaccatttacgaaaaaaactgaaccctagcctgataactaccatccgaggtttaggctatctgttaaaagatgagtcatcatga

SEQ ID NO: 107486 - protein, 221 aa, Idiomarina loihiensis L2TR
MRLLLLEDDKTLAEGIIKGLNRMGYMVELAMNLSQAESALKTDQFELAIFDLGLPDGNAVSLIKKLRKAGQPVPIVVLTAWDDVDTKVLALNEGANDYVVKPFELRELEARVRVQVRKANLQLNDVINCGDLSVDIASQQCRFQRKLINLTRLEWILLKQLALHVGKIVSKEQLETACYGWDSDNESNSLEVHIHHLRKKLNPSLITTIRGLGYLLKDESS

SEQ ID NO: 107487 - DNA, 687 bp, Azoarcus sp. EbN1; identical to SEQ ID NO: 106106
  CDS (1)..(687): transl_table=11

SEQ ID NO: 107488 - protein, 228 aa, Azoarcus sp. EbN1; identical to SEQ ID NO: 106107

SEQ ID NO: 107489 - DNA, 681 bp, Azoarcus sp. EbN1; identical to SEQ ID NO: 106108
  CDS (1)..(681): transl_table=11

SEQ ID NO: 107490 - protein, 226 aa, Azoarcus sp. EbN1; identical to SEQ ID NO: 106109

SEQ ID NO: 107491 - DNA, 660 bp, Azoarcus sp. EbN1; identical to SEQ ID NO: 106110
  CDS (1)..(660): transl_table=11

SEQ ID NO: 107492 - protein, 219 aa, Azoarcus sp. EbN1; identical to SEQ ID NO: 106111

SEQ ID NO: 107493 - DNA, 663 bp, Azoarcus sp. EbN1; identical to SEQ ID NO: 106112
  CDS (1)..(663): transl_table=11

SEQ ID NO: 107494 - protein, 220 aa, Azoarcus sp. EbN1; identical to SEQ ID NO: 106113

SEQ ID NO: 107495 - DNA, 678 bp, Zymomonas mobilis subsp. mobilis ZM4
  CDS (1)..(678): transl_table=11
atgcgcgttttaatcgttgaggatgagccgacgctttcccgtcagttgcgaacaactttggaaggggctggctatgctgtcgatctggcgacagatggcgaagatggccatttcctaggctcgagcgaaaattatgatgccgttgtccttgatctcggtttgcccgaagtcgacggtctcaccgttcttgatcgttggcgcaaagaaggccgcgaaatgccagttctggttctgactgcacgggatagctggtctgataaagttgctggtcttgatgctggtgctgatgattatctgaccaagcctttccagaccgaagaattgattgcccgtttgcgggctttgatccgacgggcttccggtaatgcgtcttctgaattgacggcaggtgatgtccggcttgacactcgttccggcaaagtgactttagcgggtgagcctgtcaaattgacggcgcaggaatataagctgctttcctatctgatgcatcataaaggcaaagttgtcagtcgcaccgaaatgatcgagcatatttacgatcaggattttgatcgcgattctaatacgatcgaagtctttgtaacccgtattcgtaagaaactggggcaggatgttattacgactattcgcggtttgggttatgctttgaacgacccagaggatcggaataacggctga

SEQ ID NO: 107496 - protein, 225 aa, Zymomonas mobilis subsp. mobilis ZM4
MRVLIVEDEPTLSRQLRTTLEGAGYAVDLATDGEDGHFLGSSENYDAVVLDLGLPEVDGLTVLDRWRKEGREMPVLVLTARDSWSDKVAGLDAGADDYLTKPFQTEELIARLRALIRRASGNASSELTAGDVRLDTRSGKVTLAGEPVKLTAQEYKLLSYLMHHKGKVVSRTEMIEHIYDQDFDRDSNTIEVFVTRIRKKLGQDVITTIRGLGYALNDPEDRNNG

SEQ ID NO: 107497 - DNA, 687 bp, Francisella tularensis subsp. tularensis SCHU S4; identical to SEQ ID NO: 106114
  CDS (1)..(687): transl_table=11

SEQ ID NO: 107498 - protein, 228 aa, Francisella tularensis subsp. tularensis SCHU S4; identical to SEQ ID NO: 106115

SEQ ID NO: 107499 - DNA, 771 bp, Wolbachia endosymbiont strain TRS of Brugia malayi
  CDS (1)..(771): transl_table=11
atgcgtatattactaattgaagatgatcaagtcagtgcaaagactgtagttaacgctttgacttctgatgggcacttttgtgatgttgtaacttctgcgcaagactacaacaacaatatggtttcctcaaatggagatcactatgacctagttattctagatatacacttacctggtgatattgatgggtatgatatactgttaaggttaagaagtgcaaagattaaagttcctgtcttgatactttcatgtatatctgctgttaatcataaagctaagggacttgggtacggtgctgatgactacttaactaaaccatttcataagagtgagctacttgctcgaataaaagcaatagtacgtcgtactaaaggccatcctgagtcagtgataaagattggtaatataaacatcaattttgatcacagggttgttgaggtaaaaggtaaaacagttcaccttactaataaagaatattctatgatagaattgctagcgttacgtaaaggaacagtattaacaaaagaaatgtttttagatcatctttataacggcttagatgaaccttcagataataagatagttgatgtctttatgtgcaaattgcgcaagaaacttgaaagtgcaaatgatggaaaaagccacatagaaaccgtttggggcaggggttatgtcctgaaagagtatgttgatgaggaagagtattccagtattaatgtaggggaaaatagtagtgactatcaagcagaacaggttaaggacaatgcataa

SEQ ID NO: 107500 - protein, 256 aa, Wolbachia endosymbiont strain TRS of Brugia malayi
MRILLIEDDQVSAKTVVNALTSDGHFCDVVTSAQDYNNNMVSSNGDHYDLVILDIHLPGDIDGYDILLRLRSAKIKVPVLILSCISAVNHKAKGLGYGADDYLTKPFHKSELLARIKAIVRRTKGHPESVIKIGNININFDHRVVEVKGKTVHLTNKEYSMIELLALRKGTVLTKEMFLDHLYNGLDEPSDNKIVDVFMCKLRKKLESANDGKSHIETVWGRGYVLKEYVDEEEYSSINVGENSSDYQAEQVKDNA

SEQ ID NO: 107501 - DNA, 750 bp, Xanthomonas oryzae pv. oryzae KACC10331; identical to SEQ ID NO: 106122
  CDS (1)..(750): transl_table=11

SEQ ID NO: 107502 - protein, 249 aa, Xanthomonas oryzae pv. oryzae KACC10331; identical to SEQ ID NO: 106123

SEQ ID NO: 107503 - DNA, 669 bp, Salmonella enterica subsp. enterica serovar Choleraesuis str
  CDS (1)..(669): transl_table=11
atgaagatactgattgttgaagacgacacgctattattacaggggttaatactcgccgcgcaaaccgaaggctatgcgtgtgatggcttttcgacagtgcgtgccgccgagcatagtctggagtctggtcattacagtctgatggtgctggatttagggctgcccgatgaggatggcctgcatttcctgacgcgaatccgacagaaaaaatataccctgccagtactcattctgaccgcccgcgatacgctcaatgaccgcattaccgggctggatgtcggcgcagatgattatctggttaaacccttcgccctggaggagctgcacgcccgcatccgcgcactgctgcgccgccataataaccagggtgaaagtgaactgacggttggcaatctgacgctcaatataggccgccatcaggcatggagggatggacaggaactgaccctgacgcctaaggagtacgcgttgctctcacggttgatgctcaaggcaggcagtccggtgcaccgggaaattctttataacgatatctacaactgggataacgaaccctcgaccaacactctggaagtgcatatacataatttgcgcgacaaagtcggcaagtcgcgcattcgcacggttcgcgggtttggctacatgctggttgccactgaggaaagctaa

SEQ ID NO: 107504 - protein, 222 aa, Salmonella enterica subsp. enterica serovar Choleraesuis str
MKILIVEDDTLLLQGLILAAQTEGYACDGFSTVRAAEHSLESGHYSLMVLDLGLPDEDGLHFLTRIRQKKYTLPVLILTARDTLNDRITGLDVGADDYLVKPFALEELHARIRALLRRHNNQGESELTVGNLTLNIGRHQAWRDGQELTLTPKEYALLSRLMLKAGSPVHREILYNDIYNWDNEPSTNTLEVHIHNLRDKVGKSRIRTVRGFGYMLVATEES

SEQ ID NO: 107505 - DNA, 690 bp, Brucella abortus biovar 1 str. 9-941; identical to SEQ ID NO: 106126
  CDS (1)..(690): transl_table=11

SEQ ID NO: 107506 - protein, 229 aa, Brucella abortus biovar 1 str. 9-941; identical to SEQ ID NO: 106127

SEQ ID NO: 107507 - DNA, 678 bp, Brucella abortus biovar 1 str. 9-941; identical to SEQ ID NO: 106128
  CDS (1)..(678): transl_table=11

SEQ ID NO: 107508 - protein, 225 aa, Brucella abortus biovar 1 str. 9-941; identical to SEQ ID NO: 106129

SEQ ID NO: 107509 - DNA, 687 bp, Pseudomonas syringae pv. syringae B728a; identical to SEQ ID NO: 106132
  CDS (1)..(687): transl_table=11

SEQ ID NO: 107510 - protein, 228 aa, Pseudomonas syringae pv. syringae B728a; identical to SEQ ID NO: 106133

SEQ ID NO: 107511 - DNA, 669 bp, Pseudomonas syringae pv. syringae B728a
  CDS (1)..(669): transl_table=11
atgcgcctgctactggttgaagaccacgttcccctggccgatgagctgctcgctgcgctggggcgtcaaggctatgcggtcgactggctggctgacgggcgcgatgcggtttatcaaggagcaagcgagccgtatgacttgattgttctggatctgggcttacccggcatgccagggctcgaggttcttcagcagtggcgcagcaaaggtctggcgacccctgtgttgattctgaccgcgcggggttcctggtcagagcgtatagaaggtttgaaggcaggcgctgatgattacctgaccaagccttttcatcctgaagagctgcagctgcgtattcaggcgctgttgcgacgttcgcacgggctggccaaccagcccacgctggaatcggccggtcttaatctggatgaaggccggcaatgcgtcagccgggatggcgtggatatccagctcacctcggctgagtttcgtctgctgcgttatttcatgctccacccgggacagattctctcgaaaagccatctgtcggagcatttgtacgatggcgaaaacgagcgtgattccaatgttattgaagtccatgtcaatcacctgaggcgcaagttgggccgtgcagtcgtcgagacacgccgtggccagggctatctgtatggcggagccggcggttga

SEQ ID NO: 107512 - protein, 222 aa, Pseudomonas syringae pv. syringae B728a
MRLLLVEDHVPLADELLAALGRQGYAVDWLADGRDAVYQGASEPYDLIVLDLGLPGMPGLEVLQQWRSKGLATPVLILTARGSWSERIEGLKAGADDYLTKPFHPEELQLRIQALLRRSHGLANQPTLESAGLNLDEGRQCVSRDGVDIQLTSAEFRLLRYFMLHPGQILSKSHLSEHLYDGENERDSNVIEVHVNHLRRKLGRAVVETRRGQGYLYGGAGG

SEQ ID NO: 107513 - DNA, 663 bp, Pseudomonas syringae pv. syringae B728a; identical to SEQ ID NO: 106134
  CDS (1)..(663): transl_table=11

SEQ ID NO: 107514 - protein, 220 aa, Pseudomonas syringae pv. syringae B728a; identical to SEQ ID NO: 106135

SEQ ID NO: 107515 - DNA, 672 bp, Pseudomonas syringae pv. syringae B728a
  CDS (1)..(672): transl_table=11
atgcgtgttcttcttgtggaagatcatctgcaattggctgaaagtgtcgcgcaggcgctcaaaagcgcgggtttgaccgttgatgtgctgcatgatggcgtggctgccgacctggcgttgaacagcgaggaatacgccgttgccattctcgatgtcgggttgccgcgcatggatggcttcgaagtgctggcgcgtctgcgcgcgcgcagcaaaaacctgccggtgctgatgctgacggcgcgcagtgacgtcaaggaccgggtccatggcctgaatctgggcgccgacgactacctggccaagccttttgaactctccgagctggaagccagggtcaaggccttgctgcggcgcagtgtgctgggtggcgagcggcaacagtgttgcggcgtgctggcctacgatctggatacgcgacgtttcacgcttggtgaagaactgctgaccctgacctctcgcgaacaggcggtgctggaagcgcttatcgcccggccgggtcgggtgatgagcaaggagcaactggcggcgcaggtgttcgggctcgatgaagaagccagccccgacgccatcgagatctatgtccatcgtctgcggaaaaagctcgacgggcattccgtggccatcgtgacctttcgcggtctggggtatctgctggaaagccgtgatgattaa

SEQ ID NO: 107516 - protein, 223 aa, Pseudomonas syringae pv. syringae B728a
MRVLLVEDHLQLAESVAQALKSAGLTVDVLHDGVAADLALNSEEYAVAILDVGLPRMDGFEVLARLRARSKNLPVLMLTARSDVKDRVHGLNLGADDYLAKPFELSELEARVKALLRRSVLGGERQQCCGVLAYDLDTRRFTLGEELLTLTSREQAVLEALIARPGRVMSKEQLAAQVFGLDEEASPDAIEIYVHRLRKKLDGHSVAIVTFRGLGYLLESRDD

SEQ ID NO: 107517 - DNA, 666 bp, Xanthomonas campestris pv. campestris str. 8004; identical to SEQ ID NO: 106138
  CDS (1)..(666): transl_table=11

SEQ ID NO: 107518 - protein, 221 aa, Xanthomonas campestris pv. campestris str. 8004; identical to SEQ ID NO: 106139

SEQ ID NO: 107519 - DNA, 666 bp, Haemophilus influenzae 86-028NP; identical to SEQ ID NO: 106140
  CDS (1)..(666): transl_table=11

SEQ ID NO: 107520 - protein, 221 aa, Haemophilus influenzae 86-028NP; identical to SEQ ID NO: 106141

SEQ ID NO: 107521 - DNA, 681 bp, Pseudomonas fluorescens Pf-5
  CDS (1)..(681): transl_table=11
atgcgtttgctggtagttgaagacgaagccaagaccgcccatttccttgccaagggcctgggagagtccggctttgccgtggacgtggccctgaacggcctggacgggcgctatttcatcgagcagcaggagtacgacctgatcatcctcgacgtcatgctccccggcctcaacggctggcagttgctgcaactggtgcgccagcgcggtgccaccccggtgctgttcctcactgcccgcgacgctatcgaggaccgggtccgcggcctggaactgggcgccgacgactacctgctcaagcccttcgcctttgccgagctactggcccgggtgcgcaccctgctgcgccgcggaccgctgcgcgaggccgagtccttcagcatcgccgacctggagatcgacgtgctgcgccgtcgcgtcagccgtggcggccagcgcatcgccctgaccaacaaggagttcgccctgctgcacctgttggccagccgccagggcgaagtgctgtcgcggaccctcatcgcctcccaggtgtggaacctgaacttcgacagcgacaccaacatggtggaagtagcggtacgaaggttgcgggccaaggtcgacgacccctacatgcccaagctgatccacaccgtgcgtggcgtcggctaccagctggaagccccggatgaagcgctctag

SEQ ID NO: 107522 - protein, 226 aa, Pseudomonas fluorescens Pf-5
MRLLVVEDEAKTAHFLAKGLGESGFAVDVALNGLDGRYFIEQQEYDLIILDVMLPGLNGWQLLQLVRQRGATPVLFLTARDAIEDRVRGLELGADDYLLKPFAFAELLARVRTLLRRGPLREAESFSIADLEIDVLRRRVSRGGQRIALTNKEFALLHLLASRQGEVLSRTLIASQVWNLNFDSDTNMVEVAVRRLRAKVDDPYMPKLIHTVRGVGYQLEAPDEAL

SEQ ID NO: 107523 - DNA, 672 bp, Pseudomonas fluorescens Pf-5; identical to SEQ ID NO: 106142
  CDS (1)..(672): transl_table=11

SEQ ID NO: 107524 - protein, 223 aa, Pseudomonas fluorescens Pf-5; identical to SEQ ID NO: 106143

SEQ ID NO: 107525 - DNA, 663 bp, Pseudomonas fluorescens Pf-5
  CDS (1)..(663): transl_table=11
atgcgcctgctgcttgtcgaagatgatcgtgccctcggccagggcatccgcgtggccctgagcgccgaaggctacaccctggactggctgcaggacggtgccagcgccctgcacgccctgcgcaccgaaagcttcgacctgttgctgctggacctgggcctgccgcggctcgacggcctcgaactgctgcagcaattgcgtgccgcccagcaggacctgccggtgctgatcctcaccgcccgcgacggcaccgccgaacgcatcgccgggctggatgccggggccgacgactacctggtcaagcccttcgatgtcgaggaattcaaggcccgggtccgcgccctgctgcgccgcagccagggtcgtgcccagccgctgctggaacacgccggcatccgcctcgacccggccaaccagcaggtgcagtaccaagacaacgaagtggtgctcacgcccatggaataccagctgctgcaccagctgatggtgcgcccgggcaaggtggtgacccgcgagcgcctgtcccgggcgctgtacggctggcaggaccgggtcgagagcaacaccctggaagtactgatccataacctgcgcaagaagctctgcagcgagctgatccgcaccgtgcgcggcgtcggttacgtgctggcgctcaagccatga

SEQ ID NO: 107526 - protein, 220 aa, Pseudomonas fluorescens Pf-5
MRLLLVEDDRALGQGIRVALSAEGYTLDWLQDGASALHALRTESFDLLLLDLGLPRLDGLELLQQLRAAQQDLPVLILTARDGTAERIAGLDAGADDYLVKPFDVEEFKARVRALLRRSQGRAQPLLEHAGIRLDPANQQVQYQDNEVVLTPMEYQLLHQLMVRPGKVVTRERLSRALYGWQDRVESNTLEVLIHNLRKKLCSELIRTVRGVGYVLALKP

SEQ ID NO: 107527 - DNA, 669 bp, Pseudomonas fluorescens Pf-5
  CDS (1)..(669): transl_table=11
atgcgcctgcttgtggtggaagaccacgtatccctggccgatgaactgcttgaaggcctgaaccgccagggctacgccgtggactggctggccgacggccgcgacgcgctgtaccagggcgccagcgaaccctatgacctgatcatcctcgacctcggcctgcccggggtgccgggcctggaggtgctgcgaaagtggcgcgccgatggcctggcaacgccggtgctggtcctcaccgcccgcggctcctgggccgagcgcatcgaggggctcaaggccggcgccgacgattacctgagcaaaccgttccatcccgaagagctgcacctgcgggtccaggccctgctgcgccgctcccatggccaggccaaccagcagaccctgcaggccgccgggctacacctggacgagggccggcaatgtgtggtccgcgacggccaggatgtcttgctgaccgccgcggagttccgcctgttgcgctatttcatgctgcacccgcagcagatcctgtccaaaagccacctggccgaacacctctacgacggtgaaaccgagcgcgactccaacgtccttgaagttcacgtcaaccacctgcggcgcaagctgggccgcagtgtgatcgaaacccgccgcggccagggttatctgttcggcggaaccgcttcgtga

SEQ ID NO: 107528 - protein, 222 aa, Pseudomonas fluorescens Pf-5
MRLLVVEDHVSLADELLEGLNRQGYAVDWLADGRDALYQGASEPYDLIILDLGLPGVPGLEVLRKWRADGLATPVLVLTARGSWAERIEGLKAGADDYLSKPFHPEELHLRVQALLRRSHGQANQQTLQAAGLHLDEGRQCVVRDGQDVLLTAAEFRLLRYFMLHPQQILSKSHLAEHLYDGETERDSNVLEVHVNHLRRKLGRSVIETRRGQGYLFGGTAS

SEQ ID NO: 107529 - DNA, 678 bp, Pseudomonas fluorescens Pf-5; identical to SEQ ID NO: 106148
  CDS (1)..(678): transl_table=11

SEQ ID NO: 107530 - protein, 225 aa, Pseudomonas fluorescens Pf-5; identical to SEQ ID NO: 106149

SEQ ID NO: 107531 - DNA, 678 bp, Pseudomonas fluorescens Pf-5
  CDS (1)..(678): transl_table=11
atgaagttgctggtcgtcgaagatgaggcgctgttgcgtcatcatttgcaaacccgcctcaccgacagcggtcatgtcgtcgagtccgtggccaacgccgaggaggcgctgtatcagaccgagcagttcaaccacgatctggcggtgatcgacctgggcctgcccggcatgggcgggctggacctgatccgccagttgcgcaaccgtggcaagacgttcccgatcctcatcctcacggcccgtggcaactggcaggacaaggtcgagggcctggcggccggtgcggacgactatgtggtcaagccattccagttcgaagagctggatgcgcgcctgaatgcgctgctgcggcgctccagtggcttcacccagtccaccatcattgccgggccgctgctgctggacctgaatcgcaagcaggcctccctggatgagcagcccctggccctgacggcctatgagtaccggattctcgaatacctgatgcgtcatcatcagcaagtggtggccaaggaccggctcatggagcagttgtacccggacgacgacgagcgcgatccgaatgtcatcgaagtgctggtgggccgcttgcggcgcaagcttgaggggccgtcgggcttcaagccgatcgatacggtgcgtggcctgggctacctgttcaacgagcgttgccgatga

SEQ ID NO: 107532 - protein, 225 aa, Pseudomonas fluorescens Pf-5
MKLLVVEDEALLRHHLQTRLTDSGHVVESVANAEEALYQTEQFNHDLAVIDLGLPGMGGLDLIRQLRNRGKTFPILILTARGNWQDKVEGLAAGADDYVVKPFQFEELDARLNALLRRSSGFTQSTIIAGPLLLDLNRKQASLDEQPLALTAYEYRILEYLMRHHQQVVAKDRLMEQLYPDDDERDPNVIEVLVGRLRRKLEGPSGFKPIDTVRGLGYLFNERCR

SEQ ID NO: 107533 - DNA, 675 bp, Psychrobacter arcticum 273-4; identical to SEQ ID NO: 106152
  CDS (1)..(675): transl_table=11

SEQ ID NO: 107534 - protein, 224 aa, Psychrobacter arcticum 273-4; identical to SEQ ID NO: 106153

SEQ ID NO: 107535 - DNA, 732 bp, Colwellia psychrerythraea 34H; identical to SEQ ID NO: 106154
  CDS (1)..(732): transl_table=11

SEQ ID NO: 107536 - protein, 243 aa, Colwellia psychrerythraea 34H; identical to SEQ ID NO: 106155

SEQ ID NO: 107537 - DNA, 684 bp, Pseudomonas syringae pv. phaseolicola 1448A; identical to SEQ ID NO: 106156
  CDS (1)..(684): transl_table=11

SEQ ID NO: 107538 - protein, 227 aa, Pseudomonas syringae pv. phaseolicola 1448A; identical to SEQ ID NO: 106157

SEQ ID NO: 107539 - DNA, 669 bp, Pseudomonas syringae pv. phaseolicola 1448A; identical to SEQ ID NO: 106158
  CDS (1)..(669): transl_table=11

SEQ ID NO: 107540 - protein, 222 aa, Pseudomonas syringae pv. phaseolicola 1448A; identical to SEQ ID NO: 106159

SEQ ID NO: 107541 - DNA, 663 bp, Pseudomonas syringae pv. phaseolicola 1448A; identical to SEQ ID NO: 106160
  CDS (1)..(663): transl_table=11

SEQ ID NO: 107542 - protein, 220 aa, Pseudomonas syringae pv. phaseolicola 1448A; identical to SEQ ID NO: 106161

SEQ ID NO: 107543 - DNA, 672 bp, Pseudomonas syringae pv. phaseolicola 1448A
  CDS (1)..(672): transl_table=11
atgcgtgttcttcttgtggaagatcatctgcaattggctgaaagtgtcgcgcaggcgctcaaaagcgcaggtttgaccgttgatgtactgcatgatggcgttgccgccgacctggcgttgagcagcgaggaatacgccgtcgccattctcgacgtcggcttgccgcgtatggacggctttgaagtgctggcgcgtctgcgggcgcgcagcaaaaaccttccggtgttgatgctgaccgcgcgcagcgacgtcaaggatcgcgttcatggcctgaacctgggggccgacgactacctggccaagcctttcgagctgtccgagctggaggccagggtcaaggcattgctgcggcgtagcgtgctgggtggcgagcggcaacagcgctgcggcgtactggcctatgatctggacacccggcgtttcacgctaggcgaggagctgctggccctgacgtctcgcgaacaggcggtgctggaagcgcttatcgcccggccaggtcgggtgatgagcaaggagcaactggccgcgcaggtgttcggcctcgacgaggaggccagccctgacgccatcgaaatctacgtccatcgcctgcgcaagaagctcgacgggcattctgtggccatcgtgacctttcggggtctggggtatctgcttgaaagccgcgatgattaa

SEQ ID NO: 107544 - protein, 223 aa, Pseudomonas syringae pv. phaseolicola 1448A
MRVLLVEDHLQLAESVAQALKSAGLTVDVLHDGVAADLALSSEEYAVAILDVGLPRMDGFEVLARLRARSKNLPVLMLTARSDVKDRVHGLNLGADDYLAKPFELSELEARVKALLRRSVLGGERQQRCGVLAYDLDTRRFTLGEELLALTSREQAVLEALIARPGRVMSKEQLAAQVFGLDEEASPDAIEIYVHRLRKKLDGHSVAIVTFRGLGYLLESRDD

SEQ ID NO: 107545 - DNA, 672 bp, Dechloromonas aromatica RCB; identical to SEQ ID NO: 106162
  CDS (1)..(672): transl_table=11

SEQ ID NO: 107546 - protein, 223 aa, Dechloromonas aromatica RCB; identical to SEQ ID NO: 106163

SEQ ID NO: 107547 - DNA, 666 bp, Dechloromonas aromatica RCB; identical to SEQ ID NO: 106164
  CDS (1)..(666): transl_table=11

SEQ ID NO: 107548 - protein, 221 aa, Dechloromonas aromatica RCB; identical to SEQ ID NO: 106165

SEQ ID NO: 107549 - DNA, 672 bp, Dechloromonas aromatica RCB; identical to SEQ ID NO: 106166
  CDS (1)..(672): transl_table=11

SEQ ID NO: 107550 - protein, 223 aa, Dechloromonas aromatica RCB; identical to SEQ ID NO: 106167

SEQ ID NO: 107551 - DNA, 690 bp, Dechloromonas aromatica RCB; identical to SEQ ID NO: 106168
  CDS (1)..(690): transl_table=11

SEQ ID NO: 107552 - protein, 229 aa, Dechloromonas aromatica RCB; identical to SEQ ID NO: 106169

SEQ ID NO: 107553 - DNA, 678 bp, Dechloromonas aromatica RCB; identical to SEQ ID NO: 106170
  CDS (1)..(678): transl_table=11

SEQ ID NO: 107554 - protein, 225 aa, Dechloromonas aromatica RCB; identical to SEQ ID NO: 106171

SEQ ID NO: 107555 - DNA, 666 bp, Dechloromonas aromatica RCB
  CDS (1)..(666): transl_table=11
atgcgagtattgctggtcgaagacgacttcatgattggcgaagccatccaaggggcgctgaaagacgcttcgtacgctgccgactgggtaaagaacggccaaactgccctcacgacactgggttgccagcactatgacctggtgctgctcgatcttggccttccaggtaaggatgggttggaggtgctgaccagcattcgcgccaaagacaatccggttccccttctcatcatcactgcccgcgacggcctcaatgatcgactgcgcggcttggatggtggagccgatgattatttgctcaaaccttttgagatggccgaactgctggcccgcatgcgtgcggtgctacgacgtaagggaggaaatgcaacgtccgtgctcagcaacggcgtcgtgtcgctcgatccggccacgcgggaggcggcggtcaacaacagtgcctcggtgcaactctccaatcgtgagtttgccttgttgcaagccttgctggtacgccctggagccattctctcgcgcagcgatctggaagaccgtatctacggatggggtgaagaggtcgagagcaacgccgtcgaattcctgatccatgcactgcggcgcaagctgggcggcgaagtcatcaagaatgtcaggggggttggatggatggtttcaaaaaacgtctga

SEQ ID NO: 107556 - protein, 221 aa, Dechloromonas aromatica RCB
MRVLLVEDDFMIGEAIQGALKDASYAADWVKNGQTALTTLGCQHYDLVLLDLGLPGKDGLEVLTSIRAKDNPVPLLIITARDGLNDRLRGLDGGADDYLLKPFEMAELLARMRAVLRRKGGNATSVLSNGVVSLDPATREAAVNNSASVQLSNREFALLQALLVRPGAILSRSDLEDRIYGWGEEVESNAVEFLIHALRRKLGGEVIKNVRGVGWMVSKNV

SEQ ID NO: 107557 - DNA, 657 bp, Dechloromonas aromatica RCB; identical to SEQ ID NO: 106174
  CDS (1)..(657): transl_table=11

SEQ ID NO: 107558 - protein, 218 aa, Dechloromonas aromatica RCB; identical to SEQ ID NO: 106175

SEQ ID NO: 107559 - DNA, 660 bp, Thermobifida fusca YX
  CDS (1)..(660): transl_table=11
atggcacgcatcctgatcgtcgaagatgaagaccgcatcgcctcgttcgtccgcaaagggttgaacgcgaacgggttcaccagcaccgtggtggaccgcgcgggcgccgccatcgactatgcgctcaccggcaatttcgacctcatggttcttgacctgggcctgccggacgctgacgggttcacggtgctgcgccggctgcgtgaggaaggcagccggctgccgatcatcatcctcactgctcgcgacagtgtgcgggacacggtgaccggtctggaaaccggtgccgacgactacatgactaaaccgttccgcttcgaagaactccttgcccgtatccggttgcgtatgcggagcgcgcacaacgcggaaacaaccgtgctccacgccggtgacctcgcccttgatctgcgcacccgccgcgcctccacccctgaggccactgtcgacttgacggcccgcgagttcgccctgttggaactgttcctccgccacccaggccaggtgctgtcccgccagcagattctctcccacgtgtggggctacgactacgaccccggctccaacgtggtcgacgtgttcatccgcgcgttgcggaagaagatcggcgcccaccggatcgaaaccctccgcggcatgggataccggcttggcggttga

SEQ ID NO: 107560 - protein, 219 aa, Thermobifida fusca YX
MARILIVEDEDRIASFVRKGLNANGFTSTVVDRAGAAIDYALTGNFDLMVLDLGLPDADGFTVLRRLREEGSRLPIIILTARDSVRDTVTGLETGADDYMTKPFRFEELLARIRLRMRSAHNAETTVLHAGDLALDLRTRRASTPEATVDLTAREFALLELFLRHPGQVLSRQQILSHVWGYDYDPGSNVVDVFIRALRKKIGAHRIETLRGMGYRLGG

SEQ ID NO: 107561 - DNA, 669 bp, Thermobifida fusca YX
  CDS (1)..(669): transl_table=11
atgacctgcgttttgctggccgaagacgatgcttcgatctctgaaccgttggcccgcgcgctccggcgggaaggatattcagtcgacgtcaccgtcgacggtatggaaacactcgaccgtgcccgtagcggcgacatcgacctgctcgtcttggacttgggattgcccgaactggacgggctcgaagtagcccggcggctgcgttccgaagggcacggaactccgattctcatcctcaccgcccgggccgacgaggtggacaccgtcgtcggactggacgcgggggccgacgactacgtcaccaaacccttccgcctggcagagctgctggcccgggtccgggccctgctgcgccgcggcggcggcgaagtccccgtcgtccacggggtgcgcatcgacacggactcccgccgggcctggctcggcgaccgcgaactgcaactgaccacgaaagagttcgacctgctgcgggtcctggtccgcgaagcgggcaaggtggtcacccgggagcagatcatgcgggaggtatgggacaccaactggtgggggtccacgaaaacactggacatgcacatttcctggctgcgccggaagctcggcgacgacgccaaccagccctcctacatcactacggtgcggggggtcggcttccggttcgagaaggagtga

SEQ ID NO: 107562 - protein, 222 aa, Thermobifida fusca YX
MTCVLLAEDDASISEPLARALRREGYSVDVTVDGMETLDRARSGDIDLLVLDLGLPELDGLEVARRLRSEGHGTPILILTARADEVDTVVGLDAGADDYVTKPFRLAELLARVRALLRRGGGEVPVVHGVRIDTDSRRAWLGDRELQLTTKEFDLLRVLVREAGKVVTREQIMREVWDTNWWGSTKTLDMHISWLRRKLGDDANQPSYITTVRGVGFRFEKE

SEQ ID NO: 107563 - DNA, 690 bp, Ralstonia eutropha JMP134; identical to SEQ ID NO: 106176
  CDS (1)..(690): transl_table=11

SEQ ID NO: 107564 - protein, 229 aa, Ralstonia eutropha JMP134; identical to SEQ ID NO: 106177

SEQ ID NO: 107565 - DNA, 750 bp, Ralstonia eutropha JMP134; identical to SEQ ID NO: 106178
  CDS (1)..(750): transl_table=11

SEQ ID NO: 107566 - protein, 249 aa, Ralstonia eutropha JMP134; identical to SEQ ID NO: 106179

SEQ ID NO: 107567 - DNA, 681 bp, Ralstonia eutropha JMP134; identical to SEQ ID NO: 106182
  CDS (1)..(681): transl_table=11

SEQ ID NO: 107568 - protein, 226 aa, Ralstonia eutropha JMP134; identical to SEQ ID NO: 106183

SEQ ID NO: 107569 - DNA, 687 bp, Ralstonia eutropha JMP134; identical to SEQ ID NO: 106184
  CDS (1)..(687): transl_table=11

SEQ ID NO: 107570 - protein, 228 aa, Ralstonia eutropha JMP134; identical to SEQ ID NO: 106185

SEQ ID NO: 107571 - DNA, 705 bp, Ralstonia eutropha JMP134
  CDS (1)..(705): transl_table=11
atgcgtatcctgctgatcgaagacgaccgccagatcgcgagcggcgtcgaagccggcctgacccgtgccggccaccaggtgcgcgtggtccatgacggcgtctacgccaccgagcacctgctgcgcgagcagcatgaccttgtcatcctcgacctgggcctgcccggtattgacggcatgacgctgctcgcgcgctaccgcgcccgcaaccgcaccacgcccgtcatcatcctgaccgcgcgcgacgagctcgaagacaagctttccggcctgaacgccggcgccgacgactacctcgtcaagccattcgcactgcccgagctggaggcccgcgtgcgtgtgctgttgcgccgcagccagcacggcgaagccgtacccgatcgcgacgtgcgcctgggccggctgcgcctgtccggcaacgatcgccgcatgttcatcgacggcaagccgctggaactgtcgccgcgcgagttcgcggtgctggaactgctgctgcagcgccagggccgtgtggtcagcaaggcacagctccaggatcacctggccaccttcgcccacccggccggcgaaggcggcgacacggtcggcgacaccgccatcgaagtctatgtgcaccgcgtgcgcaagaagctcgaggaaagcgacgtcgagatcgtcacggtacgcggcttcggctacctgctgcaggcccgcgccggccaatga

SEQ ID NO: 107572 - protein, 234 aa, Ralstonia eutropha JMP134
MRILLIEDDRQIASGVEAGLTRAGHQVRVVHDGVYATEHLLREQHDLVILDLGLPGIDGMTLLARYRARNRTTPVIILTARDELEDKLSGLNAGADDYLVKPFALPELEARVRVLLRRSQHGEAVPDRDVRLGRLRLSGNDRRMFIDGKPLELSPREFAVLELLLQRQGRVVSKAQLQDHLATFAHPAGEGGDTVGDTAIEVYVHRVRKKLEESDVEIVTVRGFGYLLQARAGQ

SEQ ID NO: 107573 - DNA, 678 bp, Ralstonia eutropha JMP134; identical to SEQ ID NO: 106186
  CDS (1)..(678): transl_table=11

SEQ ID NO: 107574 - protein, 225 aa, Ralstonia eutropha JMP134; identical to SEQ ID NO: 106187

SEQ ID NO: 107575 - DNA, 660 bp, Ralstonia eutropha JMP134; identical to SEQ ID NO: 106190
  CDS (1)..(660): transl_table=11

SEQ ID NO: 107576 - protein, 219 aa, Ralstonia eutropha JMP134; identical to SEQ ID NO: 106191

SEQ ID NO: 107577 - DNA, 708 bp, Ralstonia eutropha JMP134; identical to SEQ ID NO: 106192
  CDS (1)..(708): transl_table=11

SEQ ID NO: 107578 - protein, 235 aa, Ralstonia eutropha JMP134; identical to SEQ ID NO: 106193

SEQ ID NO: 107579 - DNA, 660 bp, Shigella sonnei Ss046
  CDS (1)..(660): transl_table=11
atgcgaattttactgatagaagatgacatgctgattggcgacggcatcaaaactggccttagtaaaatgggttttagtgtcgactggtttacacaaggtcgtcagggaaaagaggcgctttatagcgcaccttatgatgcggtgatcctggatttaaccttaccaggcatggatggtcgcgatattttgcgcgaatggcgagagaaaggtcagcgtgagccggtactgatcctgaccgcgcgtgatgcgttagcggaacgtgtagaagggctgcgtctgggagctgacgattatctgtgtaaaccttttgcgttgatagaagtcgccgccaggctggaggctctgatgcgccgaaccaacggccaggccagcaacgagctgcgccacggtaacgttatgctcgaccccggcaaacgtatcgccacgctggctggcgaacccttaacactgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggtagtgattttattcgtaccgtgcatggtattggctacacattaggtgagaaatga

SEQ ID NO: 107580 - protein, 219 aa, Shigella sonnei Ss046
MRILLIEDDMLIGDGIKTGLSKMGFSVDWFTQGRQGKEALYSAPYDAVILDLTLPGMDGRDILREWREKGQREPVLILTARDALAERVEGLRLGADDYLCKPFALIEVAARLEALMRRTNGQASNELRHGNVMLDPGKRIATLAGEPLTLKPKEFALLELLMRNAGRVLPRKLIEEKLYTWDEEVTSNAVEVHVHHLRRKLGSDFIRTVHGIGYTLGEK

SEQ ID NO: 107581 - DNA, 663 bp, Thiobacillus denitrificans ATCC 25259; identical to SEQ ID NO: 106194
  CDS (1)..(663): transl_table=11

SEQ ID NO: 107582 - protein, 220 aa, Thiobacillus denitrificans ATCC 25259; identical to SEQ ID NO: 106195

SEQ ID NO: 107583 - DNA, 666 bp, Thiobacillus denitrificans ATCC 25259; identical to SEQ ID NO: 106198
  CDS (1)..(666): transl_table=11

SEQ ID NO: 107584 - protein, 221 aa, Thiobacillus denitrificans ATCC 25259; identical to SEQ ID NO: 106199

SEQ ID NO: 107585 - DNA, 672 bp, Rubrivivax gelatinosus PM1
  CDS (1)..(672)
atgaggatcctcatcgccgaagacgaccaggtgctggccgacggtctgttgcgcaccttgcgcaagggtggctatgcggtggatcaggtcggaagcggcagcgaggccgatgcggcgctggccgaccacgagttcgacctggtgatcctcgatctcggactgcccaagctgcacggcctggaggtgctgcgcaagatgcgcgcgcgcggcaccgtgacgccagtgctgatcctgaccgcggccgacagcgtggagcagcgcgtgaaggggctggacctgggggccgacgactacatggccaagcccttcgcgctgcaggaactggaggcgcgcgtgcgagcgctgacgcggcgtggcctgggcaccgcctcggccatcatcaagcacggcccgctgtcgttcgatgcaactgggcgcgtggcctacctgaacgaccagatgatcgagctgtcggctcgcgagctctcgctgctcgaggtgctgctgcagcgtgccggccggctggtcagcaaggatcagctggtcgagcgcctgtgcgaatggggcgacgaggtcagcaacaacgcgatcgaggtctacatccaccgcctgcgcaagaagatcgagcagggcccggtgcgcatcgccaccgtgcgcggcctgggctactgcctcgagaagatcgcgggctga

SEQ ID NO: 107586 - protein, 223 aa, Rubrivivax gelatinosus PM1
MRILIAEDDQVLADGLLRTLRKGGYAVDQVGSGSEADAALADHEFDLVILDLGLPKLHGLEVLRKMRARGTVTPVLILTAADSVEQRVKGLDLGADDYMAKPFALQELEARVRALTRRGLGTASAIIKHGPLSFDATGRVAYLNDQMIELSARELSLLEVLLQRAGRLVSKDQLVERLCEWGDEVSNNAIEVYIHRLRKKIEQGPVRIATVRGLGYCLEKIAG

SEQ ID NO: 107587 - DNA, 666 bp, Haemophilus influenzae R2846
  CDS (1)..(666)
atgagaattttattgatagaagacgataatctaatcggcaatgggttgcagattggtttaactaaacttggttttgcggtggattggtttaccgatggaaaaacaggaatggctgctttaacctctgcgccttatgatgcggtggtattggatttaaccttgcctaaacttgatggattagatgtattgcaacaatggcgatctaatcatcaagatgttcccgtattaattttgactgctcgcgatactttagatgaacgagttaaaggtttacaaagtggtgcagatgattatctttgtaagccttttgctttggctgaagtcgccgcacgtttacaagcccttattcgtcgtcgttatggacatcatcattcggtaatagaacagtctggtgttaagctagatcagaatcaacgttctgtttggctgaataatcaacccatttctttaacaagccgtgaatataaattattagagttatttatgctgaataaagatcgtgtgttgtctcgcacatcgattgaagaaaaattatccagttgggatgaagaaattagcagtggtgcattggatgtgcatatttataatttacgccaaaaattggggaaacaatttattcgtacggtacacggtgttggatatgctttgggacaagttgaaaaatga

SEQ ID NO: 107588 - protein, 221 aa, Haemophilus influenzae R2846
MRILLIEDDNLIGNGLQIGLTKLGFAVDWFTDGKTGMAALTSAPYDAVVLDLTLPKLDGLDVLQQWRSNHQDVPVLILTARDTLDERVKGLQSGADDYLCKPFALAEVAARLQALIRRRYGHHHSVIEQSGVKLDQNQRSVWLNNQPISLTSREYKLLELFMLNKDRVLSRTSIEEKLSSWDEEISSGALDVHIYNLRQKLGKQFIRTVHGVGYALGQVEK

SEQ ID NO: 107589 - DNA, 672 bp, Syntrophobacter fumaroxidans MPOB
  CDS (1)..(672): transl_table=11
atgcggctcctggtggtggaagacgagaagaaagtcgcgagctttatccgtaaagggctggaagaagagggttatgcggtggacgtggccctggacggcgaggttggcctccagatggccatggaccgggtgcacgatctgatcatcctggacatccagcttccgcgcctgagcggaatggaactgctccggtcgctgcgcgcaaaacggatttcgacgcctgtcctgctgctcaccgtgagggcgaccatcgaagacaaggtcctcggtctggatgctggcgccgacgactacctgaccaagcccttctctttccgcgaactggtcgcgcgggtgcgcgccctgttgaggcgccgggcggaaagcagtcagaccgagctccgggtagccgacctgacgctcgatccggtcaggcacacagtgtcgagaggttcggaaaagatcgagctcacggccaaggagttcgcgcttctcgactatttcatgcgcaatccggaccgggtcctgaccaggaccatgattgccgaacacgtctgggattatgatttcgactcgatgacgaatgtcatcgacgtttacgtgaattatcttcgccgcaagatcgattccgaccgcgaaccgaagctcatccataccgttcgcggggtcggctacatgctgaagacggagtga

SEQ ID NO: 107590 - protein, 223 aa, Syntrophobacter fumaroxidans MPOB
MRLLVVEDEKKVASFIRKGLEEEGYAVDVALDGEVGLQMAMDRVHDLIILDIQLPRLSGMELLRSLRAKRISTPVLLLTVRATIEDKVLGLDAGADDYLTKPFSFRELVARVRALLRRRAESSQTELRVADLTLDPVRHTVSRGSEKIELTAKEFALLDYFMRNPDRVLTRTMIAEHVWDYDFDSMTNVIDVYVNYLRRKIDSDREPKLIHTVRGVGYMLKTE

SEQ ID NO: 107591 - DNA, 690 bp, Brucella suis; identical to SEQ ID NO: 106206
  CDS (1)..(690): transl_table=11

SEQ ID NO: 107592 - protein, 229 aa, Brucella suis; identical to SEQ ID NO: 106207

SEQ ID NO: 107593 - DNA, 672 bp, Salmonella typhi
  CDS (1)..(672): transl_table=11
atgcgtctcttattggcggaagataaccgtgagctggctcactggctggagaaagcgctggtgcaaaacggctttgccgtggactgcgtatttgaacgcctggcggctgaccatcttctgcacagtgaaatgtatgcgctgatggtgctggatatcaatatgccgggaatggatggactggaggtggtgcaacggctgcgtaaacgcggtcagaccttgcccgttttgctgctcacggcgcgaaggttggcggatcgcgtaaaaggtctcaacgtcggcgcggatgactatctgccgaaaccctttgaactggaagagctggatgcccgtttacgggccttgctccgacgcagcgctgggctggttcatgaagttcagcaactgggtgaattgatctttcatgatgaagggtattttctgttacagggacagccgttagcgctgacgccgcgtgagcaggcgctcttaaccgtattgatgtaccgacgaacgcggcctgtctcgcgtcagcagctttttgaacaggtgttcagcctgaacgatgaggtaagccctgaaagcatcgaactttatattcatcgactgcgtaaaaaacttcagggaagcgatgtacgaattaccgtactgcgcggcctgggttatgtgctggagcgcggcgatgaagtgggttaa

SEQ ID NO: 107594 - protein, 223 aa, Salmonella typhi
MRLLLAEDNRELAHWLEKALVQNGFAVDCVFERLAADHLLHSEMYALMVLDINMPGMDGLEVVQRLRKRGQTLPVLLLTARRLADRVKGLNVGADDYLPKPFELEELDARLRALLRRSAGLVHEVQQLGELIFHDEGYFLLQGQPLALTPREQALLTVLMYRRTRPVSRQQLFEQVFSLNDEVSPESIELYIHRLRKKLQGSDVRITVLRGLGYVLERGDEVG

SEQ ID NO: 107595 - DNA, 672 bp, Rhizobium leguminosarum; identical to SEQ ID NO: 106210
  CDS (1)..(672): transl_table=11

SEQ ID NO: 107596 - protein, 223 aa, Rhizobium leguminosarum; identical to SEQ ID NO: 106211

SEQ ID NO: 107597 - DNA, 660 bp, Serratia marcescens; identical to SEQ ID NO: 106212
  CDS (1)..(660): transl_table=11

SEQ ID NO: 107598 - protein, 219 aa, Serratia marcescens; identical to SEQ ID NO: 106213

SEQ ID NO: 107599 - DNA, 669 bp, Salmonella bongori; identical to SEQ ID NO: 106214
  CDS (1)..(669): transl_table=11

SEQ ID NO: 107600 - protein, 222 aa, Salmonella bongori; identical to SEQ ID NO: 106215

SEQ ID NO: 107601 - DNA, 669 bp, Salmonella enterica; identical to SEQ ID NO: 106218
  CDS (1)..(669): transl_table=11

SEQ ID NO: 107602 - protein, 222 aa, Salmonella enterica; identical to SEQ ID NO: 106219

SEQ ID NO: 107603 - DNA, 687 bp, uncultured bacterium; identical to SEQ ID NO: 106228
  CDS (1)..(687)

SEQ ID NO: 107604 - protein, 228 aa, uncultured bacterium; identical to SEQ ID NO: 106229

SEQ ID NO: 107605 - DNA, 669 bp, Pectobacterium carotovorum subsp; identical to SEQ ID NO: 106230
  CDS (1)..(669): transl_table=11

SEQ ID NO: 107606 - protein, 222 aa, Pectobacterium carotovorum subsp; identical to SEQ ID NO: 106231

SEQ ID NO: 107607 - DNA, 729 bp, Propionibacterium freudenreichii shermanii
  CDS (1)..(729): transl_table=11
atggctggacctaatgcacccgaactgctcacccgccccgacggcacgcccatccgcgtgctggcggtcgacgatgagaacagtctgactgaactcctgtcgatggcgatgcgctacgagggctgggaacccacgacggcggccaccggctccgatgcggtgcgtgcggcgcgcgacaccaatcccgacgccatcgtgctcgacatgatgctgcccgacttcgacggcctcgaggtgatgcgccgggtgcgcgccgaacagcccgacgtgccggtgatcttcctcaccgccaaggacgcggtgaatgatcgcatcgtcggcctgaccgccggcggcgacgactatgtgaccaagccgttcagcgtggaggagctgatggcccggctgcgcagcctgttgcgccgcagcggagccaccagcaagcgctccgagtccgagctgatcgtcggtgacctggtgctcgacgaggactcccacgaggtgacgcgtggtggcgacgagatccacctcaccgccaccgagttcgagctgctgcgctatctgatgcgcaacccgaagcgcgtgctgtccaaggcccagatcctcgatcgcgtgtggaactacgacttcggcggccaggccaacgtggtggagctctacatcagctacctgcgcaagaagatcgacgccggacgcgaaccgatgatccacaccatgcgcggtgccggatatgtcctcaagccggcctga

SEQ ID NO: 107608 - protein, 242 aa, Propionibacterium freudenreichii shermanii
MAGPNAPELLTRPDGTPIRVLAVDDENSLTELLSMAMRYEGWEPTTAATGSDAVRAARDTNPDAIVLDMMLPDFDGLEVMRRVRAEQPDVPVIFLTAKDAVNDRIVGLTAGGDDYVTKPFSVEELMARLRSLLRRSGATSKRSESELIVGDLVLDEDSHEVTRGGDEIHLTATEFELLRYLMRNPKRVLSKAQILDRVWNYDFGGQANVVELYISYLRKKIDAGREPMIHTMRGAGYVLKPA

SEQ ID NO: 107609 - DNA, 669 bp, Neisseria cinerea; identical to SEQ ID NO: 106236
  CDS (1)..(669): transl_table=11

SEQ ID NO: 107610 - protein, 222 aa, Neisseria cinerea; identical to SEQ ID NO: 106237

SEQ ID NO: 107611 - DNA, 693 bp, Lactococcus lactis subsp
  CDS (1)..(693): transl_table=11
atggcatcaaagaaaattttgattattgaggatgaaaagaatttagctcgtttcgtctcattagaattagagcatgaaggctatgccactgagattaaagataacggacgttctgggattgaagaagcaacttcaaaagattatgatttaatcttgcttgatttgatgcttcctgaacttgatggttttgaagttgcccgccgtttgcgcaaagaaaaagatactccaattattatgatgaccgcgcgtgattcaacaatggaccgtgttgccggtcttgatattggagcagatgattatattactaagccttttgcgattgaagaacttttggctcgtgttcgtgcattcttccgtcgtgaagaacatggtcatgctgtagaacgtgctgaaaacacttcttttcgtgatcttgtaattgacaaaacaaatcgtaccgttcaccgcggtaaaaaagtaattgatttgacgcgtcgtgaatacgatcttcttttgacgttgatgcaaaatgttggggatgttgtcactcgcgaacatttagtttcacaagtttggggatatgaagaaggaacggaaacaaatgttgttgatgtatatatccgctatcttagaaataaaattgatgttgaaggacaagacagctatattcaaaccgttcgtggtttgggttatgtgatgcgtgaacgcaaataa

SEQ ID NO: 107612 - protein, 230 aa, Lactococcus lactis subsp
MASKKILIIEDEKNLARFVSLELEHEGYATEIKDNGRSGIEEATSKDYDLILLDLMLPELDGFEVARRLRKEKDTPIIMMTARDSTMDRVAGLDIGADDYITKPFAIEELLARVRAFFRREEHGHAVERAENTSFRDLVIDKTNRTVHRGKKVIDLTRREYDLLLTLMQNVGDVVTREHLVSQVWGYEEGTETNVVDVYIRYLRNKIDVEGQDSYIQTVRGLGYVMRERK

SEQ ID NO: 107613 - DNA, 684 bp, Pseudomonas sp; identical to SEQ ID NO: 106238
  CDS (1)..(684): transl_table=11

SEQ ID NO: 107614 - protein, 227 aa, Pseudomonas sp; identical to SEQ ID NO: 106239

SEQ ID NO: 107615 - DNA, 687 bp, Pseudomonas syringae
  CDS (1)..(687): transl_table=11
atgaaactgttggtagccgaagacgaaccgaagactggaatctatctgcagcaaggcctgcgggaggccggcttcaatgtggaccgcgtggtcacaggcacagatgccgttgaccaggcgctcaatgaagcctatgacctgttgattcttgacgtgatgatgccgggcctggatggctgggaagtcatcagacgccttcgcaccgctggccagtccgtaccggtgctgtttctgaccgcacgcgacggggtagacgaccgggtcaagggcctggagctgggcgccgatgattacctggttaagccatttgctttttcagaactgctggcacgggtgcgaacactgctacggcgcggcagcagcagcctgccggttcaaacaagcctgcaaatcggagaccttcaggtggatttgctcaagcgtcgggcgactcggggcggcaagcgaatcgaccttacggccaaagagttcgcactgctggagttactgatgcgccggcaaggtgaggtgttgtccaaatcgctgatagcttcccaggtctgggacatgaatttcgacagcgacacaaatgttatcgaggtggcgatacggcggttgagggccaagattgacgatgacttcgaggcaaaactgctgcatacctgccgggggatgggttacatgctagacgcgcaggacgaaggatga

SEQ ID NO: 107616 - protein, 228 aa, Pseudomonas syringae
MKLLVAEDEPKTGIYLQQGLREAGFNVDRVVTGTDAVDQALNEAYDLLILDVMMPGLDGWEVIRRLRTAGQSVPVLFLTARDGVDDRVKGLELGADDYLVKPFAFSELLARVRTLLRRGSSSLPVQTSLQIGDLQVDLLKRRATRGGKRIDLTAKEFALLELLMRRQGEVLSKSLIASQVWDMNFDSDTNVIEVAIRRLRAKIDDDFEAKLLHTCRGMGYMLDAQDEG

SEQ ID NO: 107617 - DNA, 687 bp, Streptococcus pyogenes
  CDS (1)..(687): transl_table=11
atgacaaagaaaattttaattattgaagatgaaaagaatctggctagattcgtttctcttgagctgcaacctgacggttatgaagtcattgttgaggtcaatggtcgtgaagggttagaaactgctttggaaggagagtttgatttaatcctgcttgacttaatgttaccagagatggatggttttgaagtgacccgtcgtttgcaaaccgaaaaaacaacgtatatcatgatgatgactgcgcgtgattctattatggatgtggttgcaggtttagaccgcggtgcagacgactatattgttaaaccgtttgccattgaagaactacttgcccgtattcgtgctattttccgccgtcaagatattgaatctgagaagaaagtgcctagtcaaggcatttatcgagatctagttttaaatccacaaaaccgttcagttaatcgtggcgacgatgagatttctctcactaaacgtgaatatgatttgcttaatattttgatgactaatatgaatcgtgtcatgacacgtgaagaattattgtcaaatgtttggaaatatgatgaagccgttgagactaatgttgtagatgtctatattcgttatctccgcggcaaaattgacattccaggcaaggaatcttatatccaaacagtgcgtggcatgggatacgttattcgtgagaaataa

SEQ ID NO: 107618 - protein, 228 aa, Streptococcus pyogenes
MTKKILIIEDEKNLARFVSLELQPDGYEVIVEVNGREGLETALEGEFDLILLDLMLPEMDGFEVTRRLQTEKTTYIMMMTARDSIMDVVAGLDRGADDYIVKPFAIEELLARIRAIFRRQDIESEKKVPSQGIYRDLVLNPQNRSVNRGDDEISLTKREYDLLNILMTNMNRVMTREELLSNVWKYDEAVETNVVDVYIRYLRGKIDIPGKESYIQTVRGMGYVIREK

SEQ ID NO: 107619 - DNA, 669 bp, Salmonella typhimurium; identical to SEQ ID NO: 106242
  CDS (1)..(669): transl_table=11

SEQ ID NO: 107620 - protein, 222 aa, Salmonella typhimurium; identical to SEQ ID NO: 106243

SEQ ID NO: 107621 - DNA, 684 bp, Pseudomonas syringae pv; identical to SEQ ID NO: 106244
  CDS (1)..(684): transl_table=11

SEQ ID NO: 107622 - protein, 227 aa, Pseudomonas syringae pv; identical to SEQ ID NO: 106245

SEQ ID NO: 107623 - DNA, 681 bp, Escherichia coli; identical to SEQ ID NO: 106250
  CDS (1)..(681): transl_table=11

SEQ ID NO: 107624 - protein, 226 aa, Escherichia coli; identical to SEQ ID NO: 106251

SEQ ID NO: 107625 - DNA, 660 bp, Escherichia coli O157
  CDS (1)..(660): transl_table=11
atgcgaattttactgatagaagatgacatgctgattggcgacggcatcaaaacgggccttagtaaaatgggttttagcgtcgactggtttacacaaggtcgtcagggaaaagaggcgctttatagcgcaccttatgatgcggtgatcctggatttaaccttaccaggcatggatggtcgcgatattttgcgcgaatggcgagaaaaaggtcagcgtgagccggtactgatcctgaccgcgcgcgatgcgctggaggaacgtgtagaagggctgcgtctgggagctgacgattatctgtgtaaaccttttgcgttgatagaagtcgccgccaggctggaagctctgatgcgccgaaccaacggccaggccagcaacgagctgcgccacggtaacgtcatgctcgaccccggcaaacgtatcgccacgctggctggcgaacccttaacactgaaaccaaaagaatttgccctgctggaattactgatgcgtaacgctggtcgggtactgccgcgcaaactgattgaagagaaactgtatacctgggacgaagaggtcaccagtaatgccgttgaagtgcatgtgcatcatctgcgacgcaaactcggtagtgattttattcgtaccgtgcatggtattggctacacattaggtgagaaatga

SEQ ID NO: 107626 - protein, 219 aa, Escherichia coli O157
MRILLIEDDMLIGDGIKTGLSKMGFSVDWFTQGRQGKEALYSAPYDAVILDLTLPGMDGRDILREWREKGQREPVLILTARDALEERVEGLRLGADDYLCKPFALIEVAARLEALMRRTNGQASNELRHGNVMLDPGKRIATLAGEPLTLKPKEFALLELLMRNAGRVLPRKLIEEKLYTWDEEVTSNAVEVHVHHLRRKLGSDFIRTVHGIGYTLGEK

SEQ ID NO: 107627 - DNA, 660 bp, Escherichia coli; identical to SEQ ID NO: 105854
  CDS (1)..(660): transl_table=11

SEQ ID NO: 107628 - protein, 219 aa, Escherichia coli; identical to SEQ ID NO: 105855

SEQ ID NO: 107629 - DNA, 666 bp, Haemophilus influenzae; identical to SEQ ID NO: 106252
  CDS (1)..(666): transl_table=11

SEQ ID NO: 107630 - protein, 221 aa, Haemophilus influenzae; identical to SEQ ID NO: 106253

SEQ ID NO: 107631 - DNA, 660 bp, Salmonella typhi; identical to SEQ ID NO: 106254
  CDS (1)..(660): transl_table=11

SEQ ID NO: 107632 - protein, 219 aa, Salmonella typhi; identical to SEQ ID NO: 106255

SEQ ID NO: 107633 - DNA, 660 bp, Serratia marcescens; identical to SEQ ID NO: 106256
  CDS (1)..(660): transl_table=11

SEQ ID NO: 107634 - protein, 219 aa, Serratia marcescens; identical to SEQ ID NO: 106257

SEQ ID NO: 107635 - DNA, 675 bp, Salmonella typhimurium; identical to SEQ ID NO: 106260
  CDS (1)..(675): transl_table=11

SEQ ID NO: 107636 - protein, 224 aa, Salmonella typhimurium; identical to SEQ ID NO: 106261

SEQ ID NO: 107637 - DNA, 26 bp, Artificial sequence
  primer
atgaaaattctgattgttgaagacga

SEQ ID NO: 107638 - DNA, 24 bp, Artificial sequence
  primer
ttagttttcctcattcgcgaccag

SEQ ID NO: 107639 - protein, 275 aa, Artificial sequence
  Variant (10)..(11): xaa in position 10 to 11 is any amino acid
  Variant (13)..(15): xaa in position 13 to 15 is any amino acid
  Variant (17)..(19): xaa in position 17 to 19 is any amino acid
  Variant (21)..(23): xaa in position 21 to 23 is any amino acid
  Variant (24)..(24): xaa in position 24 is any or no amino acid
  Variant (26)..(28): xaa in position 26 to 28 is any amino acid
  Variant (30)..(33): xaa in position 30 to 33 is any amino acid
  Variant (35)..(36): xaa in position 35 to 36 is any amino acid
  Variant (38)..(44): xaa in position 38 to 44 is any amino acid
  Variant (45)..(55): xaa in position 45 to 55 is any or no amino acid
  Variant (57)..(58): xaa in position 57 to 58 is any amino acid
  Variant (64)..(64): xaa in position 64 is any amino acid
  Variant (67)..(69): xaa in position 67 to 69 is any amino acid
  Variant (70)..(70): xaa in position 70 is any or no amino acid
  Variant (72)..(73): xaa in position 72 to 73 is any amino acid
  Variant (76)..(78): xaa in position 76 to 78 is any amino acid
  Variant (80)..(84): xaa in position 80 to 84 is any amino acid
  Variant (85)..(91): xaa in position 85 to 91 is any or no amino acid
  Variant (100)..(102): xaa in position 100 to 102 is any amino acid
  Variant (103)..(103): xaa in position 103 is any or no amino acid
  Variant (107)..(107): xaa in position 107 is any amino acid
  Variant (110)..(111): xaa in position 110 to 111 is any amino acid
  Variant (118)..(118): xaa in position 118 is any amino acid
  Variant (122)..(124): xaa in position 122 to 124 is any amino acid
  Variant (127)..(127): xaa in position 127 is any amino acid
  Variant (131)..(131): xaa in position 131 is any amino acid
  Variant (137)..(142): xaa in position 137 to 142 is any amino acid
  Variant (143)..(151): xaa in position 143 to 151 is any or no amino acid
  Variant (153)..(154): xaa in position 153 to 154 is any amino acid
  Variant (156)..(156): xaa in position 156 is any amino acid
  Variant (158)..(170): xaa in position 158 to 170 is any amino acid
  Variant (171)..(194): xaa in position 171 to 194 is any or no amino acid
  Variant (196)..(196): xaa in position 196 is any amino acid
  Variant (199)..(200): xaa in position 199 to 200 is any amino acid
  Variant (202)..(203): xaa in position 202 to 203 is any amino acid
  Variant (206)..(207): xaa in position 206 to 207 is any amino acid
  Variant (210)..(214): xaa in position 210 to 214 is any amino acid
  Variant (217)..(217): xaa in position 217 is any amino acid
  Variant (219)..(220): xaa in position 219 to 220 is any amino acid
  Variant (222)..(224): xaa in position 222 to 224 is any amino acid
  Variant (227)..(233): xaa in position 227 to 233 is any amino acid
  Variant (234)..(241): xaa in position 234 to 241 is any or no amino acid
  Variant (243)..(243): xaa in position 243 is any amino acid
  Variant (247)..(247): xaa in position 247 is any amino acid
  Variant (249)..(250): xaa in position 249 to 250 is any amino acid
  Variant (253)..(253): xaa in position 253 is any amino acid
  Variant (256)..(259): xaa in position 256 to 259 is any amino acid
  Variant (260)..(264): xaa in position 260 to 264 is any or no amino acid
  Variant (266)..(266): xaa in position 266 is any amino acid
  Variant (271)..(271): xaa in position 271 is any amino acid
  Variant (274)..(274): xaa in position 274 is any amino acid
MRILLVEDDXXLXXXLXXXLXXXXGXXXDXXXXGXXAXXXXXXXXXXXXXXXXXXYXXVILDLXLPXXXXGXXVLXXXRXXXXXXXXXXXXPVLILTARXXXXDRVXGLXXGADDYLXKPFXXXELXARLXALLRRXXXXXXXXXXXXXXXLXXGXLXXXXXXXXXXXXXXXXXXXXXXXXXXXXXXXXXXXXXLXLTXXEXXLLXXLMXXXXXVVXRXXLXXXLYXXXXXXXXXXXXXXXNXIEVXIXXLRXKLXXXXXXXXXIXTVRGXGYXL

SEQ ID NO: 107640 - protein, 16 aa, Artificial sequence
  Variant (2)..(2): xaa in position 2 is His, Lys or Arg
  Variant (3)..(3): xaa in position 3 is Ile, Leu or Val
  Variant (5)..(5): xaa in position 5 is Ile, Leu or Val
  Variant (6)..(6): xaa in position 6 is any amino acid
  Variant (9)..(15): xaa in position 9 to 15 is any amino acid
  Variant (16)..(16): xaa in position 16 is Ile, Leu, Met or Val
MXXLXXEDXXXXXXXX

SEQ ID NO: 107641 - protein, 21 aa, Artificial sequence
  Variant (2)..(4): xaa in position 2 to 4 is any or no amino acid
  Variant (6)..(6): xaa in position 6 is Ile, Leu or Val
  Variant (7)..(7): xaa in position 7 is any amino acid
  Variant (10)..(12): xaa in position 10 to 12 is any amino acid
  Variant (14)..(15): xaa in position 14 to 15 is any amino acid
  Variant (16)..(16): xaa in position 16 is Phe, Ile, Leu or Val
  Variant (17)..(20): xaa in position 17 to 20 is any amino acid
LXXXDXXLPXXXGXXXXXXXR

SEQ ID NO: 107642 - protein, 44 aa, Artificial sequence
  Variant (2)..(2): xaa in position 2 is any amino acid
  Variant (3)..(3): xaa in position 3 is Ile, Leu, Met or Val
  Variant (4)..(4): xaa in position 4 is any amino acid
  Variant (5)..(5): xaa in position 5 is Ile, Leu, Met or Val
  Variant (6)..(6): xaa in position 6 is Ser or Thr
  Variant (7)..(7): xaa in position 7 is Ala, Cys, Gly or Val
  Variant (8)..(8): xaa in position 8 is any amino acid
  Variant (9)..(9): xaa in position 9 is Ala, Asp, Glu, Gly, Ser or Thr
  Variant (10)..(14): xaa in position 10 to 14 is any amino acid
  Variant (15)..(15): xaa in position 15 is Ala, Ile, Leu or Val
  Variant (16)..(17): xaa in position 16 to 17 is any amino acid
  Variant (18)..(18): xaa in position 18 is Phe, Ile or Leu
  Variant (19)..(20): xaa in position 19 to 20 is any amino acid
  Variant (26)..(27): xaa in position 26 to 27 is any amino acid
  Variant (31)..(33): xaa in position 31 to 33 is any amino acid
  Variant (35)..(35): xaa in position 35 is Phe, Leu, Met or Val
  Variant (36)..(37): xaa in position 36 to 37 is any amino acid
  Variant (39)..(39): xaa in position 39 is any amino acid
  Variant (40)..(43): xaa in position 40 to 43 is any or no amino acid
PXXXXXXXXXXXXXXXXXXXGADDYXXKPFXXXEXXXRXXXXXR

SEQ ID NO: 107643 - protein, 27 aa, Artificial sequence
  Variant (2)..(4): xaa in position 2 to 4 is any amino acid
  Variant (5)..(6): xaa in position 5 to 6 is any or no amino acid
  Variant (8)..(9): xaa in position 8 to 9 is any amino acid
  Variant (10)..(10): xaa in position 10 is Ile, Leu or Val
  Variant (12)..(13): xaa in position 12 to 13 is any amino acid
  Variant (14)..(14): xaa in position 14 is Phe or Leu
  Variant (15)..(26): xaa in position 15 to 26 is any amino acid
  Variant (27)..(27): xaa in position 27 is Ile or Leu
LXXXXXEXXXLXXXXXXXXXXXXXXXX

SEQ ID NO: 107644 - protein, 23 aa, Artificial sequence
  Variant (3)..(3): xaa in position 3 is any amino acid
  Variant (5)..(11): xaa in position 5 to 11 is any amino acid
  Variant (12)..(16): xaa in position 12 to 16 is any or no amino acid
  Variant (18)..(19): xaa in position 18 to 19 is any amino acid
  Variant (21)..(21): xaa in position 21 is any amino acid
  Variant (23)..(23): xaa in position 23 is Phe or Tyr
LRXKXXXXXXXXXXXXTXXGXGX

SEQ ID NO: 107645 - DNA, 2697 bp, Escherichia coli K12
  CDS (1)..(2697)
atgtttaaagaaatttttacccggctcattcgccatttaccttcccgtctggttcatcgtgatccattgcctggcgcgcagcagacagtgaatacggtggtcccgccgtccttaagtgcgcattgcctgaaaatggcggtgatgcccgaagaagaattgtggaaaacgttcgacacccatccggaagggttaaatcaggcggaagtggaatctgcccgcgaacaacatggtgaaaataaattacccgcacaacaaccgtcgccgtggtgggtacatttatgggtctgctatcgcaacccctttaatattttactcaccattctcggcgctatttcttacgccacggaagatttatttgccgcgggcgttatcgcgctaatggtcgctatttcaacgttgctgaactttattcaggaagcacgttccactaaagcggcagatgccctgaaagcgatggtcagcaataccgcgacggtgctgcgcgtaattaacgacaaaggcgaaaatggctggctggagatcccgatcgaccagctggtgcccggcgatattataaaactggcggcgggagatatgatcccggcagatttacgtatcttgcaggcgcgggatctgttcgtcgctcaggcgtcgttaaccggtgagtctctgcccgtggaaaaagccgctaccactcgccagccggagcacagcaatccgctggagtgcgacacgctgtgttttatgggcaccaccgtggtgagcggcacggcacaagcaatggtgattgctacaggtgccaatacctggtttggtcaactggcggggcgtgttagtgagcaggaaagcgagccgaatgcctttcagcaagggatcagccgcgtcagtatgctgctgattcgctttatgctggtgatggcaccggtggtgctgttaatcaatggctacaccaaaggcgactggtgggaagcggcgctgtttgcgctttcggtcgcggtaggcctaacgccggaaatgttgccgatgattgttacctcgacgctggcgcgcggcgcagtaaagctgtcgaaacagaaagtgatcgtcaaacatctggatgctattcagaactttggcgcaatggatattctgtgcactgataaaaccggcaccctgacacaggataaaattgtgctggagaatcataccgatatctccggtaaaaccagcgaacgcgtgctgcatagcgcgtggttgaatagtcattatcagaccggacttaaaaacctgctcgatacagcggtgctcgaaggtacggatgaagagtcagcgcgctcgctggccagtcgttggcaaaaaatcgatgagattccgtttgatttcgagcgtcgccggatgtcggtggtagtggcagaaaataccgagcaccatcagctggtttgcaaaggtgcattgcaggaaatcctcaatgtgtgttcgcaggtgcgtcacaatggcgagattgtgccgctcgatgacatcatgctgcgtaagattaagcgggttactgatacgctgaatcgtcaggggctgcgcgtggttgcggtggcgacgaaatacctgccagcgcgtgaaggagattaccagcgggcggatgaatccgacctgatcctcgaaggatatattgctttccttgatccgccaaaagagacaaccgctccggcactgaaggcattaaaagcgagtggaattaccgtaaaaatccttactggcgacagtgagttagttgcagcgaaagtgtgccatgaagtggggctggacgcgggagaggtggtcattggtagtgatattgaaacgctatctgacgacgaactggcaaatcttgcacagcgcactacgctgtttgcccgcctgacgccgatgcataaagaacgcattgtgaccttactgaagcgcgaagggcatgtggttggctttatgggcgatggtattaatgatgcgcccgccttacgcgctgcggatatcggcatttctgtggacggcgcggtagatattgcccgtgaagcggctgatatcatcctgctggaaaaaagcctgatggtgctggaagagggggttattgagggacgtcgcactttcgccaacatgctgaaatacatcaaaatgacggcgagttctaacttcggtaatgtgttcagcgtgctggtggcgagtgctttcttgcccttcctgccgatgttgccgttacacttgcttattcagaacctgctgtacgatgtgtcacaggtggcgatcccgtttgataacgtcgacgacgagcaaattcaaaagccgcagcgttggaatccggcggatctggggcgctttatgatcttcttcggaccgatcagctcgatcttcgatattctgacgttttgcctgatgtggtgggtattccatgccaacacgccggaaacgcaaacgctgttccagtcgggatggtttgtggtgggcttactgtcgcaaacgctgattgtgcatatgatccgcacccgccgtgtgccgtttattcagagctgtgcatcgtggccgttaatgatcatgaccgtgatcgtgatgattgtcgggatcgcattgccgttttcaccgctggccagttatctgcaattacaggcgctgccgttaagctatttcccgtggctggttgcgattctggcagggtatatgacattaacccagttggtgaaagggttctatagccgtcgttacggctggcaataa

SEQ ID NO: 107646 - protein, 898 aa, Escherichia coli K12
MFKEIFTRLIRHLPSRLVHRDPLPGAQQTVNTVVPPSLSAHCLKMAVMPEEELWKTFDTHPEGLNQAEVESAREQHGENKLPAQQPSPWWVHLWVCYRNPFNILLTILGAISYATEDLFAAGVIALMVAISTLLNFIQEARSTKAADALKAMVSNTATVLRVINDKGENGWLEIPIDQLVPGDIIKLAAGDMIPADLRILQARDLFVAQASLTGESLPVEKAATTRQPEHSNPLECDTLCFMGTTVVSGTAQAMVIATGANTWFGQLAGRVSEQESEPNAFQQGISRVSMLLIRFMLVMAPVVLLINGYTKGDWWEAALFALSVAVGLTPEMLPMIVTSTLARGAVKLSKQKVIVKHLDAIQNFGAMDILCTDKTGTLTQDKIVLENHTDISGKTSERVLHSAWLNSHYQTGLKNLLDTAVLEGTDEESARSLASRWQKIDEIPFDFERRRMSVVVAENTEHHQLVCKGALQEILNVCSQVRHNGEIVPLDDIMLRKIKRVTDTLNRQGLRVVAVATKYLPAREGDYQRADESDLILEGYIAFLDPPKETTAPALKALKASGITVKILTGDSELVAAKVCHEVGLDAGEVVIGSDIETLSDDELANLAQRTTLFARLTPMHKERIVTLLKREGHVVGFMGDGINDAPALRAADIGISVDGAVDIAREAADIILLEKSLMVLEEGVIEGRRTFANMLKYIKMTASSNFGNVFSVLVASAFLPFLPMLPLHLLIQNLLYDVSQVAIPFDNVDDEQIQKPQRWNPADLGRFMIFFGPISSIFDILTFCLMWWVFHANTPETQTLFQSGWFVVGLLSQTLIVHMIRTRRVPFIQSCASWPLMIMTVIVMIVGIALPFSPLASYLQLQALPLSYFPWLVAILAGYMTLTQLVKGFYSRRYGWQ

SEQ ID NO: 107647 - DNA, 3208 bp, Sus scrofa domestica (domestic pig)
  CDS (34)..(3138)
tctcagcaaaggagggtggctgcactgggcaccatggggaaggcggagaattatgagctgtaccaagtagagctgggtcctggtcctagtggggacatggcagccaagatgagcaagaagaaggcgggccgtggtgggggcaagaggaaggagaagctggagaacatgaagaaggagatggagattaatgaccaccagctgtccgtggcagagctggaacagaaataccagaccagtgcaaccaagggcctgtctgccagcctggctgcagagctgctgctgcgggatgggcccaacgcgctgaggccgccacggggcacccctgagtacgtcaagttcgcaaggcagctggcgggcggtctgcagtgcctcatgtgggtagcagcggccatctgcctcattgcctttgccatccaggccagcgagggcgaccttaccacggacgacaatctatacctggcactggccctcatcgctgtggttgtggtcacgggctgctttggctactatcaggagtttaagagcaccaacatcatcgccagcttcaagaaccttgtgccccagcaagcgactgtgatccgagatggggacaagttccagatcaatgcagatcagctcgtggtaggcgacctggtggagatgaaaggcggggatcgagtgccagccgacatccgcatcctccaggcccagggccgcaaggtggacaactcctcgctgaccggagagtcggagccgcagacccgctcacccgagtgcacacacgagagccccctggagacccgcaacatcgccttcttctccaccatgtgcctcgagggcacggcacagggcctggtggtgaacaccggcgaccgcaccatcatcgggcgcattgcgtccctggcctcgggggtagaaaacgagaagacgcccatcgctatcgaaatcgaacactttgtggacatcatcgcaggcctggccatcctctttggtgccacgtttttcattgtggccatgtgcatcggctacaccttcctgcgggccatggtcttcttcatggccatcgtggtagcctatgtgcctgaggggctgctggccacggtcacggtctgcctgtccctgacagccaagcggctggccagcaagaactgtgttgtcaagaacctggaagcggtggagacactgggctccacgtcagtcatctgctctgacaagacggggaccctcactcagaatcgcatgactgtgtcccacctgtggttcgacaaccacatccactccgctgacactacagaagaccagtcagggcagacatttgaccagtcctcagagacgtggcgggcgctgtgccgcgtgctcaccctctgcaaccgcgctgccttcaagtcgggccaggacgcggtgcctgtgcccaagcgcatcgtgatcggagacgcgtccgagacggcgctgctcaagttctcggagctgacgctgggcaatgccatgggctaccgtgagcgcttccccaaagtctgcgagatccccttcaactccaccaacaagttccagctgtccatccacacactggaggaccctcgggacccgaggcacgtgcttgtgatgaagggcgcccccgagcgcgtcctggagcgctgtagctccatcctcatcaagggccaggagctgccactggatgagcaatggcgcgaggccttccagactgcctacctcagcctgggaggcctcggagagcgggtcctgggcttctgccagctctacctgagtgagaaggactacccgcctggctatgccttcgacgtggaggccatgaactttccaaccagtggcctgtcgttcgcgggactcgtatccatgatagacccaccccgggccaccgttcctgatgccgtgctcaagtgccgaacagcaggcatccgggtgatcatggtgacaggtgaccaccccatcacagccaaggccattgcagccagtgtgggcatcatctcggaaggcagcgagacagtggaggacattgcagcccgcctccgtgtgcccgtggaccaggttaatcggaaggatgcccgagcctgcgtgatcaacggcatgcagctgaaggacatggacccatcagagctggtcgaagccctgcgtacccaccctgagatggtctttgctcgcaccagtccccagcagaagctggtgattgtggagagctgccagcgactgggtgcaatcgtggctgtgacaggggatggtgtgaatgactccccagccctgaagaaggcagacatcggtgtggccatgggtattgctggctcggatgctgccaaaaatgcagccgacatgatcctgctggatgacaacttcgcctccattgtgactggcgtggagcagggccgactgatctttgacaacttgaaaaagtccatcgcctacacgttgaccaagaacatccctgaattgacgccctacctcatttacatcaccgtcagcgtgcccctgcccctcgggtgcatcaccatcctcttcattgaactctgcactgacatctttccatctgtgtccctggcatatgagaaggccgagagtgacatcatgcacctgcgcccgcggaatccaaagcgtgaccggttggtcaacgagcccctggctgcctactcctacttccagatcggtgccatccagtcatttgctgggttcactgactacttcacggccatggcccaggagggctggttcccactgctgtgtgtggggctgcggccacagtgggagaaccaccacctacaagacctgcaggacagctatggccaggagtggacgtttgggcagcgcctgtaccagcagtacacctgctacactgtgttcttcatcagcatcgagatgtgccagattgctgacgtcctcatccgcaagacgcgccgcctctcagccttccagcagggcttcttcaggaacaggatcctggtgatcgccatcgtgttccaggtctgcatcggctgcttcctgtgctactgccccgggatgcccaacatcttcaacttcatgcccattcggttccagtggtggctggttcccatgccctttggcctcctcatcttcgtctatgatgagatcaggaaacttggagttcgctgttgcccagggagctggtgggaccaggaactctactattagagggaccattgcctgcaagccatccttgcatacaccacagtggggggcagggacacacggaacccctggg

SEQ ID NO: 107648 - protein, 1034 aa, Sus scrofa domestica (domestic pig)
MGKAENYELYQVELGPGPSGDMAAKMSKKKAGRGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLALALIAVVVVTGCFGYYQEFKSTNIIASFKNLVPQQATVIRDGDKFQINADQLVVGDLVEMKGGDRVPADIRILQAQGRKVDNSSLTGESEPQTRSPECTHESPLETRNIAFFSTMCLEGTAQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHSADTTEDQSGQTFDQSSETWRALCRVLTLCNRAAFKSGQDAVPVPKRIVIGDASETALLKFSELTLGNAMGYRERFPKVCEIPFNSTNKFQLSIHTLEDPRDPRHVLVMKGAPERVLERCSSILIKGQELPLDEQWREAFQTAYLSLGGLGERVLGFCQLYLSEKDYPPGYAFDVEAMNFPTSGLSFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRPQWENHHLQDLQDSYGQEWTFGQRLYQQYTCYTVFFISIEMCQIADVLIRKTRRLSAFQQGFFRNRILVIAIVFQVCIGCFLCYCPGMPNIFNFMPIRFQWWLVPMPFGLLIFVYDEIRKLGVRCCPGSWWDQELYY

SEQ ID NO: 107649 - DNA, 3054 bp, Gallus gallus (chicken)
  CDS (1)..(3054)
atggacggccgcgagtattcccccgctgccaccacgtcggagaatgggggcgggcggcggaagcagaaggagaaggagttggatgagctgaagaaggaggtcaacctggatgaccataagttgtccctcgatgagctggggaggaagtaccaggtggatctgtcccgggggctgagcaatgcccgcgctgcagaggtgctggcgcaggacggccccaacgcgctgaccccccctcccaccacccccgagtgggtgaagttctgccggcagctcttcgggggtttctccatcctgctgtggatcggagccatcctctgcttcctcgcctacggcatccaggctgccatggaggatgagccctccaacgacaacctgtacctgggggtggtgctggccgctgtcgtcattgtcaccggctgcttctcctactaccaagaagccaagagctccaagatcatggactccttcaagaacatggtgccgcagcaagcgctggtgatccgcgagggagagaagatccaaatcaacgcggagaatgtggtggtgggcgacctggtggaggtgaagggcggcgatcgcgtgcctgccgacatgcgcatcatctcctcccacggctgcaaggtggacaactcgtccctgacgggggagtcggagccgcagacgcgctccccggagttcacccacgagaaccccctggagacgcgcaacatctgcttcttctccaccaactgcgtggaaggcaccgcccggggcatcgtcatctccacgggggaccgcacggtgatggggcgcatcgcctcgctggcgtcggggctggaggtggggcgcacgcccatcgccatggagatcgagcacttcatccgcctcatcaccggcgtcgccgtcttcctcggcctctccttcttcatcctctccctcatcctgggctacacgtggctcgaggccgtcatcttcctcatcggcatcatcgtggccaacgtccccgaggggctgctggccaccgtcactgtgtgcctgacgctgacggccaagcgcatggcgcgcaagaactgcctggtgaagaacctggaggcggtggagacgttgggctccacctccaccatctgctccgacaaaaccgggaccctcacccagaaccgcatgacggtggcccacatgtggttcgacaaccagatccacgaggccgacaccaccgaggatcagtccggtgccacctttgataagcgctcgcccacctgggccgcgttgtcgcgcattgccgggctctgcaaccgcgccgtcttcaaaccgggacaggagaacatctccatttcgaagcgcgacaccgcaggcgacgcatccgagtcggcgctgctgaagtgcattcagctctcgtgcggctccgtcaagaagatgcgggacaagaaccccaaagtcactgaaatcccctttaactccaccaacaagtaccagctctccatccacgagcgggaggaggacccccagggacacatcctggtgatgaaaggggcccccgagcgcatcctggagcgctgctcccgaatcctactgcagggccaggaggtgcccctggacgaggagatgaaggaggccttccagaacgcctacctggagctcggggggctgggggagcgcgtgcttgggttctgccacctctacctgccccccgacaagttcccgcggggtttccgcttcgacgccgatgaggtcaacttccccaccagcgacctctgcttcgtggggctcatgtctatgatcgaccccccccgcgccgccgtccccgacgccgtcggcaaatgccgcagcgctgggatcaaggtgattatggtgacgggggaccaccccattacggccaaagccatcgccaaaggggtcgggatcatctcagagggcaacgagacggtggaggacatcgcggcgcggctcaacatccccgtcagccaggtcaacccgcgggaggccaaggcgtgcgtggtgcacggctccgacctgaaggacatgacggcggaacagctggacgagatcctgcgcaaccacaccgagatcgtcttcgcccgcacctccccgcagcagaagctcatcatcgtcgagggctgccagcgccagggggccatcgtggcggtgacgggggacggtgtgaacgactccccggcgctgaagaaagcggacatcggcatagcgatgggcatcgcgggctccgatgtgtccaagcaggcggccgacatgatcctattggacgacaacttcgcctccatcgtcaccggcgtcgaggaagggcgcctcatcttcgacaacctgaagaagtccatcgcgtacactctgaccagcaacatccccgagataacgcccttcctcctcttcatcatcgccaacatcccgctgcccctcggcaccgtcaccatcctctgcatcgacctgggcaccgacatggtccccgccatctctctggcctacgaagcagctgagagtgacatcatgaagcggcagccacgcaacccccgcaccgataagctcgttaacgagcgcctcatcagcatggcctacgggcagatcgggatgattcaggcgctgggggggttcttcacctactttgtgatcctggctgagaacggtttcctgcccgcacggctgctgggggtgcgcctggcgtgggacgaccgctccaccaacgacctcgaggactcctatgggcaggagtggacgtacgagcagcgcaaggtggtggagttcacgtgccacacggcgttcttcgccagcatcgtggtggtgcagtgggccgacctcatcatctgcaaaacgcgccgcaactccgtcttccagcagggcatgaagaataagatcctcattttcgggctgctggaggagacggcgctggcggcgttcctgtcctactgccccgggatgggggtggccctgcgcatgtaccccctcaaggtcacgtggtggttctgcgccttcccgtacagtctgctcatctttgcctacgacgaagtgcgcaaacttatcctgcgccgctaccccggaggttgggtggagaaggagacgtactactga

SEQ ID NO: 107650 - protein, 1017 aa, Gallus gallus (chicken)
MDGREYSPAATTSENGGGRRKQKEKELDELKKEVNLDDHKLSLDELGRKYQVDLSRGLSNARAAEVLAQDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKIQINAENVVVGDLVEVKGGDRVPADMRIISSHGCKVDNSSLTGESEPQTRSPEFTHENPLETRNICFFSTNCVEGTARGIVISTGDRTVMGRIASLASGLEVGRTPIAMEIEHFIRLITGVAVFLGLSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWAALSRIAGLCNRAVFKPGQENISISKRDTAGDASESALLKCIQLSCGSVKKMRDKNPKVTEIPFNSTNKYQLSIHEREEDPQGHILVMKGAPERILERCSRILLQGQEVPLDEEMKEAFQNAYLELGGLGERVLGFCHLYLPPDKFPRGFRFDADEVNFPTSDLCFVGLMSMIDPPRAAVPDAVGKCRSAGIKVIMVTGDHPITAKAIAKGVGIISEGNETVEDIAARLNIPVSQVNPREAKACVVHGSDLKDMTAEQLDEILRNHTEIVFARTSPQQKLIIVEGCQRQGAIVAVTGDGVNDSPALKKADIGIAMGIAGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNPRTDKLVNERLISMAYGQIGMIQALGGFFTYFVILAENGFLPARLLGVRLAWDDRSTNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFAYDEVRKLILRRYPGGWVEKETYY

SEQ ID NO: 107651 - DNA, 2874 bp, Nicotiana plumbaginifolia (curled-leaved tobacco)
  CDS (1)..(2874)
atgggggaggagaagcctgaagtgctggatgcagtattgaaagaggctgttgatttggaaaacatacccattgaagaagtttttgagaatctgagatgcacaaaggagggtctcacagctactgctgcccaagaaaggctggccatttttggctacaacaagctagaggagaagaaggatagcaaactcttgaaatttttggggttcatgtggaaccctctatcatgggttatggaagctgcagctatcatggcaattgctcttgcaaatggaggaggaaagcctccggattggcaggatttcgtgggtatcattactttacttataattaactcaacgatcagttttattgaggagaataatgctggaaatgcagcagctgcccttatggctcgacttgctccaaaggccaaggttcttcgagatggaagatggaaggaagaagatgctgccgttcttgtgcctggtgacataatcagtatcaaactgggagatataattcctgcagatgctcgtcttcttgagggtgatccgctgaaaattgatcagtctgctttgacgggtgaatctcttcctgtaactaaaggtccgggagacggagtctactctggttcaacctgtaaacaaggagagatagaagctatcgtcatcgccacaggagttcataccttttttgggaaggctgcccaccttgttgacagtacaaaccaagtgggacatttccaaaaggttttgactgctataggaaacttctgcatctgttctattgcagtggggatgataattgagattattgtcatgtaccctatccaacaccgcgcataccgtcctgggattgacaatcttcttgtgcttcttattggtggaattccaattgccatgccaactgttctttctgttactatggcaattggttctcatcgtcttgctcaacagggtgccattacaaaaagaatgacagctatagaggagatggctggcatggatgtgctctgtagtgacaagaccgggaccctgactctaaacaagcttactgttgataaaaaccttattgaggtttttgccaaaggtgttgatgcagatatggtagttctaatggcagctcgagcctcaagaacagagaatcaggatgccattgatgctgctattgttgggatgttggctgatccgaaggaggcacgtgctggcattcgtgaaatacacttccttcctttcaatccaactgacaagcgaacagcacttacctatcttgatggtgaagggaagatgcacagggtcagcaaaggtgctcccgagcagatcctaaatcttgcacacaacaagtcagacatagaacgtagagttcatgctgtgatcgataagtttgctgagcggggtttacggtcacttggtgtggcataccaggaagtcccagagggaaggaaggagagtgctggggggccatggcagttcattggtctcttgcctttgtttgatccaccaagacatgatagtgcagagaccataaggagagcattgaacctcggagtaaatgttaaaatggttacaggggatcaactcgcaattggaaaagaaactgggcgtcgcttgggaatgggaacaaatatgtacccttcatctgctctgttgggacagaccaaggatgaatccatttctgccttaccaattgatgaacttatagagaaggctgatggttttgctggtgtttttcccgagcacaaatatgagatagtaaagcgcttgcaagctaggaaacacatatgcggaatgactggtgatggagtcaatgatgctcctgctctaaagaaggctgatattggaatagctgttgatgatgccactgatgctgctcgtagtgcttctgacattgtccttactgaacctggtctaagtgtcatcatcagtgctgttttaaccagtcgagcaatctttcaaaggatgaaaaactacacgatatatgccgtttctatcacaatccgtattgtgcttggttttatgcttttggcactgatatggaagtttgactttccaccttttatggtgcttatcattgcaatcctcaacgacggcaccattatgacaatatcaaaggatagggtcaaaccatctcctctacctgatagttggaagctagctgaaatttttactactggtattgttcttggtggctatttggctatgatgacagtcatattcttttgggcagcatacaaaacaaacttcttccctcatgtattcggagtatcaacacttgagaagacagcaactgacgacttcaggaagcttgcctcagcaatttaccttcaagtgagcattatcagtcaggccctgatatttgtcacaagatctcgaagttggtcgtttgttgagcgtcctggttttctacttgtgattgcttttgtaattgctcaactggttgcaaccttgattgctgtttacgcaaattggagctttgctgctattgaaggaattggctggggttgggctggagtgatctggatctacaatctagtattctatatccctcttgatataatcaagttcttcatccgctatgctctcagtggaagggcctgggatcttgtttttgagcgaaggattgcttttaccaggaagaaggatttcgggaaagaacagcgtgagcttcagtgggcacacgcacagaggacccttcacgggctgcaagttcctgacacaaaattatttagtgaagctaccaatttcaacgagcttaatcagttggctgaggaagcaaagaggagagctgaaattgctagacttcgggagttgcatacactgaaaggccatgtggaatccgtggtgaagttaaagggacttgatatagagacaattcaacaggcatacactgtttga

SEQ ID NO: 107652 - protein, 957 aa, Nicotiana plumbaginifolia (curled-leaved tobacco)
MGEEKPEVLDAVLKEAVDLENIPIEEVFENLRCTKEGLTATAAQERLAIFGYNKLEEKKDSKLLKFLGFMWNPLSWVMEAAAIMAIALANGGGKPPDWQDFVGIITLLIINSTISFIEENNAGNAAAALMARLAPKAKVLRDGRWKEEDAAVLVPGDIISIKLGDIIPADARLLEGDPLKIDQSALTGESLPVTKGPGDGVYSGSTCKQGEIEAIVIATGVHTFFGKAAHLVDSTNQVGHFQKVLTAIGNFCICSIAVGMIIEIIVMYPIQHRAYRPGIDNLLVLLIGGIPIAMPTVLSVTMAIGSHRLAQQGAITKRMTAIEEMAGMDVLCSDKTGTLTLNKLTVDKNLIEVFAKGVDADMVVLMAARASRTENQDAIDAAIVGMLADPKEARAGIREIHFLPFNPTDKRTALTYLDGEGKMHRVSKGAPEQILNLAHNKSDIERRVHAVIDKFAERGLRSLGVAYQEVPEGRKESAGGPWQFIGLLPLFDPPRHDSAETIRRALNLGVNVKMVTGDQLAIGKETGRRLGMGTNMYPSSALLGQTKDESISALPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGIVLGGYLAMMTVIFFWAAYKTNFFPHVFGVSTLEKTATDDFRKLASAIYLQVSIISQALIFVTRSRSWSFVERPGFLLVIAFVIAQLVATLIAVYANWSFAAIEGIGWGWAGVIWIYNLVFYIPLDIIKFFIRYALSGRAWDLVFERRIAFTRKKDFGKEQRELQWAHAQRTLHGLQVPDTKLFSEATNFNELNQLAEEAKRRAEIARLRELHTLKGHVESVVKLKGLDIETIQQAYTV

SEQ ID NO: 107653 - DNA, 4645 bp, Rattus norvegicus (Norway rat)
  CDS (179)..(2938)
tccctgccaccatcctgctcgttccctccggacgcggctgggctccgtgtggcgccaccgtgccgccagcagcgcccgtcgcccgaggcgcgtggggcgcccccgcagccccgcgatgtggccgtggctgacactaaagactttgtagccatcaaccagagtgcagtttcgatggaaaatgaaggttgcacgatttcaaaagatccctaatgttgaaaatgagacaatgatccctgtactgacatccaagagagcaagtgagttagcagtcagtgaggtcgcaggccttctccaggctgatcttcagaatggcttaaacaaatctgaagttagtcataggcgagccttccatggctggaatgagtttgatatcagtgaagatgaaccattatggaagaagtacatttctcagtttaaaaatcccctcatcatgctgcttctggcttcggcagtcatcagcgttttaatgcgtcagtttgatgatgccgtcagtatcactgtggcaatactgattgttgtcaccgtggcctttgttcaggaatatcgttcagaaaaatctttagaagaattaagtaaacttgtgccaccagaatgccattgtgttcgtgaaggaaaattggagcatacacttgcccgagacttggttccaggtgatacagtttgtctgtctgtgggggacagagttcctgctgacttacgcttattcgaggccgtggatctttccatcgatgagtctagcttgacaggagagacaactccttgttctaaggtgaccgctcctcaaccagctgctaccaatggggatcttgcatcaagaagtaacattgccttcatggggactctggtcagatgtggcaaagcaaagggtattgtcattggaacaggagagaattctgaatttggagaggtctttaagatgatgcaggcagaagaagcaccaaaaacgcctctgcagaagagcatggacctcttgggcaagcagctgtccttttactcctttggtataataggtatcatcatgttggttggctggttactagggaaagacattctggaaatgttcactattagtgtaagtttggctgtagctgcaattcctgaaggtctgcctattgtggtcacagtgacactagcccttggtgttatgagaatggtgaagaaaagggctattgtaaagaaattgcctattgttgaaacgctgggctgctgtaatgtgatttgttcagataaaactggaaccctgacgaagaatgagatgactgttactcacatcctcacttcagacggcctgcatgctgaggttactggagttggctacaatcagtttggtgaagtgattgttgatggtgatgttgttcatggattctataacccagctgttagcagaattgttgaggcgggctgtgtgtgcaacgatgctgtcattaggaacaacactctgatgggaaagccaactgaaggagccttaatcgctctcgcgatgaagatgggtcttgatggactgcaacaagactatatcagaaaagctgaatacccttttagttctgagcagaaatggatggctgttaagtgtgtgcaccgaacacagcaggacagaccagagatttgttttatgaagggtgcttatgagcaggtgattaagtattgtactacgtacaacagcaaagggcagactttggcacttacccagcagcagagagatttgtaccaacaagagaaggcccagatgggctcggcaggactccgagttcttgcactggcgtctggtccggacctggggcagctgaccctccttggcctggtaggaatcattgaccctccgagaactggtgtgaaagaagccgtcacaacactcattgcctcaggagtctccatcaaaatgatcacaggagactctcaggagactgcaattgcaatcgctagtcgtctgggattgtattctaaaacttcacagtctgtgtctggagaagaagtagatacaatggaagtccagcacctttcacagatagtgccaaaggttgcagtattttacagagcaagcccaagacacaagatgaaaattatcaagtctctacaaaagaacgggtcagttgtagccatgacaggagatggggtaaatgatgcagtggctctgaaggctgcagatattggagttgcaatgggccagactggcacagatgtttgcaaagaggctgcggacatgatcttggtggatgatgatttccaaactataatgtctgcaatagaagagggtaaaggcatttataataacattaaaaattttgttagatttcaactgagcacgagtatagcagcattaactttaatctcattggctacgttaatgaactttcctaaccctctcaatgcaatgcagattttgtggatcaatattataatggatggacccccagctcagagccttggagtagagccagtggataaagatgtcattcgaaaaccccctcggaactggaaggacagcattttgacaaaaaacttgatccttaaaatacttgtttcatcaataatcattgtctgtgggactttgtttgtcttctggcgagagcttcgagacaatgtgataacaccccgagacacaacaatgactttcacttgcttcgtgttttttgatatgttcaatgcactgagttccagatctcagactaagtctgtgtttgagattggactctgcagtaataagatgttctgctatgcggttcttggatccatcatggggcagttgcttgttatctacttcccgcctctgcagaaggtttttcagaccgagagcctcagtattctggatctgttgtttcttttgggtctcacttcatcagtgtgcattgtgtctgaaattataaagaaggttgaaaggagcagggaaaagactcagaagaacactacttcaacaccatcgtcttttcttgaagtatgatgcatattgcattttttttttcatttgcaaactaggaattgcagtctgggaatcatttagaagggcaagttcaagaggataatgaagatttaaggacttttaaactttccattgactaaaaatgaccattaatgttaaagacttgatttgaaccttgttggtagtcccaaatgaaattatgcaactttgaataacacgttccttgatttgaattggcttttgcaatcgattggaacttcaacatatggtcaagtactgaattaaaaaagtacaaaaggcaaaacgtgaacaccttctgcacttagagttctaatgtacaaatacactatctgtcttagatggatataaatattttttttatttttaaatattgtactatttatggttgtggggctttcttactaatacactcaataaatgcactcagtcatttcaaaggcattctatttggtttagaaattgccaggagtgccatatttcagctaccatgtttcctttttcctgcaatgtacgcaaatgataccttgtgctaccatttttatatttcaagttttttattttttatttttgcacaggatgtgaccactgtctaatcactgttctttctttttgtgactgaaaagcatatactgcaattgaagtaaatgtttgctcttcttagtaagtgtacatggttgttttggttttttgtagtggttttccacagaggtgtgagtctttgacctagcaggattagttcaggctgttgttgcattacagttagagtaattgtacttaacacagtcaaagagtcaaaaacaacaaaggccggatggaatttcaaacagactatgttaacacgtccttgtttaggttaatacagttctactttgtcagtgtcatcttgtcatttcttctttataaatcaaacacttcagctaaataattgacctttattactgtttcatatttgtatttttaagtctatttcttagagagtatagactaccatacttagaaaatcaaaagtcccaaactcagagagataggacatgaaccagggtgtccatcagaagatcctgtgcaggccttgctcctccgaatcctctaggcagccgctttggcctagattgtagcacaaccctgagtctgtcccttctgccgtttgttgggatccgtcttcttcttttggtatgcttgggaaatagatggatttgctttgtgtaaaccatcagtttttataagagcttgacaaaataaaggtaagtgttgaatcttgtatttcataaactgtcagaattaactgttctgagcttgttcaatattactggtgagtgttaacgctgctgcgctgtcgttgataggagaactctgttgtctgagtctgtactactgaagcatgaacgtaaggagccagatgtctgactttgtcttaatctctcaggctcaactgtcagtgtacattgttctgtctcattaggtgggacgtgaggtcactgtcaaccaactcatagaggtttgatgtctcatagcaaaattttataatggttttttacattctgttccaaacttgaaaactacatattaagtgcatattcagtcttgtttgttttacagtagaggttgagaatatgactcatgaaatgaatgtgcctatcttttcacttggtattgaactataaaaataaagtgagtttttcataagttcaaaaaaaaaaaaaaaaaaaa

SEQ ID NO: 107654 - protein, 919 aa, Rattus norvegicus (Norway rat)
MKVARFQKIPNVENETMIPVLTSKRASELAVSEVAGLLQADLQNGLNKSEVSHRRAFHGWNEFDISEDEPLWKKYISQFKNPLIMLLLASAVISVLMRQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGIVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHILTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYNSKGQTLALTQQQRDLYQQEKAQMGSAGLRVLALASGPDLGQLTLLGLVGIIDPPRTGVKEAVTTLIASGVSIKMITGDSQETAIAIASRLGLYSKTSQSVSGEEVDTMEVQHLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNKMFCYAVLGSIMGQLLVIYFPPLQKVFQTESLSILDLLFLLGLTSSVCIVSEIIKKVERSREKTQKNTTSTPSSFLEV

SEQ ID NO: 107655 - DNA, 3229 bp, Lycopersicon esculentum (tomato)
  CDS (121)..(2991)
aaatcttgtcctcttttcttcatctgcttcacctaattttgttgcttcactgagttatatttatggtgtttttgatctgagacactgttatcaaaagggggaaaaacaagttttaggaagatggcggaaaagcctgaagttctggatgctgtcttgaaggagactgttgatttggaaaacataccgattgaggaggtttttgagaatctgagatgtaccagagagggacttactgctactgctgctcaagaaaggttgtccatttttgggtacaataagctcgaggagaaaaaggagagcaaattcttgaaatttttgggatttatgtggaaccctctctcatgggttatggaggctgctgctatcatggcaattgctcttgctaatggaggaggaaagccaccggactggcaggattttgtgggtatcatcacattgctcataatcaactcaacaattagttttatcgaggagaacaatgctggcaatgcagcagctgcactgatggctcgacttgctccaaaagccaaggttcttcgagatggaaaatgggacgaggaagatgcttctgttcttgtgcctggggacataatcagtattaaactgggagatatcattccagctgatgctcgtcttctagagggtgatccactcaaaattgatcagtctgctttgaccggtgaatctcttcctgtaacaaaaggtcctggagatggtgtttactctggctccacgtgtaagcagggagagatagaagctgttgtgattgctacaggggttcataccttttttggaaaggcagctcaccttgttgacagtacaaaccaagtgggacactttcagaaggttttgactgctatagggaacttctgcatctgttcaattgcagtagggatgataatagagattattgtgatgtaccctatccaacaccgcaaataccgtcctggcatagacaatcttctggtgcttctcattggtgggattccaattgctatgccaactgttctctcagtcacgatggcaataggttctcatcgtcttgctcaacagggggccattacgaaaagaatgacagctatagaggagatggctggcatggatgttttgtgcagcgacaagacgggaaccctaacattgaacaagctgactgttgataaagcccttattgaggtatttgcgaaaggaattgatgcagacactgtagttcttatggcagctcgagcctctcgaattgagaaccaggatgcgattgatactgctattgttgggatgttggctgatccgaaggaggcacgtgctggaattcgtgaaatacactttcttcctttcaatccaactgataaacgaacagcacttacttatcttgatggtgagggaaaaatgcatagggtcagcaaaggtgcaccggagcagattcttaatcttgcacacaacaagtctgacatagagcgtagagttcatacagtgattgataagtttgctgagcggggcttgcggtcgcttggtgtggcatatcaggaagttccggagggacggaaggagagcgctggggggccatggcagttcattgctctcctccctttgtttgatccacctaggcacgacagtgctgagactataaggagggctttaaaccttggagtaaatgtcaaaatgatcacaggagatcaattggcaattggaaaagaaactgggcgccgcctgggaatgggtacaaatatgtatccttcatctgctctgttgggacagacgaaggatgaatcaatcgctgctttgccaattgatgaacttatagaaaaggctgatgggtttgctggtgttttccctgagcacaaatatgagatagtaaagcgcttgcaagctaggaaacatatctgtggtatgactggtgatggagtcaatgatgctcctgctctaaagaaagctgatattggaattgctgttgacgatgcaactgatgcggctcgcagtgcttctgatattgtccttactgaacctggtcttagtgtcatcattagtgctgttttgaccagtcgagcaatctttcaaaggatgaaaaattacacgatatatgctgtttccatcacaatccgtattgtgcttggttttatgcttctggctctgatctggaagtttgactttccgcctttcatggtgcttatcattgcaattcttaatgatggtaccattatgacgatatcgaaggatagggtcaaaccatctcctctgcctgatagctggaaactggctgagatttttactactggagttgttcttggtggctacttggcaatgatgacggtcattttcttttgggccgcatacaaaacaaatttcttcccgcgaatatttggggtatcaacacttgagaaaacagcaactgatgattttaggaagctcgcctctgcgatataccttcaagtaagcactatcagtcaggccctgatattcgttacaagatctcgaagttggtcgtttgtggagcgtcctgggttgttgctagtgtttgcctttttcgttgctcaactggttgccaccttgattgctgtttatgcaaattggagctttgctgcaattgaaggaattggctggggttgggctggagttatctggctttacaatattgttacctatatcccactagatttgatcaagttcctcatccgttatgctctcagtgggaaggcctgggatcttgttcttgagcaaaggattgctttcacccggaagaaggattttggaaaagaactgcgcgagcttcaatgggcacatgcacagagaacccttcatgggctccaagttccagaccccaaaatatttagcgaaactaccaatttcaatgagcttaaccagttggctgaggaagcgaagaggagagctgaaattgctaggctacgtgagttgcatacactgaaaggtcatgttgaatcagttgtgaagttgaagggtctcgacattgagacaattcagcagtcatacaccgtttaaagggaccccctgaagttgtaagcaaactgttggtgtcgtgatgggagcgaagacatcaaaacgctagtaccgagtttacccattaaacaacatctacataggtagttagattaggggagtaatatttttgaagttgttattttgctgtttcctggagccttcatatcctatagctcctgtacatgttgtagtgacccagaaatggtgaacataaggttatatgctagtacccgttttc

SEQ ID NO: 107656 - protein, 956 aa, Lycopersicon esculentum (tomato)
MAEKPEVLDAVLKETVDLENIPIEEVFENLRCTREGLTATAAQERLSIFGYNKLEEKKESKFLKFLGFMWNPLSWVMEAAAIMAIALANGGGKPPDWQDFVGIITLLIINSTISFIEENNAGNAAAALMARLAPKAKVLRDGKWDEEDASVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKALIEVFAKGIDADTVVLMAARASRIENQDAIDTAIVGMLADPKEARAGIREIHFLPFNPTDKRTALTYLDGEGKMHRVSKGAPEQILNLAHNKSDIERRVHTVIDKFAERGLRSLGVAYQEVPEGRKESAGGPWQFIALLPLFDPPRHDSAETIRRALNLGVNVKMITGDQLAIGKETGRRLGMGTNMYPSSALLGQTKDESIAALPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYKTNFFPRIFGVSTLEKTATDDFRKLASAIYLQVSTISQALIFVTRSRSWSFVERPGLLLVFAFFVAQLVATLIAVYANWSFAAIEGIGWGWAGVIWLYNIVTYIPLDLIKFLIRYALSGKAWDLVLEQRIAFTRKKDFGKELRELQWAHAQRTLHGLQVPDPKIFSETTNFNELNQLAEEAKRRAEIARLRELHTLKGHVESVVKLKGLDIETIQQSYTV

SEQ ID NO: 107657 - DNA, 3369 bp, Ctenocephalides felis (cat flea)
  CDS (122)..(3235)
gacatttcagcattaaattttcaagtgcaacagattaatattataatgcaactattttaagtgcactcgtgacagttcaatatcatcatacctacagatgcaggaggacaaatgtgtggaaatggatgataagcatgggcgttccgattcgtatcgcgtggctacagtacctaccatagatgacaatttgacagcagacggtcaatacaagtcgcgacgtaaaacgccaacgaaaaagcaaaggaaggaaggagagcttgatgacttgaaacaagaattagatatcgattttcacaaagtatcacccgaagaattatatcaacgatttaatactcaccccgaaaatggtcttagtcacgccaaggcgaaagaaaacttagaaagagatggaccgaatgctttgaccccgccgaaacaaacaccagaatgggtcaaattttgcaagaacttgtttggaggattcgccttgttgttgtggatcggtgccattttatgttttgtcgcatactccatccaagctagtactgtggaagaaccagcagatgataatttgtatcttggtattgtattggcggctgtagttatagttactggtatattttcgtattaccaagaatccaagagttccaaaattatggaaagtttcaaaaacatggttccacagtttgcaacagtattacgtgaaggtgaaaaattaaccttacgagcggaagatttagtactcggagatgtcgtagaagtgaaattcggcagcaggatacctgcagatatccgtattattgaaagccgaggattcaaggtagacaagtcttccttgactggtgaatcagaacctcaatctcgaggtcccgagtttacaaatgaaaagcctttagaaacgaagaacttggcgttcttctctatcaacgccgtcgaaggtactgccaaaggtgtcgttatcagctgtggagacaacactgtcatgggtcgtattgccggcttggcttcaggcttggacactggggagactccaatcgctaaagaaattcatcacttcattcatctcatcactggagtcgctgtatttttaggtgtaacattctttgttattgcaattattttgaactaccattggttagacgctgtcatcttcttgattggtatcatcgtcgctaatgtccctgaaggtttattggctactgtaaccgtatgtctaacccttactgctaagcgtatggcatccaagaattgtcttgtcaagaatcttgaagctgtagaaactcttggttctacctcaactatctgctcagacaaaactggcacactgacccagaacagaatgactgtagcccacatgtggtttgacaaccagattattgaagccgacaccactgaagatcaatctggagtcgtatatgacagaaccagccctggtttcaaagctttggcgcgcattgcaactttgtgcaacagagcagaattcaagggaggtcaggaaggtgtacccatcttgaaaaaagaagtcagtggtgatgcatctgaagctgctcttctcaaatgtatggaactggctttaggagatgttatgtctattcgaaaacgaaataagaaagtctgtgaaattccatttaactccacaaacaaataccaggtttccattcacgaaactgaagatgcgtcagacccccgtcatgtaatggttatgaaaggagctcctgaaagaatcttagaaaaatgttccaccatcttcattggaggaaaggaaaaactactggacgaagagatgaaagaagctttcaataatgcatatctggaattgggcggtcttggagagcgtgtattgggcttttgtgatctcatgttgcctacagacaaattccccttaggtttcaaattcgacagcgatgatcccaacttcccaattgaaaaccttagatttgttggactcatgtctatgattgatcctcctagagctgccgtacctgacgctgttgccaagtgccgatctgctggtatcaaggttatcatggttacaggagatcatccaatcactgcaaaagccattgctaaatcagtgggtatcatctcagagggtaatgaaactgtagaagatatcgcgcaaagattgaatattcctgtatcagaggtaaatccacgagaagccaaggcagctgttgtacatggaactgagcttagggaactcaactctgatcagctcgatgaaattcttaggtatcacactgaaattgtatttgctcggacatctcctcaacaaaagctgattattgttgaaggatgccaacgtatgggtgctattgtcgccgtaactggtgatggtgtgaatgactcacctgctttgaaaaaggctgatattggtgttgccatgggtattgccggatctgatgtatcaaaacaggctgctgacatgattttattagatgacaactttgcatctattgtcactggtgtggaagagggtcgtttgatattcgacaatctgaagaaatctattgcttacacattgacttcaaatatcccagaaatttcaccattcttggcattcatcttatgtgatatcccgctacctttgggaactgtaacaatcttgtgcattgacttgggaactgacatggtgcctgccatctcattggcctacgaacatgctgaagctgatatcatgaagaggccgcctagagatccagtcaatgacaaacttgtaaattccagacttatctctatggcttatgggcaaatcggaatgattcaagcagctgctggattctttgtatactttgtaatcatggctgaaaatggattcttacccatgaaattgtttggaattagaaaacaatgggactcgaaagctgtcaatgatctaacagattcttatggacaagaatggacatacagagatcgcaagactcttgaatatacctgccacactgccttcttcgtctctattgtcgttgtacaatgggctgatttgattgtctgcaaaacgcgccgtaattccttgttacaccagggaatgagaaattgggctctcaactttggtctagtttttgaaactgccttagcagcattcctgtcatacacaccaggaatggacaagggactgaggatgttcccactgaagtttgtttggtggctgcctgctctgccattcatgatttccatcttcatctatgatgagactagaagattttacctacgtcgcaaccctggtggttggttagaacaagaaacatattattaagaaaaatgttgcatatagaatatataaaatttttaaattagtctcattgagcagtaatatgatagcaaccaatttaacattgaaatattgttaattgttgttcaatcataccaatttatggttgctaatatttt

SEQ ID NO: 107658 - protein, 1037 aa, Ctenocephalides felis (cat flea)
MDDKHGRSDSYRVATVPTIDDNLTADGQYKSRRKTPTKKQRKEGELDDLKQELDIDFHKVSPEELYQRFNTHPENGLSHAKAKENLERDGPNALTPPKQTPEWVKFCKNLFGGFALLLWIGAILCFVAYSIQASTVEEPADDNLYLGIVLAAVVIVTGIFSYYQESKSSKIMESFKNMVPQFATVLREGEKLTLRAEDLVLGDVVEVKFGSRIPADIRIIESRGFKVDKSSLTGESEPQSRGPEFTNEKPLETKNLAFFSINAVEGTAKGVVISCGDNTVMGRIAGLASGLDTGETPIAKEIHHFIHLITGVAVFLGVTFFVIAIILNYHWLDAVIFLIGIIVANVPEGLLATVTVCLTLTAKRMASKNCLVKNLEAVETLGSTSTICSDKTGTLTQNRMTVAHMWFDNQIIEADTTEDQSGVVYDRTSPGFKALARIATLCNRAEFKGGQEGVPILKKEVSGDASEAALLKCMELALGDVMSIRKRNKKVCEIPFNSTNKYQVSIHETEDASDPRHVMVMKGAPERILEKCSTIFIGGKEKLLDEEMKEAFNNAYLELGGLGERVLGFCDLMLPTDKFPLGFKFDSDDPNFPIENLRFVGLMSMIDPPRAAVPDAVAKCRSAGIKVIMVTGDHPITAKAIAKSVGIISEGNETVEDIAQRLNIPVSEVNPREAKAAVVHGTELRELNSDQLDEILRYHTEIVFARTSPQQKLIIVEGCQRMGAIVAVTGDGVNDSPALKKADIGVAMGIAGSDVSKQAADMILLDDNFASIVTGVEEGRLIFDNLKKSIAYTLTSNIPEISPFLAFILCDIPLPLGTVTILCIDLGTDMVPAISLAYEHAEADIMKRPPRDPVNDKLVNSRLISMAYGQIGMIQAAAGFFVYFVIMAENGFLPMKLFGIRKQWDSKAVNDLTDSYGQEWTYRDRKTLEYTCHTAFFVSIVVVQWADLIVCKTRRNSLLHQGMRNWALNFGLVFETALAAFLSYTPGMDKGLRMFPLKFVWWLPALPFMISIFIYDETRRFYLRRNPGGWLEQETYY

SEQ ID NO: 107659 - DNA, 2418 bp, Methanococcus jannaschii
  CDS (1)..(2418)
atgtggggggttgttatgaatgttgaggaaattgaagaagaatataaaacttctataaaaactggattatcaactgaagaagctaagaagagattaaaaatctatggatataatgaaatcccagaaaaaaaggttcatccaattattaaatttctctcttacttctggaatcctattgcttggatgattgaaattgccgctattttatctgcaataatcaaacactgggtggattttgttataatcttaatactactgttggttaatggtgttgttggtttttgggaagaatataaggcagaaaatgtcatagagtttttaaagcagaagatggctttaaatgcaagggttttgagagatggaaaatggcaaataattccagcaaaagaattagtccctggagatgttgttagaattaggattggagatatcgttccagctgatataatattggttgatggagattatttagttgtagatgaatctgccttaactggagagagtttgccagtagagaagaagattggagatattgcttattctggctctattgttaaaaaaggagagatgactggaatagttaaagctaccgggctaaatacttactttggaaagaccgttaagttagttgaaaaagcagaaaaagttagctcttatcaaaagatgattatcaagataggagactatttgatagttttagcagtaattttaatagcaataatggttgccgttgaattgtttagaggaaagagtttaatagaaacagcccaatttgctttagtgttagctgtttcagcaattccagcggctatgccagctgtgttatcaataactatggctattggagcattaaatttagcaaagaaggatgctattgttaagaaacttgtagctattgaagaacttgcaggagttgatattctctgctcagataaaactgggactttaacaaagaatcagcttgtgtgtggggaaattatagctttaaatggatttagtaaagaggatgttgttttatttgccgctcttgcttcaagggaagaggatgctgatgcaatagatatggcaattttaaatgaggctaagaaattaggattgatggaaaaaataaaaaactacaaaataaagaagttcattccatttgacccagttattaagaggacagaggcagaggtaactaacgatgaggagtttaaagtctcaaaaggagctcctcaggttatattagatttatgcaatgcagatgaagagttaaggagaaaggttgaggaaattgttgataagcttgctgaaaatggttatagggctttaggggtagctgtttataaaaatgggagatggcactttgctggaataatcccattgtatgaccctccaagagaagatgctcctttggcagttaagaagattaaagagcttggagttataataaagatggttactggagaccatgtagctatagctaagaatatagcacgaatgttgggcattggagacaagataatatcaattagtgagctattgaaaaaactaaaaagaggagagattaaagaagaaaaatttgatgagattgttgaagaagcagatggatttgctgaggtattcccagagcataaatataagattgttgattcactgcagaagagagggcatcttgttgccatgactggggatggagttaatgatgctcctgccttaaaaaaggctgactgtgggattgctgtttcaaatgcaactgatgctgcaagagccgctgctgatatagttttattatctcctggaatatctgttattgttgatgcaatccaagaggcaagaaggatatttcaaagaatggaaagctatgttatttatagaattactgagacaataaggattttattctttgttgagttatgcatattgattttgggcatttatccaataactgcattgatgattgtgctcttagctatattgaatgacatccctatattggcaatcgcctatgataacgttgttgagccaaaatctccagttagatggaggatgagagagattttaatgctctcaactgctttaggactgagtggagttgttagctccttcctgatattctatatatctgatgtattcttacatctaacaattgcagagttgcagagctttgtatttttaaagttgatattggctggacatgcaaccatattcgttacaagaattagagataggttgtggaaaaagccatatccaagtaagttgctgttctggggagttatgggaacaaatattattggaacaattgtagctgctgaaggaatattcatggctccaattggttgggatttggctttgtttatgtggctctatgcccatgtttggatgttaattaacgatgagattaaaatgattttgctaaaaagactaaaaattgattag

SEQ ID NO: 107660 - protein, 805 aa, Methanococcus jannaschii
MWGVVMNVEEIEEEYKTSIKTGLSTEEAKKRLKIYGYNEIPEKKVHPIIKFLSYFWNPIAWMIEIAAILSAIIKHWVDFVIILILLLVNGVVGFWEEYKAENVIEFLKQKMALNARVLRDGKWQIIPAKELVPGDVVRIRIGDIVPADIILVDGDYLVVDESALTGESLPVEKKIGDIAYSGSIVKKGEMTGIVKATGLNTYFGKTVKLVEKAEKVSSYQKMIIKIGDYLIVLAVILIAIMVAVELFRGKSLIETAQFALVLAVSAIPAAMPAVLSITMAIGALNLAKKDAIVKKLVAIEELAGVDILCSDKTGTLTKNQLVCGEIIALNGFSKEDVVLFAALASREEDADAIDMAILNEAKKLGLMEKIKNYKIKKFIPFDPVIKRTEAEVTNDEEFKVSKGAPQVILDLCNADEELRRKVEEIVDKLAENGYRALGVAVYKNGRWHFAGIIPLYDPPREDAPLAVKKIKELGVIIKMVTGDHVAIAKNIARMLGIGDKIISISELLKKLKRGEIKEEKFDEIVEEADGFAEVFPEHKYKIVDSLQKRGHLVAMTGDGVNDAPALKKADCGIAVSNATDAARAAADIVLLSPGISVIVDAIQEARRIFQRMESYVIYRITETIRILFFVELCILILGIYPITALMIVLLAILNDIPILAIAYDNVVEPKSPVRWRMREILMLSTALGLSGVVSSFLIFYISDVFLHLTIAELQSFVFLKLILAGHATIFVTRIRDRLWKKPYPSKLLFWGVMGTNIIGTIVAAEGIFMAPIGWDLALFMWLYAHVWMLINDEIKMILLKRLKID

SEQ ID NO: 107661 - DNA, 2733 bp, Lactococcus lactis subsp. lactis
  CDS (1)..(2733)
atgaaaaaaattagaaaaacactcgaaaacacaaaaagagctacaacatttgtagataacaatgaaataaatgcaagattagaatttgcaaaaacttctacaaaagaggagctatttcaaaaatttaaaacatcaaataaaggattaagtgaagaacaagtagaaatctctcgtgaacaatatggagataatacgattacgcgtggtaaaaaaacttcacttattaaacggctttatcaagcgttcatcaatccttttaccattatattgtttgtcttagcattagtttcagcttttacggatattatcttagcagctcctggtgagaaaaatccccaaggactcattatcattactacaatggttttaatctcaggaattctgcgtttcgttcaagagactagaagtggaaatgctgctgagaatctcttaaaaatgattacgacgacgacaaacgttcatagattagaatcaggaagtcaagagattcctattgaagaagttctcgtaggcgatattatccatctatcagctggagacatggttccagcagaccttaggattattcaagcaaaagacttatttatcagccaagcctctttaactggtgaaagcgaaccagtagaaaaactagatttagctactgatgaaaaagatgattcaatcacagagtcagtaaacctagccttcatgggttcaaatgtcatttctggtagtgcttatggagttgtaattgcaactggagatgcgaccatttttggtgaaatggcaaaaagtgtaaccgaagactcaactaaaacaacttttgaaaaaggcgttaactcagtttcatgggtccttattcgctttatgttagttatggttccatttgtcttattgatcaatggtttcactaaaggtgattggatggaagctgcactatttgctttagcagttgctgttggtttaacaccagaaatgttaccaatgattgtgacaacttgcctagcaaaaggtgcagtcacaatgtcaaaagaaaaaacaatcatcaagaacctaaattctattcaaaatctaggttcaatgaatattctctgcactgataaaactggaacattaacacaagataaagtagtattaatgcgtcatttagatattcatgggcaagaaaatattcgagtattaagacatggatttttgaatagttactaccaaactggtttaaagaatttaatggatttggcaattattgaaggagccgaagccaagcaagataaaaatcctgaactgggtggtctaagtagtaaatatacaaaagttgatgaaattccttttgattttgaaagacgtcggatgagtgttgtagtaaaaagcaatactaatggagcgacttcaaaaacgcaaatgattactaaaggtgcagctgaagaaatgttagacatctgtactttagtcgaagataagggaaatgttgttcatttaactcctgaactcagagcatacattctgaaaaaagttgatgaacttaacgaagaaggaatgcgcgtgattttagtcgctcaaaaaacaaatccttcaccaatagatacattctcggttcaagatgaatctgaaatggtgttaatgggttatcttgcctttcttgatccacccaaagaatctacagcaaaagcaatcaaagcactcaataaatatggggtatcagttaaaatcttgactggtgataacgataaagttactcgttcagtttgcaaacaagtaggacttccagttgataaaactattttaggttctgatatcgaccaattagatgataatgaattggcaaaggttgccaaggaagcttctgtttttgctaagttatcacctcaacaaaaagccagaatagtaacaacacttagaaattcaggcaatagtgtcggctatatgggagatggtattaatgacgcagcagcaatgaaatcatctgacgttggaatttcagtagatagtgctgtagatattgccaaagagtcagctgatgtaattttgttagaaaaagatttaatggttcttgaaaaaggaattattgaaggaagaaaaacctatgctaacatgattaagtatataaaaatgacagcaagttctaactttggtaatatgttctcagttctaatcgctagtgcatttttaccatttattccaatgttatctattcatattctcttacttaatttaatctatgatttctcttgtaccgctattccttgggataatgtcgatgaagaatatttggttgttccaagaaaatgggatgcaagttctgtaagtaaattcatgttgtggattggcccaacaagttccgtattcgatattacaacttatctcctaatgttctttgtgatttgtccagcaacatttggaccatttagctctcttgttcctggaagtgtagcatatattggatttatcgcgctcttccatactggttggtttgttgaatcaatgtggactcaaaccttggttatccatatgattcgtactcctaaaatcccatttttacaaagtcgtgcttcggctccactaacaatcttaactttcatgggaatcattggactcacaatcattccattcacaagctttggacattcaattggtttaatggctttaccaattaactttttcccatggctaattttaacagtagtgatgtatatgatgcttgtcaccatatttaaaaaaatatttgtttcaaaatacggtgaattactttaa

SEQ ID NO: 107662 - protein, 910 aa, Lactococcus lactis subsp. lactis
MKKIRKTLENTKRATTFVDNNEINARLEFAKTSTKEELFQKFKTSNKGLSEEQVEISREQYGDNTITRGKKTSLIKRLYQAFINPFTIILFVLALVSAFTDIILAAPGEKNPQGLIIITTMVLISGILRFVQETRSGNAAENLLKMITTTTNVHRLESGSQEIPIEEVLVGDIIHLSAGDMVPADLRIIQAKDLFISQASLTGESEPVEKLDLATDEKDDSITESVNLAFMGSNVISGSAYGVVIATGDATIFGEMAKSVTEDSTKTTFEKGVNSVSWVLIRFMLVMVPFVLLINGFTKGDWMEAALFALAVAVGLTPEMLPMIVTTCLAKGAVTMSKEKTIIKNLNSIQNLGSMNILCTDKTGTLTQDKVVLMRHLDIHGQENIRVLRHGFLNSYYQTGLKNLMDLAIIEGAEAKQDKNPELGGLSSKYTKVDEIPFDFERRRMSVVVKSNTNGATSKTQMITKGAAEEMLDICTLVEDKGNVVHLTPELRAYILKKVDELNEEGMRVILVAQKTNPSPIDTFSVQDESEMVLMGYLAFLDPPKESTAKAIKALNKYGVSVKILTGDNDKVTRSVCKQVGLPVDKTILGSDIDQLDDNELAKVAKEASVFAKLSPQQKARIVTTLRNSGNSVGYMGDGINDAAAMKSSDVGISVDSAVDIAKESADVILLEKDLMVLEKGIIEGRKTYANMIKYIKMTASSNFGNMFSVLIASAFLPFIPMLSIHILLLNLIYDFSCTAIPWDNVDEEYLVVPRKWDASSVSKFMLWIGPTSSVFDITTYLLMFFVICPATFGPFSSLVPGSVAYIGFIALFHTGWFVESMWTQTLVIHMIRTPKIPFLQSRASAPLTILTFMGIIGLTIIPFTSFGHSIGLMALPINFFPWLILTVVMYMMLVTIFKKIFVSKYGELL

SEQ ID NO: 107663 - DNA, 2736 bp, Nostoc sp. PCC 7120
  CDS (1)..(2736)
atgacagcaaaagttgaagaaattatccaatcacatcaatggcacaatttatctgcatcaaaagtggctcaatatttagatgcaaatctagatacaggtttgacatcaaatcagatagcaaaacggcaggaaagctttggtgcgaatgaactcaagggtaaaaagggaactagcccgatagtcagatttcttctacaattcaatcagccgttgctgtacattttgctgattgcaggtgcaatcaaagccttaattgggcagtgggtaaatgcttgggtgatttggggtgtcaccttaattaatgccattattggttttgtgcaagaatcaaaagctgaaagtgcgatcgcagctttagcttcttcagtccaaactaatgcaactatcctacgcaacggtcaaaaggtacaagttccttcacaagaattagtccctggcgatttagtactactgacctctggtgataaagtacccgccgatttgcgtttgattcagtcccgcaatctccaagtgaatgaatctgccctcactggtgagtcggttgctattgagaaaaataccgaacctgtggacgcgaatgcagttttagcagaacgcagcaacatggcttatgctggcagttttgtgacctttggcactggtaaggggattgttgtagccattggggaagctacggaaaccgggcggatatcccaactgatggagcagggtacaagccttaagactcccctaacacggaaatttgataaatttagccgcacattactatacataattttgggcatcgctgccctgacgtttgccgttggactgggatacggtaattcctgggcaagtatgtttgaagcggcggtggcttttgctgtcagtgccattcctgaaggattacctgccgtagtgacggtaacattggcaataggtgtttcacggatggcgaagcgacacgcgattgtgaggaaattaccagccgtggaaaccctcggtggcgctacagtcatctgctcggataaaacgggtacactcacagaaaaccagatgactgtacaggtgatttatactgacggtcaatactatacagttacagggacaggttatattcccgaaggtgaaatcttacgcgatgaacagccagtagattggcgtagttctcccgtattggcagaatgtctgcaagccggattgttatgtaatgattcccacttagagcagaaggaaggagaatggcaagttatcggtgatcctactgaaggagcgttgatagttgtggcgaataaagtggggctgactagcaataacttagaatcagaaatgcccaggctagatgtcatcccctttgagtctgagtttcaatacatggcaactttgcatgaagggggaagtggagaaaattctgcaagagtcaggactatctatgtaaagggttccgttgaggctattgtgcaacgttgtcagcagatgttaactggaggtaatcttgtttctgtggatgcccagactttacatcaagaagttgagacaatggctcatcagggtttgcgggtgttggcgtttgcacggaaaactgtatcggttagtcaagattccctggatcatgcagatatcgacaatgatttggttttcttgggactacaaggaatgatcgatcccccacgagcagaagcgatcgccgccgtagctgcttgtcaaaatgcggggattcaagtcaaaatgatcacaggcgaccacgctgccacagcacaagcgatcgctcaaaggatgggctttaatcaaaatggggaagttctcgcctttactggcgcgcaactagcccaaatgtcacaaacacaactggctactgccatagaagatggggctgtatttgcccgtgttgccccagaacagaaactccgccttgtagaagccttgcaatcaaaaggcgaggttgtagcgatgacgggggatggtgtcaatgatgcaccagccttgagacaagcagatattggcattgcaatggggggtgcgggtacagaagtagccaaagaagccgccgacatgattttgactgatgataactttgcttccatagaagcggcagtggaggaaggacggactgtttaccgcaacttattaaaagcgatcgccttcattttacctgtgaatggcggcgaatccatgacgattttaattagtgttttacttgccagagaattaccaattttatctttacaagtcctctggttaaatatggttaattccattgctatgactgtacccttggcttttgaaccaagttctcaacgggttatgcagttaccaccccgtagccctcgtgagccattactctccaaaagtttagtcaagcgcatcttcgcaatttctatctttaactggatattaatatttggtgtatttgaatggattaaacaatctacaggcaatattgatttagccagaacaatggcaattcaggcgttagtatctggaagatttttttatcttttaagtattagtcagttaggaattgctgccattaatttcctgcgaggagttaggcagaaacttagcgatatatcagccatagctatcggcattgtaactacaatcattttgcagataattttcagtcaatggagcttgatgaatcagttatttgctactgcaccattgaatttaactcaatggttaacttgcctacttgtaggtttaccaatgattcccgtagcacttatagtcaataagttcgacccccttgactga

SEQ ID NO: 107664 - protein, 911 aa, Nostoc sp. PCC 7120
MTAKVEEIIQSHQWHNLSASKVAQYLDANLDTGLTSNQIAKRQESFGANELKGKKGTSPIVRFLLQFNQPLLYILLIAGAIKALIGQWVNAWVIWGVTLINAIIGFVQESKAESAIAALASSVQTNATILRNGQKVQVPSQELVPGDLVLLTSGDKVPADLRLIQSRNLQVNESALTGESVAIEKNTEPVDANAVLAERSNMAYAGSFVTFGTGKGIVVAIGEATETGRISQLMEQGTSLKTPLTRKFDKFSRTLLYIILGIAALTFAVGLGYGNSWASMFEAAVAFAVSAIPEGLPAVVTVTLAIGVSRMAKRHAIVRKLPAVETLGGATVICSDKTGTLTENQMTVQVIYTDGQYYTVTGTGYIPEGEILRDEQPVDWRSSPVLAECLQAGLLCNDSHLEQKEGEWQVIGDPTEGALIVVANKVGLTSNNLESEMPRLDVIPFESEFQYMATLHEGGSGENSARVRTIYVKGSVEAIVQRCQQMLTGGNLVSVDAQTLHQEVETMAHQGLRVLAFARKTVSVSQDSLDHADIDNDLVFLGLQGMIDPPRAEAIAAVAACQNAGIQVKMITGDHAATAQAIAQRMGFNQNGEVLAFTGAQLAQMSQTQLATAIEDGAVFARVAPEQKLRLVEALQSKGEVVAMTGDGVNDAPALRQADIGIAMGGAGTEVAKEAADMILTDDNFASIEAAVEEGRTVYRNLLKAIAFILPVNGGESMTILISVLLARELPILSLQVLWLNMVNSIAMTVPLAFEPSSQRVMQLPPRSPREPLLSKSLVKRIFAISIFNWILIFGVFEWIKQSTGNIDLARTMAIQALVSGRFFYLLSISQLGIAAINFLRGVRQKLSDISAIAIGIVTTIILQIIFSQWSLMNQLFATAPLNLTQWLTCLLVGLPMIPVALIVNKFDPLD

SEQ ID NO: 107665 - DNA, 2571 bp, Listeria innocua
  CDS (1)..(2571)
atgaaaaaaacacacgtaaaaatgcaaggtaacaatttgctcaaagaatcacaaatggatagaaataagattttagaaaaattaggtgtaatggaaacagggctaacgaacgtagaggttacagaaagactagccgaatttggtcctaatcaaacagtggaagaaaagaaagtatcgaatttacggttatttattcgggcgtttaatgatccttttatctatattttaatcatgttaatggtgatttcgtatttaacagatgatatggaagcgacaataattatgtcattaatgatcttagctagtggaattcttggatttgttcaaacgagtagagcagagcgggctagctacgcgttaaaaaatatggtgaaaaataaagtgaacgttattcggaacgatgaaatgattgtagtagcacaagatgaaatcgtacccggagatttaatcgaagtttcagcgggggatattattccagcagatgcacgcgttatttcggcgacagatttattaattaatcagtcagcacttacaggcgaatcaattccttctgaaaaatttgtggaagacaaacgcgccaatccggagctttttgaacgggaaaacttattatttatggggacagatgtgttaagtgggcacggtaaggcggttgttttacgaacaggaagcgcaacatttttcggctcattgtcaatcgcagctacagaacgtcgcggcgacactagctttgataaaggcgttaagtcaatttcgaaattactcttttattttatggttgtaatggttccgattgtatttatgattaacggtcttatgaaaggcgagtggttagaagcatttctttatgcggtagcgattgcggttgggctcacacctgagatgctaccgatgatcgtcagcacgaacttggcaaaaggcgctatcaatatgtcgtcgaaaaaagtaattatgaaagagctgagtgcaattcaaaatatcggcgcgatggatattttatgtacggataaaacaggcacgctcacagaagataaactagaacttgtaaaatacattgatagtgctggtgaaacttccgaaagtgttctaaatatggcttatttaaacagctacttccaaacgggctggaaaaacgttttagatcatgctgttattgccaaattggatgaaagtactgcatcaggatggacaaaagttggcgaaattccgtttaattttgatcggcgtcgtctgagtgtggtagtggaaaataatacagagacaaagatgattacaaaaggcgcggtagaagaaatgctcacagtatgcactcataaggaatttggcggcactatttctacactaactgaattagaaaagaatgagcttcaagaaatgtgtgcagaaatgaatcgctcaggaattcgagtaattgcagtagcgtataaaactggaaaagccggcgaatcattcactaaaaaagatgaagaacagatgattattgcaggattcttaggtttccgcgacccagtaaaagcatcgacgaaagaagcaattacacagctatttaagaaccaaattaacgtgaaggttttgacaggagataacgaaatcgttacgaaacggatttgtgaggaagtaggcataccagcgaatggatttttacttggcggggatattgaagacttatctgatgaagaactcacgcgcgaattacggaaataccacatttttgcgaaattaaccccaatgcaaaaatcgcgtatcattggtttgctgaaaaaagcaggacatactgttggcttccttggagacgggattaatgacgcaccagcacttaggaaagcggatgttggtatttctgttgatacagcggcagatataacaaaagacgcaagctcggtaattttactggaaaaaagtttaacggtattaaatgatgcggttatggaagggcgtaacgtatttggtaatattttaaaatacttgaaaatgacagctagttccaattttggtaatgtgtttagtgttttggtggcaagtgcatttattccctttttaccaatgctatctttacatcttttgctacaaaacttgctgtatgatttctcacaattaactctcccttgggataaaatggatcggtcgtttttgaaaaagccgcatcaatgggaacaaaaaggcatgttgcgctttattctatgtattgggccagtaagttcgatttttgatattgcgacgtttctaattatgtggtttgtatttagtgcgaacacggtagcagagcaagctttattccatagtggttggtttgttgtcggcttactcactcaaactttagttgtgcatatgattcggacagagaaaataccttttattcaaagtcgggcagctgctccggtaatgattgcgacactaatcgtgatggcattaggtattgtgattccgtttaccggatttggtcacagtatcggttttgtaagcttaccaggtagttatttcccatggttaatccttattcttgttggttatatggctacgatgcaactagtgaaaactctttacattcggaaattccgggagtggatttaa

SEQ ID NO: 107666 - protein, 856 aa, Listeria innocua
MKKTHVKMQGNNLLKESQMDRNKILEKLGVMETGLTNVEVTERLAEFGPNQTVEEKKVSNLRLFIRAFNDPFIYILIMLMVISYLTDDMEATIIMSLMILASGILGFVQTSRAERASYALKNMVKNKVNVIRNDEMIVVAQDEIVPGDLIEVSAGDIIPADARVISATDLLINQSALTGESIPSEKFVEDKRANPELFERENLLFMGTDVLSGHGKAVVLRTGSATFFGSLSIAATERRGDTSFDKGVKSISKLLFYFMVVMVPIVFMINGLMKGEWLEAFLYAVAIAVGLTPEMLPMIVSTNLAKGAINMSSKKVIMKELSAIQNIGAMDILCTDKTGTLTEDKLELVKYIDSAGETSESVLNMAYLNSYFQTGWKNVLDHAVIAKLDESTASGWTKVGEIPFNFDRRRLSVVVENNTETKMITKGAVEEMLTVCTHKEFGGTISTLTELEKNELQEMCAEMNRSGIRVIAVAYKTGKAGESFTKKDEEQMIIAGFLGFRDPVKASTKEAITQLFKNQINVKVLTGDNEIVTKRICEEVGIPANGFLLGGDIEDLSDEELTRELRKYHIFAKLTPMQKSRIIGLLKKAGHTVGFLGDGINDAPALRKADVGISVDTAADITKDASSVILLEKSLTVLNDAVMEGRNVFGNILKYLKMTASSNFGNVFSVLVASAFIPFLPMLSLHLLLQNLLYDFSQLTLPWDKMDRSFLKKPHQWEQKGMLRFILCIGPVSSIFDIATFLIMWFVFSANTVAEQALFHSGWFVVGLLTQTLVVHMIRTEKIPFIQSRAAAPVMIATLIVMALGIVIPFTGFGHSIGFVSLPGSYFPWLILILVGYMATMQLVKTLYIRKFREWI

SEQ ID NO: 107667 - DNA, 2988 bp, Nostoc sp. PCC 7120
  CDS (1)..(2988)
atgattcaagcaatacatactggggtcaaagggagagcgagatataaggtaaaagaactttatcattcactgtctctcaaggaatatttggagcgatcgcttgtcaatcaaccagaaataattaatgtttctgctaatatctccacaggtaatgtgcttgtattgttttcgccaaaatataattacaagcagattgccaatttaattgatcaagttatattaaattaccggaaaattcatcagcaagttcagccatttaaatctaacaaaattattaagaaatccaaacaaataagtggtgttaaacagcaaagaagtgagaattggcatcttatgccagccagcacggttgtggataccttcaacacctctgcatcagggttatccagtgagtctgccgccgctaatttgagtatatatggggcgaatatcctttcggaaacggagatacgttctagtttcagcatcttagttgaccagttcaagtctttacctgtagctttgctgggtgtggcggctggtgtatcggtttttactggagggttgattgatgctgtagttattttaggtgtggttggtgtaaatgctgtgattggctacgctacagaaactcagtcagaacgcatcatccactctctcaagcaccaagaacaaacgtcagcttgggtgatgcgagatggcaaggcgcaagaaattcctgtagaaaatgtagttgtgggcgatgttttaattctcaaaccaggtagctatgtagcggcagatgccagactgattgaggcggataatttaagtattgatgaatcggctttaactggtgaaagtctccctgccagtaaaaatacggcatttttgacaggtgaggatgtaccattaggcgatcgcctaaatatgatttacaggggaacttatatcaccggtggtcaaggattggcggcggttgtagccactggacaatttacggaaatgggacacatccaaactctggtaggtacagccaatgcgacagaaacacccctggccagacaactagaccaggtgggtagccaattggtagtcattgggatgggtctttgtggtctggtgtttggtatgggagtgctgcggggatatggtttagtgcagatgttgaaatcatccatatctttggctgtagcggctgttcctgaaggtttaccgacaattgccaccacaaccttagccttgggtatccgtgatatgcggcgaaacaaagtccttgtccgtagtttgagtgcggtggaggctttgggttctgtgcagacaatttgcctggataaaaccgggacaattacggaaaataaaatgtcggtggtagaaattcacaccaacacgcgggaaattaaagttacagatggggagttcatcgccgggggagaaaatattaacccctatatgtacgatgaactgttaaagctgattcatgtctcggttctctgcaatgaaagtgaagtgagtcgagacgatggtgagtatgtagtcacaggttcagcgacagaaaacgccttaatttacatgggaattgcggcgggggtagatgcgatcgccctaaaagataagtatcctttactacaaacgaatctgcgatcggaaaaccgcaatattatgagtaccatccacgagactcataatggacataaatttgtcgctgttaaaggtagtcccggcgaagtggtgcagatgtgccaagggtggatgaaggatgggcaggtagtgcctttaaccgatgcagaccgacaaatgctggaaatagaaaatgaccgtatggcgggtaaagctttgcgggtgttgggtgtagcctacaaccatatagatgaatcccacaacggcaaccatgaaacagacctgatttggttgggtttagtagggatggcagacccaattagaaggggtgcaaaagcattaattgccgacttccatcacgccggcattgataccgtcatgataaccggtgatcaaagcccaacagcttatgcgatcgctaaagaattagaattgaaccgtcatacccaacttgaaattctcgactccaccaacctcaacaacctcaccccagaagccttaaccgccctcagcgacaaagtagatgtatttgcccgtatcagtcccagtaataaactgcaagtagtccaagctttgcaaggtgcaggtaaagtcgtcgccatgaccggtgatggcattaacgatgcccccgccttaaaagctgcccaagttggggtggcaatgggtaaagggggaaccgatgtcgcccgtgaggtagcagatatcgtcctggaagacgacagactggaaaccatgattatcgctgtcagtcggggacgaacgatatacaacaacatccgtaaatctgtgcatttcctcctagcgaccaacctcagcgaaatcatggtcatgaccaccgccaccgccgtaggtattggcgaacccttgaatgcaattcaattactttggttgaatttagttacagatatcttccctggtttatccttagcgatggaagcgccagaaccagaggtattaagtcaaccaccccgcaacccaacagaaccaattatcaaaaaatccgattttggcagaatcacttttgagtccgccaccatatctgcaagtaccctagccgcatacagttacggcatcctcaaatatggtatcagtccccaagccagcaccattgctttcatgggtctaaccacagcccaactactacacacaattagtagccgttccgaaaaacacagcatatttagttccgaaaaactcccacataatccttacctaactgcggcggtcactggttcttttgccctgcaactactcgctgtagctgtcccacccctaagaactttattaaagattacccccattaatctggttgatggtgcggtaattggtggtagtgccttactacctctgattgtgaatgaagcaaccaaaaatactggcgcaagcaagatgatattccccagtccctaa

SEQ ID NO: 107668 - protein, 995 aa, Nostoc sp. PCC 7120
MIQAIHTGVKGRARYKVKELYHSLSLKEYLERSLVNQPEIINVSANISTGNVLVLFSPKYNYKQIANLIDQVILNYRKIHQQVQPFKSNKIIKKSKQISGVKQQRSENWHLMPASTVVDTFNTSASGLSSESAAANLSIYGANILSETEIRSSFSILVDQFKSLPVALLGVAAGVSVFTGGLIDAVVILGVVGVNAVIGYATETQSERIIHSLKHQEQTSAWVMRDGKAQEIPVENVVVGDVLILKPGSYVAADARLIEADNLSIDESALTGESLPASKNTAFLTGEDVPLGDRLNMIYRGTYITGGQGLAAVVATGQFTEMGHIQTLVGTANATETPLARQLDQVGSQLVVIGMGLCGLVFGMGVLRGYGLVQMLKSSISLAVAAVPEGLPTIATTTLALGIRDMRRNKVLVRSLSAVEALGSVQTICLDKTGTITENKMSVVEIHTNTREIKVTDGEFIAGGENINPYMYDELLKLIHVSVLCNESEVSRDDGEYVVTGSATENALIYMGIAAGVDAIALKDKYPLLQTNLRSENRNIMSTIHETHNGHKFVAVKGSPGEVVQMCQGWMKDGQVVPLTDADRQMLEIENDRMAGKALRVLGVAYNHIDESHNGNHETDLIWLGLVGMADPIRRGAKALIADFHHAGIDTVMITGDQSPTAYAIAKELELNRHTQLEILDSTNLNNLTPEALTALSDKVDVFARISPSNKLQVVQALQGAGKVVAMTGDGINDAPALKAAQVGVAMGKGGTDVAREVADIVLEDDRLETMIIAVSRGRTIYNNIRKSVHFLLATNLSEIMVMTTATAVGIGEPLNAIQLLWLNLVTDIFPGLSLAMEAPEPEVLSQPPRNPTEPIIKKSDFGRITFESATISASTLAAYSYGILKYGISPQASTIAFMGLTTAQLLHTISSRSEKHSIFSSEKLPHNPYLTAAVTGSFALQLLAVAVPPLRTLLKITPINLVDGAVIGGSALLPLIVNEATKNTGASKMIFPSP

SEQ ID NO: 107669 - DNA, 2787 bp, Brucella melitensis
  CDS (1)..(2787)
atgcggcctcacgccagaggctggataacgcgatgtcgctgccgcttcagatgtggcaggagatcgaaaatgaatgtcgccgtcagaacagcgaacaacaagaatttcaaaaaggatgaacgccgcctgtctatgcgcgccgtgcgtgaggcatccaatgagatcgagcttacccttgccaatgtcggaagcaggcgcgacggcctgaccgagggcgacgcaattacccggctctatcgcgacggcccgaatgaggtcgctcgcgagcgtcgtatcccggctctcgtgcagtttgcgcttgccttcaagaatcccttcatcatggtcctggtcgtgctgggcgcgatcagtgccttcactgatatatggcttccgctcgaaacgggcgaggaggccgatccgaccaaggtgatcatcattgccgtgatggtgcttgcaagcgcgctcatgcgcttcattcaggagtataggtccggccgtgccgccgaggccctcaaggcaatggtgcgcacgacggctacggtatggcggcgcgtgagtgcgggaaccagctccgcgccgcgcgaaattccgatgcgcgagctggtcgtgggcgatattgtgcagctttctgccggggatatgatccccgccgaccttcgccttattgaatcgcgtgatctgtttatcagtcaggcagtgctcactggcgaagcacttcccgtcgaaaaatatgacacgctcggcgccatttcagagaaatcggccatggcaacagcctcccaggatgcggatatgctcgacctgcccagcatctgctttatgggtaccaatgtcgtcagcggcaccgccaccgccgttgtggtcgccaccggtcaacgcacttacttcgggtcgctcgccaaggcgattgtcggctcgcgcgcccaaacatccttcgaccgcggcattaacagcgttagctggctgctgatccgcttcatgctgatcatggtgccggtggtcttcctcatcaacggcttcaccaaaggcaactgggtggaagccatgcttttcggccttgcggtcgccgttgggcttaccccggaaatgctgccgatgatcgtttcctcgaacctcgccaagggcgctgttgcgatggcgcgccgcaaggtcgttgtgaagcgtctcaatgcgatccagaatttcggcgccatggacgtgctctgcacggacaagaccggcacgttgacacaggacaagattatcctggaacatcatatcgacgtttcgggcaaggcggacgacaaggtcctgcgtctggcatggctgaacagctatcatcagagcggcgtcaagaacctgatggatcaggccgtggttagcttcgccaatcgtgtgcccgaggaggtgatgcgtaccgcccggctctatcgcaaggtcgatgagcttcccttcgatttcattcgccgccggctctcggtggtcgtcgagggggtggggggcgaacatctgctcgtttgcaaaggcgcggtcgaggagatgctggcgatctgcaccacggtccgggacggggagacggtcagggctctcgacgcggtgacgcgcgagaagctcatcgccacggcgtgtgcctataatgccgacgggttccgcgtcctcgtggtcgctacccgcgaaattccgggcgctgagaccagtgcgcagtacaggatcgccgatgaagcgggcctgaccgtccagggtttcctgacctttctcgatccaccaaaggagacggcggggccagccattgccgctctggccgagcacggtgtttgtgtgaaagtcctcaccggcgataacgagatcgtcacgagaaagatttgccgcgaggtcggcctggaggctggcattcccattctgggaagcgagatcgagaaactcgatgatgaggcactgcgtgtcgttgccgaggagcgcaccgtcttcgccaagctgacgccgcttcagaaatccagggtgcttcaggccttgcaggccaatggccatacggtcggcttcctcggtgacggcatcaacgatgcgccagcactgcgcgatgccgatgttggtatctccgttgacagcggcgccgatatcgcgaaggaatcggcagatatcatcctgcttgaaaagagcctgatcgtgcttgaggaaggggtggtcacgggccgcgagaccttcgggaatatcctgaaatacctcaacatgtgcgcaagctcgaactttgggaatgtcttctccgttctggtggcaagcgcattcatcccgttccttccgatgctcgccattcacctcctgatccagaacctgatgtacgatatctcccagcttgcgctgccgtgggacaagatggacaaggagtttctggccaagccccgcaaatgggatgccagaaacatcgggcgcttcatgatctggatcgggccgacctcgtcgatcttcgacatcaccacctttgcgctgatgtggtatgtgttttcggccaattcgccgcaaatgcagtctctgttccagtcgggctggtttatcgaaggcctcctctcgcaaacgctcgtcgtgcacatgctgcgcacccagaagattccgttcttccagagcacggctgccctgcccgtcatgctgatgtccgcgctcatcatcgctctgggcatctacattccgttttctccaatcggggaaatggtcggactcgtaccgctgccatgggcgtatttcccgtggctggccgcaaccctcgtcagctactgcctcgtcgcacaaggcatgaaggtcatctatgtgcgccgtttcgggcagtggttctga

SEQ ID NO: 107670 - protein, 928 aa, Brucella melitensis
MRPHARGWITRCRCRFRCGRRSKMNVAVRTANNKNFKKDERRLSMRAVREASNEIELTLANVGSRRDGLTEGDAITRLYRDGPNEVARERRIPALVQFALAFKNPFIMVLVVLGAISAFTDIWLPLETGEEADPTKVIIIAVMVLASALMRFIQEYRSGRAAEALKAMVRTTATVWRRVSAGTSSAPREIPMRELVVGDIVQLSAGDMIPADLRLIESRDLFISQAVLTGEALPVEKYDTLGAISEKSAMATASQDADMLDLPSICFMGTNVVSGTATAVVVATGQRTYFGSLAKAIVGSRAQTSFDRGINSVSWLLIRFMLIMVPVVFLINGFTKGNWVEAMLFGLAVAVGLTPEMLPMIVSSNLAKGAVAMARRKVVVKRLNAIQNFGAMDVLCTDKTGTLTQDKIILEHHIDVSGKADDKVLRLAWLNSYHQSGVKNLMDQAVVSFANRVPEEVMRTARLYRKVDELPFDFIRRRLSVVVEGVGGEHLLVCKGAVEEMLAICTTVRDGETVRALDAVTREKLIATACAYNADGFRVLVVATREIPGAETSAQYRIADEAGLTVQGFLTFLDPPKETAGPAIAALAEHGVCVKVLTGDNEIVTRKICREVGLEAGIPILGSEIEKLDDEALRVVAEERTVFAKLTPLQKSRVLQALQANGHTVGFLGDGINDAPALRDADVGISVDSGADIAKESADIILLEKSLIVLEEGVVTGRETFGNILKYLNMCASSNFGNVFSVLVASAFIPFLPMLAIHLLIQNLMYDISQLALPWDKMDKEFLAKPRKWDARNIGRFMIWIGPTSSIFDITTFALMWYVFSANSPQMQSLFQSGWFIEGLLSQTLVVHMLRTQKIPFFQSTAALPVMLMSALIIALGIYIPFSPIGEMVGLVPLPWAYFPWLAATLVSYCLVAQGMKVIYVRRFGQWF

SEQ ID NO: 107671 - DNA, 2700 bp, Yersinia pestis
  CDS (1)..(2700)
atgcgtaaattagaaaaaacagatgcaaaccgtagtaataataagaaaccttttgctattgcactggaagcaaaaaatagtctcgaacaaacattattcaagttaaatacgcatttaaatggtttgacggaagaggatgccagagagcggctggaattatacggtattaatcaggttgcgcatgaaaaagcgccaccggcttttcttcagttattggccgcatttaataacccgtttatttttgttttaattattttggcgtctatcagtttctttaccgattattggctgccattacaagagggtggggaaactgatcttatcggggtgagcattattgtgacaatggtgctgattagtggcttattgcgattctggcaagaatatcggacgaataaggcggccgaagcactgaaatcgatggtgcgtaccaccgcgacggtactgcgtcgcggccactatggtgctaaaccaactcagcaagaaattccaattaatcagttggttccaggcgacattattctgttgtctgcgggtgatatgatccctgccgatttacgcctgattaattcgcgtgatttatttgtcagccaggcgatcctcaccggtgaggcgattccggtcgaaaagtatgatgcgatggggtgtgtcagctcaaaatccgtggatgcgggtgccggcagtgagggggaactgcttgaactctctaatatatgtctgatggggacaaacgtggccagcggtacggcaatgggggtggtggtcgccacgggggggcatacttactttggttcactggctaaatctattgtggggactcgcgcgcaaacagcctttgatcgtggtgttaatagcgtcagttggttattaattcgctttatgttggttatggtgcccattgtcttgttgatcaatggctttaccaagggcgattggacggaagccgcattgtttgccttggcggttgctgtgggtttaacgccagaaatgttgccaatgattgtcagttctaatctggcaaaaggggccatcgcgatggcccggcgtaaagtcgtggttaagcgtttgaatgcgatacagaattttggcgcgatggatgtgctatgtaccgataagaccggcaccttaacccaagatcgtatcattctggagcaccacttagatgttagtggttgtaacgacaataaggtattgcagctggcatggcttaacagcttccatcaaagtggaatgcgcaacctgatggatcaggcggtaatcaaatttagtcgtggcaagccagaaatagaggcgttgcgcaacttcaataaagtggatgagttaccgttcgattttatccgtcggcgtttgtccatcgtggtaaaagatgcgcaacaacaacagcacctaatttgcaaaggtgcggtggaggagatgctcagtatctgcactcatgtgcgggaaggtgatgacatctttccactggatgctgcccgccgtgcaacgctacaagctctggctacgcaatataatgaagatggttttcgtgtcttgttgctggcgacccgagagttaggggctcaggtcagccctgtgccgttgaatattgacgatgaacgagatttagtggtgcaggggttactgacatttcttgacccaccgaaggaaagtgcagcggcggcgattgccgcattgcgggagaatggtgtcgccgtcaaagtattaactggcgataatccaattattaccgcaaaaatttgccgggatgttgggctggaacctggggaaccactgaatgggcgtgatatcgaagcaatggatgaggctacgttggcgcgggaagtggaattacgcacggtatttaccaaactcacaccgttacaaaaatcacgtgtgctaaaaatgctacaaagcaacggacataccgtgggcttcttgggcgatgggatcaatgatgcaccggcattacgtgatgccgatgtgggcatttcagtggatactgggaccgatattgctaaagagtcagccgatattatcctgctggaaaaagacctgatggtactggaagccggggtgattaaagggcgcgaaactttcggaaatatcatcaaatacttgaatatgactgccagttctaactttggtaatgtgttttcggtattagtggccagcgcatttattccgtttttacccatgctggctatccatttgctattacaaaacttgatgtatgacatttctcagctctctttgccgtgggataagatggacaaagagtttttacgtaaaccgcgtaagtgggatgccaagaatattggccgctttatgttatgggttgggccaacatcatcaatttttgatattacaacctatgcgttgatgtggtttgttttcgccgcgaacagtgttgaacatcaggcactgttccagtcagggtggtttattgaagggttattgtcgcaaactctcgtcgtacatatgttgcgtacgcaaaaaattccgtttattcaaagtactgctgcattaccggtgttattgaccacaggtctaattatggccatcgggatctatattcctttctcaccattaggcacattagtggggttagagccgctgccatggcaatatttcccttggttagcgggtacactgatttgctactgtgttgttgcgcaactgatgaagcggttctatatccgccgtttcggcgaatggctttga

SEQ ID NO: 107672 - protein, 899 aa, Yersinia pestis
MRKLEKTDANRSNNKKPFAIALEAKNSLEQTLFKLNTHLNGLTEEDARERLELYGINQVAHEKAPPAFLQLLAAFNNPFIFVLIILASISFFTDYWLPLQEGGETDLIGVSIIVTMVLISGLLRFWQEYRTNKAAEALKSMVRTTATVLRRGHYGAKPTQQEIPINQLVPGDIILLSAGDMIPADLRLINSRDLFVSQAILTGEAIPVEKYDAMGCVSSKSVDAGAGSEGELLELSNICLMGTNVASGTAMGVVVATGGHTYFGSLAKSIVGTRAQTAFDRGVNSVSWLLIRFMLVMVPIVLLINGFTKGDWTEAALFALAVAVGLTPEMLPMIVSSNLAKGAIAMARRKVVVKRLNAIQNFGAMDVLCTDKTGTLTQDRIILEHHLDVSGCNDNKVLQLAWLNSFHQSGMRNLMDQAVIKFSRGKPEIEALRNFNKVDELPFDFIRRRLSIVVKDAQQQQHLICKGAVEEMLSICTHVREGDDIFPLDAARRATLQALATQYNEDGFRVLLLATRELGAQVSPVPLNIDDERDLVVQGLLTFLDPPKESAAAAIAALRENGVAVKVLTGDNPIITAKICRDVGLEPGEPLNGRDIEAMDEATLAREVELRTVFTKLTPLQKSRVLKMLQSNGHTVGFLGDGINDAPALRDADVGISVDTGTDIAKESADIILLEKDLMVLEAGVIKGRETFGNIIKYLNMTASSNFGNVFSVLVASAFIPFLPMLAIHLLLQNLMYDISQLSLPWDKMDKEFLRKPRKWDAKNIGRFMLWVGPTSSIFDITTYALMWFVFAANSVEHQALFQSGWFIEGLLSQTLVVHMLRTQKIPFIQSTAALPVLLTTGLIMAIGIYIPFSPLGTLVGLEPLPWQYFPWLAGTLICYCVVAQLMKRFYIRRFGEWL

SEQ ID NO: 107673 - DNA, 2874 bp, Nostoc sp. PCC 7120
  CDS (1)..(2874)
atgacttacacaatgtctgctaattctctgcctgaaagttccactacttggcacagcttggaagttgataaagcactaggactgctcaatagtaatgcagacagtggcttgacaaccgaagaagttgaacaacggttgcaaaaatatggccccaacgagctagaagaacatggaggccgtagcgcttgggagattctgtttgatcagttcaagaacattatgttgttgatgctgattgcagtagcttttatttctgggtctttagattttatctcttggcaagcaggtgaactcaagcctggggaaatacctttcaaagatacgatcgccatcttagcgattgtcatcctcaatggtattctcggttatgttcaggaaagtcgtgctgaacaagccctcgcggcattgaaaaaactcgcctctccctctgtgcgggtcatccgtagtggtaagttggtagatgtagcagccaaagatatagtcccaggggatgtgatgttgttagaggctggggtgcaaatctccgccgatggccgcttgattgaacaagctaatttacaggtgcgagagtcggctttaactggtgaagcggaagccgtaaataaacaagcatctttacaactaccagaagatacatctttaggcgatcgcattaatgtagtttaccaaggtactgaagtagtccaaggtcgtggcaaggtgctagtaactaatactggcatgaccacggaactaggcaaaattgccaccatgttgcagtcggtggaaaatgaacctacccccttgcaacaacggatgactcagctagggaatgttctagtaagcggttccttggtgttggtggcgattgtcgttgtgggtggtgtcattcaagcagggaattttagccccctgagagacttattagaagtttccttgagtatggcagtagccgtagttcccgaaggtttacccgccgtaattacagttaccttggcactgggaacccagcgcatggtgcggcgtaatgccttaattcgtaaactaccagccgtagaaaccttgggttctgtaactactatttgttctgataaaaccgggacactcacccagaacaaaatggtagtgcagtcaatttacacaaaccataaaacttttcgcgtcacaggtgaaggttatgcaccagtgggcgagtttcagctagatggtcaaaacgtgccggcggaagattatccggaaattcccgctttgttagttgcttgtgctgtctgtaacgactcagtactacaaaaagaagcaggggaatggatgattttaggcgaccctacagaaggggcattagtgacactggcaggtaaagcaggcattgaaaaagaccagtggaactataagttaccccgtgtgagagagtttccgttttcttcggaacgtaaacgcatgagcgtcatttcccaggtagagaaggtagccacaggtgaaccgacaatggcaaccgttgatcccaccttggcaggtctggtcaacagtgaaccttacatcatgtttaccaagggttccccagagttgattttggcacgttgcacagccattcacttgggtgcaaactcagaccacctcaatgacgaacaacgtcaacaaattttggcagcaaatgaccagttggctagtaaaggtctgcgggtattaggttttgcttacaaacccttggcagaagtgccgccggaagggtcggatgagacatcagaacaaggaatggtttggctgggcttggtggggatgctagatgccccacgtcctgaagtccgggcagcagtccaagagtgccgagaagctggtattcgccccattatgattacaggcgaccatcaactaacggcaagagcgatcgccacagacctgggtattgcccaagaaggtgacagagttctcactggtcaagaattacaacggatggatgaccaggaattagaacaacaagtagacctagtaagcatttatgcgcgggtatctccagaacacaaattgcggattgtccaagcgctgcaacgtcgtggtagattcgtcgccatgacgggcgatggtgtgaacgatgccccagccctcaaacaagctgatattgggatcgctatgggtattactggcacagatgtcagtaaagaagccagcgatatggtgctacttgatgacaacttcgctactattgtcaccgcaactaaagaaggtagggtagtttacaccaacatccgccgctttatcaaatacatcctgggcagcaacatcggcgaagtcctcaccattgcggctgcaccactcatgggactaggaggagtacccctaacacccctacaaattctctggatgaacttggtaacagatggtttaccagccttagccttggctgtggaaccgcccgaacctgatgtgatgaagcgcccacccttcagcccccgtgaaagcatttttgctagaggcttgggttcttacatgattcgtatcgggattgtctttgccatcatcagtattatcttgatgaaatgggcttatgatcattcccacgcagtgacagggccaggactcgatcctgagcgttggaaaacaatggtctttacatctctgtgtattgctcaaatgggtcatgcgatcgccattcgctccaacaaccaactcaccatagagacgaatcctgtctcaaatccttatgtattaggggcagttgttgtcacaacaattttgcaactcatgctggtctacgttccacccctgcgggatttctttggcactcactggctaccacttgacgagttagcaatttgcgtcggcttcagcgccttgatgtttgtttgggtggagatggagaagttattcttccgctttatgggtaagaggactgtttag

SEQ ID NO: 107674 - protein, 957 aa, Nostoc sp. PCC 7120
MTYTMSANSLPESSTTWHSLEVDKALGLLNSNADSGLTTEEVEQRLQKYGPNELEEHGGRSAWEILFDQFKNIMLLMLIAVAFISGSLDFISWQAGELKPGEIPFKDTIAILAIVILNGILGYVQESRAEQALAALKKLASPSVRVIRSGKLVDVAAKDIVPGDVMLLEAGVQISADGRLIEQANLQVRESALTGEAEAVNKQASLQLPEDTSLGDRINVVYQGTEVVQGRGKVLVTNTGMTTELGKIATMLQSVENEPTPLQQRMTQLGNVLVSGSLVLVAIVVVGGVIQAGNFSPLRDLLEVSLSMAVAVVPEGLPAVITVTLALGTQRMVRRNALIRKLPAVETLGSVTTICSDKTGTLTQNKMVVQSIYTNHKTFRVTGEGYAPVGEFQLDGQNVPAEDYPEIPALLVACAVCNDSVLQKEAGEWMILGDPTEGALVTLAGKAGIEKDQWNYKLPRVREFPFSSERKRMSVISQVEKVATGEPTMATVDPTLAGLVNSEPYIMFTKGSPELILARCTAIHLGANSDHLNDEQRQQILAANDQLASKGLRVLGFAYKPLAEVPPEGSDETSEQGMVWLGLVGMLDAPRPEVRAAVQECREAGIRPIMITGDHQLTARAIATDLGIAQEGDRVLTGQELQRMDDQELEQQVDLVSIYARVSPEHKLRIVQALQRRGRFVAMTGDGVNDAPALKQADIGIAMGITGTDVSKEASDMVLLDDNFATIVTATKEGRVVYTNIRRFIKYILGSNIGEVLTIAAAPLMGLGGVPLTPLQILWMNLVTDGLPALALAVEPPEPDVMKRPPFSPRESIFARGLGSYMIRIGIVFAIISIILMKWAYDHSHAVTGPGLDPERWKTMVFTSLCIAQMGHAIAIRSNNQLTIETNPVSNPYVLGAVVVTTILQLMLVYVPPLRDFFGTHWLPLDELAICVGFSALMFVWVEMEKLFFRFMGKRTV

SEQ ID NO: 107675 - DNA, 2709 bp, Salmonella typhimurium
  CDS (1)..(2709)
atgctaaaaatcattacccgccagctttttgcccggcttaatcgtcatttgccttatcgtctggttcaccgcgatccgctgcccggcgcgcagaccgcggtaaatgcgactatcccgccttcgctgagcgagcgctgtctgaaagtcgcggcaatggagcaggagactctctggcgcgtttttgatacgcacccggagggattaaacgctgccgaggtgacgcgcgcgcgtgaaaagcatggcgaaaaccgccttccggcacagaaaccctcgccgtggtgggtgcatctgtgggtatgttatcgcaatcctttcaacatcttactcacgattcttggcggcatttcttatgccacggaggatctgtttgccgcaggcgttatcgccctgatggtcggtatctcaacgctgctgaattttgtgcaggaagcgcgctcgacaaaagcggcggacgcgctaaaagcgatggtgagcaataccgctaccgtactgcgggttattaatgaaaatggcgaaaatgcctggctggaattacccatcgatcaactggtgcccggcgatattattaagctggcggcgggggatatgatcccggcggatttacggattatccaggcgcgcgatctgtttgtcgcccaggcgtcgctgaccggcgaatctctgccagtcgagaaagtcgccgcgacgcgtgagccccggcaaaataacccgcttgagtgcgacacgctgtgctttatggggacgaacgtcgtgagcggaacggcgcaggccgtggtgatggcgaccggcgccggcacctggtttggtcaattggcggggcgcgtgtcggaacaagataacgagcagaacgctttccagaaaggaattagccgcgtcagtatgttgctgatccgctttatgctggtcatggcgccggtagtactgattattaatggttacacgaaaggtgactggtgggaagcggcgctatttgcgctctcggtcgcggtagggctcaccccggaaatgttgccgatgatcgtcacctccaccctcgcgcgcggggcggtgaagctctcgaaacagaaagttatcgtgaagcaccttgatgcgattcagaacttcggcgcgatggatattctgtgcactgataaaaccggcactctgacgcaggataaaattgtgctggagaatcacacggatatttctggtaagcccagcgagcatgtactgcattgcgcctggctgaacagccattatcagaccggtctaaaaaatttactggatacggcggtcctggagggagtagacgaaaccgccgcgcgtcagctctccggacgctggcagaaaatcgatgagatcccgtttgattttgagcgtcgccggatgtcggtagtggtcgccgaagattcgaacgtgcatcaactggtctgcaaaggcgcgttacaggagatcctgaacgtgtgtactcaggtgcgccacaacggcgatattgtgccgctggacgacaatatgctgcgccgggtgaaacgcgttaccgacacgctgaaccgtcaggggctacgcgtggtcgccgtcgcgaccaaatacctgcctgcgcgtgagggcgattaccaacgtatcgatgagtctgacctcattctggaagggtatatcgcttttctcgatccgccgaaagagaccaccgcgccggcgctgaaagcgctgaaggcgagcggaattacggtgaaaattctcaccggcgacagcgagctggtagcggcgaaagtttgccatgaggttgggctggatgcgggcgatgtcattattggcagtgatattgaagggttaagcgacgacgcgctggcggcgctggccgcccgtacgacgttgtttgcgcgtctgacgccgatgcataaagagcgcatcgtcactttactcaaacgcgaggggcatgtggtcggttttatgggcgacgggattaacgatgctccggcgttgcgggcggcggatattggtatctcggtagatggcgcggtggacatcgcccgtgaagcggccgatattatcctgctggaaaagagcctgatggtgctggaagaaggcgtcattgaaggtcgtcgtactttttctaatatgttgaaatatatcaagatgacggccagctcaaatttcggtaacgtgtttagcgtactggtggcgagcgcctttttgccgttcctgccaatgctgccgctgcacttgctgattcaaaacctactgtacgatgtatcccaggtggcgattccgtttgataatgtcgatgaagaacaaattcaaaagccgcagcgctggaatccggcggatttggggcgctttatggtctttttcggtccgatcagctcgattttcgacattttgaccttttgtctgatgtggtgggtatttcatgcgaatacgccagaaacgcaaactttgttccagtccggctggtttgtggtgggattactgtcgcaaacgctgattgtgcatatgatccgtacccgccgtctgccgtttattcaaagtcgcgccgcttggccgctgatggcgatgacattgttggtgatggtggtgggagtctcgttgccgttttcgccgctggcgtcttacctgcagttgcaggcgctgccgttaagctatttcccgtggctgattgccattctggtgggatatatgacgttaacccagttggtgaaagggttttacagcagacgttatggctggcagtaa

SEQ ID NO: 107676 - protein, 902 aa, Salmonella typhimurium
MLKIITRQLFARLNRHLPYRLVHRDPLPGAQTAVNATIPPSLSERCLKVAAMEQETLWRVFDTHPEGLNAAEVTRAREKHGENRLPAQKPSPWWVHLWVCYRNPFNILLTILGGISYATEDLFAAGVIALMVGISTLLNFVQEARSTKAADALKAMVSNTATVLRVINENGENAWLELPIDQLVPGDIIKLAAGDMIPADLRIIQARDLFVAQASLTGESLPVEKVAATREPRQNNPLECDTLCFMGTNVVSGTAQAVVMATGAGTWFGQLAGRVSEQDNEQNAFQKGISRVSMLLIRFMLVMAPVVLIINGYTKGDWWEAALFALSVAVGLTPEMLPMIVTSTLARGAVKLSKQKVIVKHLDAIQNFGAMDILCTDKTGTLTQDKIVLENHTDISGKPSEHVLHCAWLNSHYQTGLKNLLDTAVLEGVDETAARQLSGRWQKIDEIPFDFERRRMSVVVAEDSNVHQLVCKGALQEILNVCTQVRHNGDIVPLDDNMLRRVKRVTDTLNRQGLRVVAVATKYLPAREGDYQRIDESDLILEGYIAFLDPPKETTAPALKALKASGITVKILTGDSELVAAKVCHEVGLDAGDVIIGSDIEGLSDDALAALAARTTLFARLTPMHKERIVTLLKREGHVVGFMGDGINDAPALRAADIGISVDGAVDIAREAADIILLEKSLMVLEEGVIEGRRTFSNMLKYIKMTASSNFGNVFSVLVASAFLPFLPMLPLHLLIQNLLYDVSQVAIPFDNVDEEQIQKPQRWNPADLGRFMVFFGPISSIFDILTFCLMWWVFHANTPETQTLFQSGWFVVGLLSQTLIVHMIRTRRLPFIQSRAAWPLMAMTLLVMVVGVSLPFSPLASYLQLQALPLSYFPWLIAILVGYMTLTQLVKGFYSRRYGWQ

SEQ ID NO: 107677 - DNA, 2949 bp, Ureaplasma urealyticum
  CDS (1)..(2949): transl_table=4
atgtcatttgatccagaaaatataaatccatcaacaggtctaaatgatgagcaggttttaaaaagtcgtcaaatttatggttttaatgaaatcaaaaagaaaaaaaaatcccacattattacaaaatttttaaagcagtttttagattttatggttattttacttgtaatcgctgctgctgttactttagctttagtgattattaaacctcctcatgatacagctgaattagttgttcaatatgtagaatttggaataatatgttttattttattgttaaatgcaatttttggtaccattcaagaagtgaaagctgaaaaaaatacggatgcattgtctaaattagcgtctcatcaggtcaaagtattacgtaataatcaaattagaattattaattctaaccaagttgtaatgggtgatgttttgattttagaagctggtgatcaagtcccagctgatgctttattagtgaacagctcatcacttgaagtagatgaagctattttaacaggagaatctttaccagttgtaaaaaatgccaaggcaattgttaaaaaaaatacagtaattggcgactgtttaaatcaaattttttctggaacatatattactaatggaacagcaaaagcaattgttactaatatcggtatgaatactgaaattggtaaaatagccaaattaattaatgatcaaaaaactaaattaacgcctttacaaaaaaaaattaataagttatctaaaattataggtctatttgcttctattttatgtattgcagtatttattatttatatttatttaattggagatggaaattgaaatattagttgacatcccgctttaataatggctatttcattatctatagcagctattcctgaaggaattgtggcaattgtaacaattgttttatcattcggtattaaagaaatggcaaaacaaaatgctttaattaaacgtttgccagctgttgaaactctaggaagtgctaatgttatttgttctgataaaacaggaaccttaacacaaaacaaaatgactgttactaaagttttcactaataaattaaaaataacagatttaattgataatgagagtgtttttaatttaattaaatgagctactatagcaaataatggaattaaaaattttaatgaaaaaaaacaagaatatgagtttattggcgaccctacagaaacttgtatcattgaagctgctttaaaattaaacatagataaatataaattagatcaagaatttattagaattcatgaatttccatttgattcaactcgaaaattaatgagtgttgttgtaaaacatcaaagtgattattatttaattactaaaggagcaattgatgctattgacaaaattgttcaaaatccaattacaaaagatgtttatgaagcaaatgattttttaagtaaacaagctttaagaattttatgtgttgcaattaaaaaactatcatctataccaactaattttaaccaagatgaacttgaaaaatgtttagaatttgttggtctaatcggtatgatagatccgcctcgtcctgaaacacaagaggcagtaaaaattgctattaaagctggaatccgtccgataatgattactggcgatcatattaatacagcatcagccattgctaaacaagttggtattttaaacgaaggacaagaagttttgaatggtaatgaattgaatatgatgagtgataatgaattaataaataatattgatcgttatagtgtttatgcccgagtttctccaacagataaaatccgtattgttaaagcttgacagcaccatgataaagtagtaagtatgactggagatggtgtcaatgatgcacctgcactaaaagctgctgacattggatgcgcaatgggtataactggaactgatgtttcaaaagcatcaagtgatatgatattaattgatgataatttcgcaacaattattaatgctgttagtttaggacgttctattatggacaacattaaacgtattattgttttattattgatcactaatttatctggattagtttcattaatatttggaattattattctaggaattaatcctatgtcatcactacaaatattatgaattaatgtaattgctgaaactttacctggaatagcattagggttacatttagcggatgttaatttaatgcgacacaaaccattaaaaaaatcagcaccgattgttaataaaagaatgtgagctactatttttaccaatggtttttttgttggtttaatttctattttattattttatttaggagcttcttcacactttaattttgactttatgctaatgagaaacgagtttaaagaacttactaatcttgaaaagatatatcaagacacatgaagttgatttgggcaaaatcacgaaatttccaatattattcatgaaaaaattttaaccataaaaacagcgattatggctggttcgtctttaacatttgtttttatgggaatgagcttaacgtttaatgcattaagcttaagaacaaatcattcagtattcgttaatttttgagaaaactgtaaatacgttgtttattcaatattaatatcaatagttatgattattgttatcgcttatactcctcatttaaatcaaatattcaatatgaatccatacaacataaacggttatgagtgatttaatattcttccatttgttctttttgcaatacctttaagtatttttgaaattatcaaatattttagatatttaaaactacgtagtacttttgattataaaaataaaacttatgcattattaaaccaagaaatacaatcaacaaatttaaaaattaataatacaaaaattagttatgaaaaacagtattacaaggcattgttgaataatttaattattaaaagaaaaattttaataaataaatgccataaagaaatataa

SEQ ID NO: 107678 - protein, 982 aa, Ureaplasma urealyticum
MSFDPENINPSTGLNDEQVLKSRQIYGFNEIKKKKKSHIITKFLKQFLDFMVILLVIAAAVTLALVIIKPPHDTAELVVQYVEFGIICFILLLNAIFGTIQEVKAEKNTDALSKLASHQVKVLRNNQIRIINSNQVVMGDVLILEAGDQVPADALLVNSSSLEVDEAILTGESLPVVKNAKAIVKKNTVIGDCLNQIFSGTYITNGTAKAIVTNIGMNTEIGKIAKLINDQKTKLTPLQKKINKLSKIIGLFASILCIAVFIIYIYLIGDGNWNISWHPALIMAISLSIAAIPEGIVAIVTIVLSFGIKEMAKQNALIKRLPAVETLGSANVICSDKTGTLTQNKMTVTKVFTNKLKITDLIDNESVFNLIKWATIANNGIKNFNEKKQEYEFIGDPTETCIIEAALKLNIDKYKLDQEFIRIHEFPFDSTRKLMSVVVKHQSDYYLITKGAIDAIDKIVQNPITKDVYEANDFLSKQALRILCVAIKKLSSIPTNFNQDELEKCLEFVGLIGMIDPPRPETQEAVKIAIKAGIRPIMITGDHINTASAIAKQVGILNEGQEVLNGNELNMMSDNELINNIDRYSVYARVSPTDKIRIVKAWQHHDKVVSMTGDGVNDAPALKAADIGCAMGITGTDVSKASSDMILIDDNFATIINAVSLGRSIMDNIKRIIVLLLITNLSGLVSLIFGIIILGINPMSSLQILWINVIAETLPGIALGLHLADVNLMRHKPLKKSAPIVNKRMWATIFTNGFFVGLISILLFYLGASSHFNFDFMLMRNEFKELTNLEKIYQDTWSWFGQNHEISNIIHEKILTIKTAIMAGSSLTFVFMGMSLTFNALSLRTNHSVFVNFWENCKYVVYSILISIVMIIVIAYTPHLNQIFNMNPYNINGYEWFNILPFVLFAIPLSIFEIIKYFRYLKLRSTFDYKNKTYALLNQEIQSTNLKINNTKISYEKQYYKALLNNLIIKRKILINKCHKEI

SEQ ID NO: 107679 - DNA, 2733 bp, Methanobacterium thermoautotrophicum
  CDS (1)..(2733)
atggtgttaaccatgaccgccatatatgaacttgaagtggaggaggtcctgcagaggcttgaaacatcagaatcaggccttgacccccaggaggcggaaaaacgcctcaagatccacggtccaaacaaacttgaggaggtcaaaaggagaccactcatcctgctttttctatcaaacctctacaacgtacttgcactgctgctctggatcgcagccatactgtcctttataacaggcaattaccagcttgcagtcgccattgtaatggttataatcataaacgcactcttcagtttctggcaggaatatgaggctgaaaaggcagccgaggcccttaaaaacattctgcctgtgatggttaaggtcataagggcctcaaaggaggttctgatacccgcggctgatgtcgtgcacggggacatcataatccttgaggagggggacaccgtcccggccgacgcaaggatccttgaatcacacaacctgagggtggatgcatcagcactgacaggagaatcaaaacctgtgagaaaggtatcacacccggtcagggaggctgataactacatagacacagagaacattctgtttgcaggcacccaggtgacttcaggtacaggaagggccgctgtgtttgcaaccggcagggacaccgagttcagcaggatagcgacactcacacaggaggtgcgtgaggagcccagccccctccagcgacagatatccctggccgcaaggatcataggggccctggcggtcgccatgggggtcatcctcttcctggtgaacctttacatagtcagactcccccttgaaacggcattcatattcgcaattggtttgatggttgcaaacgtcccggagggccttcttccgagcgtcacactctcacttgcggcatccgcaaggaagatggcccgggaaaacgcccttgtgaagagactttccagtgtggagacactgggatcaacgacaatcatatgcacagataagacagggaccctcacaaggggtgagatgacggtcaggaaaatatggatcccccataaggtcatcgaggtcacagggtcaggttacagaccagaaggtcagttcctcttcaggggtgaaccagtgagccacagggacatggccgagctgaagctgctcatgagggcagccaccttctgcaacgattcggccctcatacatgaggaaggtgaatggagtgtgctgggtgattcaaccgagggcgccctccttgttgcagccgagaagctgggctttgatgctgaggcagaactcaaagcgatgccaaggataacagagctcccctttgactccaggcggaaatcaatgacctcaatccatgagaaatcagggaagagggtggcctacgtcaagggagcgccaaagaagataataggattatcggaacgcatttctgtggatgggagggtcagagccctccatgcagatgagaaggaaaggataataggcatacatgatgaaatggcctcgaagggtctccgtgtacttgccttcgcataccgggaactccccgaggaccttgaagtcagggaccccggtgaggttgagagggaccttgtactggtgggcatggcagccatgcatgatccaccaagggagggggttaaggaggctgtggagcactgcaagactgcaggtataaggatcataatgataacaggtgactatggtctcacagcagaggccatagccagggagatcgggatagtggagggtgagtgcagaataatcaagggaaaggagctggataagctcaaagacaccgaactcaggggtatactggccagggagaggaaccttatattcgcaagggcggtccctgaacataagatgaggatagcatctgtcctggaggactcagatgagatcgttgccatgacaggggacggtgttaacgatgcacccgccctcaggaaggcagatataggtgttgccatggggagcggcaccgatgttgcaaaggaggcagcagacatagtccttgcagatgacaactttgcaagtatcgtgaccgcggtcagggagggccgtacggtctatgagaatataaggaagttcataacctacatattttctcatgagacagctgagatagtcccatttatcatgatggttctcttcagcatacccctcccaataaccataatgcagatactcgcaatagaccttggaacagacaccctcccggccctggcccttggaagatccctgccggagtctgatgtgatgaaactgccaccaagggccccctcagagaggctccttaacagggaggtcatcctgaggggttacctgttcacagggacaattgaggcagccctcatcatggcagcatacttcctggttctctattcagggggatggcttccaggacaggaactttcagccagcgatcccctctacatgagggccaccacggtggtctttgcaggtatagtcatggcacagctgggcaatcttctctcctcacagaccctccgttcatcagcacttgaggcgggcctcctgaggaacaggtggatactggcaggtatggtctttgcaatctcggtgatgctccttgttatctatctgccaccactgcagcccatcttcggcacagccccacccggaatcctggagtggttcatcctgatactcttcacacccatcgtctttctgacagatgagatgaggaagttcatacagaggaggctggcctga

SEQ ID NO: 107680 - protein, 910 aa, Methanobacterium thermoautotrophicum
MVLTMTAIYELEVEEVLQRLETSESGLDPQEAEKRLKIHGPNKLEEVKRRPLILLFLSNLYNVLALLLWIAAILSFITGNYQLAVAIVMVIIINALFSFWQEYEAEKAAEALKNILPVMVKVIRASKEVLIPAADVVHGDIIILEEGDTVPADARILESHNLRVDASALTGESKPVRKVSHPVREADNYIDTENILFAGTQVTSGTGRAAVFATGRDTEFSRIATLTQEVREEPSPLQRQISLAARIIGALAVAMGVILFLVNLYIVRLPLETAFIFAIGLMVANVPEGLLPSVTLSLAASARKMARENALVKRLSSVETLGSTTIICTDKTGTLTRGEMTVRKIWIPHKVIEVTGSGYRPEGQFLFRGEPVSHRDMAELKLLMRAATFCNDSALIHEEGEWSVLGDSTEGALLVAAEKLGFDAEAELKAMPRITELPFDSRRKSMTSIHEKSGKRVAYVKGAPKKIIGLSERISVDGRVRALHADEKERIIGIHDEMASKGLRVLAFAYRELPEDLEVRDPGEVERDLVLVGMAAMHDPPREGVKEAVEHCKTAGIRIIMITGDYGLTAEAIAREIGIVEGECRIIKGKELDKLKDTELRGILARERNLIFARAVPEHKMRIASVLEDSDEIVAMTGDGVNDAPALRKADIGVAMGSGTDVAKEAADIVLADDNFASIVTAVREGRTVYENIRKFITYIFSHETAEIVPFIMMVLFSIPLPITIMQILAIDLGTDTLPALALGRSLPESDVMKLPPRAPSERLLNREVILRGYLFTGTIEAALIMAAYFLVLYSGGWLPGQELSASDPLYMRATTVVFAGIVMAQLGNLLSSQTLRSSALEAGLLRNRWILAGMVFAISVMLLVIYLPPLQPIFGTAPPGILEWFILILFTPIVFLTDEMRKFIQRRLA

SEQ ID NO: 107681 - DNA, 2718 bp, Mycobacterium tuberculosis
  CDS (1)..(2718)
atgtcggcgtcagtgtctgccacgacggctcatcatggcttgccagcacatgaagtggtgctgctgctggagagcgatccatatcacgggctgtccgacggcgaggccgcccaacgactagaacgcttcgggcccaacaccttggcggtggtaacgcgcgctagcttgctggcccgcatcctgcggcagtttcatcacccgctgatctacgttctgctcgttgccgggacgatcaccgccggtcttaaggaattcgttgacgccgcagtgatcttcggtgtggtggtgatcaatgcgatcgtgggtttcattcaagaatccaaggcagaggccgcactgcagggcctgcgctccatggtgcacacccacgccaaggtggtgcgcgagggtcacgagcacacaatgccatccgaagagctggttcccggtgaccttgtgctgttagcggccggtgacaaggttcccgccgatttgcggctggtgcgacagaccggattgagcgtgaacgagtcagcacttaccggcgagtcgacgccggttcacaaggacgaggtggcgttgccggagggcacaccggtcgctgatcgtcgcaatatcgcgtattccggcacattggtaaccgcgggccatggcgccgggatcgtcgtcgcgaccggcgccgaaaccgaactcggtgagattcatcggctcgttggggccgccgaggttgtcgccacaccgctgaccgcgaagctggcgtggttcagcaagtttctgaccatcgccatcctgggtctggcagcgctcacgttcggcgtgggtttgctgcgccggcaagatgccgtcgaaacgttcaccgctgcgatcgcgctggcggtcggggcaattcccgaaggtctgcccaccgccgtgaccatcaccttggccatcggcatggcccggatggccaagcgccgcgcggtcattcgacgtctacccgcggtggaaacgctgggcagcaccacggtcatctgcgccgacaagaccggaacgctgaccgagaatcagatgacggtccagtcgatctggacaccccacggtgagatccgggcgaccggaacgggctatgcacccgacgtcctcctgtgcgacaccgacgacgcgccggttccggtgaatgccaatgcggcccttcgctggtcgctgctggccggtgcctgcagcaacgacgccgcactggttcgcgacggcacacgctggcagatcgtcggcgatcccaccgagggcgcgatgctcgtcgtggccgccaaggccggcttcaacccggagcggctggcgacaactctgccgcaagtggcagccataccgttcagttccgagcggcaatacatggccaccctgcatcgcgacgggacggatcatgtggtgctggccaagggtgctgtggagcgcatgctcgacctgtgcggcaccgagatgggcgccgacggcgcattgcggccgctggaccgcgccaccgtgttgcgtgccaccgaaatgttgacttcccgggggttgcgggtgctggcaaccgggatgggtgccggcgccggcactcccgacgacttcgacgaaaacgtgataccaggttcgctggcgctgaccggcctgcaagcgatgagcgatccaccacgagcggccgcggcatcggcggtggcggcctgccacagtgccggcattgcggtaaaaatgattaccggtgaccacgcgggcaccgccacggcgatcgcaaccgaggtggggttgctcgacaacactgaaccggcggcaggctcggtcctgacgggtgccgagctggccgcgctgagcgcagaccagtacccggaggccgtggatacagccagcgtgtttgccagggtctctcccgagcagaagctgcggttggtgcaagcattgcaggccagggggcacgtcgtcgcgatgaccggcgacggcgtcaacgacgccccggccttgcgtcaggccaacattggcgtcgcgatgggccgcggtggcaccgaggtcgccaaggatgccgccgacatggtgttgaccgacgacgacttcgccaccatcgaagccgcggtcgaggaaggccgcggcgtattcgacaatctgaccaagttcatcacctggacgctgcccaccaacctcggtgagggcctagtgatcttggccgccatcgctgttggcgtcgccttgccgattctgcccacccaaattctgtggatcaacatgaccacagcgatcgcgctcggactcatgctcgcgttcgagcccaaggaggccggaatcatgacccggccaccgcgcgaccccgaccaaccgctgctgaccggctggcttgtcaggcggactcttctggtttccaccttgctcgtcgccagcgcgtggtggctgtttgcatgggagctcgacaatggcgcgggcctgcatgaggcgcgcacggcggcgctgaacctgttcgtcgtcgtcgaggcgttctatctgttcagctgccggtcgctgacccgatcggcctggcggctcggcatgttcgccaaccgctggatcatcctcggcgtcagtgcgcaggccatcgcgcaattcgcgatcacatatctacccgcgatgaatatggtgttcgacaccgcgccaatcgatatcggggtgtgggtgcgcatattcgctgtcgcgaccgcaatcacgattgtggtggccaccgacacgctgctgccgagaatacgggcgcaaccgccatga

SEQ ID NO: 107682 - protein, 905 aa, Mycobacterium tuberculosis
MSASVSATTAHHGLPAHEVVLLLESDPYHGLSDGEAAQRLERFGPNTLAVVTRASLLARILRQFHHPLIYVLLVAGTITAGLKEFVDAAVIFGVVVINAIVGFIQESKAEAALQGLRSMVHTHAKVVREGHEHTMPSEELVPGDLVLLAAGDKVPADLRLVRQTGLSVNESALTGESTPVHKDEVALPEGTPVADRRNIAYSGTLVTAGHGAGIVVATGAETELGEIHRLVGAAEVVATPLTAKLAWFSKFLTIAILGLAALTFGVGLLRRQDAVETFTAAIALAVGAIPEGLPTAVTITLAIGMARMAKRRAVIRRLPAVETLGSTTVICADKTGTLTENQMTVQSIWTPHGEIRATGTGYAPDVLLCDTDDAPVPVNANAALRWSLLAGACSNDAALVRDGTRWQIVGDPTEGAMLVVAAKAGFNPERLATTLPQVAAIPFSSERQYMATLHRDGTDHVVLAKGAVERMLDLCGTEMGADGALRPLDRATVLRATEMLTSRGLRVLATGMGAGAGTPDDFDENVIPGSLALTGLQAMSDPPRAAAASAVAACHSAGIAVKMITGDHAGTATAIATEVGLLDNTEPAAGSVLTGAELAALSADQYPEAVDTASVFARVSPEQKLRLVQALQARGHVVAMTGDGVNDAPALRQANIGVAMGRGGTEVAKDAADMVLTDDDFATIEAAVEEGRGVFDNLTKFITWTLPTNLGEGLVILAAIAVGVALPILPTQILWINMTTAIALGLMLAFEPKEAGIMTRPPRDPDQPLLTGWLVRRTLLVSTLLVASAWWLFAWELDNGAGLHEARTAALNLFVVVEAFYLFSCRSLTRSAWRLGMFANRWIILGVSAQAIAQFAITYLPAMNMVFDTAPIDIGVWVRIFAVATAITIVVATDTLLPRIRAQPP

SEQ ID NO: 107683 - DNA, 2712 bp, Pseudomonas aeruginosa
  CDS (1)..(2712)
atgagcgtagcgacccaacgcaatacccagctcgataccgagcgccgcaacgaccgactgtccatgcgcgccgcccgcgaagcgcagaacagcctggaaaccaccctcaccaatgtccgcggtcgccaggacggcctcgaccaggccgaggccgccgcccggctgcacgccgacggccccaacgaagtggcccacgaccgtccgccacacgtcctggtgcaactgctgcaggcgttcaacaaccccttcatctacgtgctgatgacgctctctgcgatcagcttcttcaccgacttctggctgcccctgcaggacggtgaggaaaccgatctcaccggcgtcatcatcgtcctctgcatggtcctggtcagcggcctgatgcgcttctggcaggaataccgttcgggcaaggccgccgaggcgctcaaggccatggtgcggaacaccgccaccgtgctgcgccgcgacgagcgcgggatgcgcggcgagctgcgggaaatccccatgggcgaactggtggtcggcgacatcgtgcgcctgtccgccggcgacatgatccccgccgacatccgcctgatcgaatcgcgcgacctgttcatcagccaggccgtactcaccggcgaggcgctgccggtggagaaatacgacaccctcggcgcggtccgcgagaagtccgccaagcggatcgccgccgaccagcaggacctgctcgaactgccgaacatctgcttcatgggcaccaacgtggtcagcggcacggccaccgcggtggtggttgccaccggtgcgcgcacctatttcggttcgctggcccgttccatcgtcggttcgcgggcgcagaccgccttcgaccgtggggtgaacagcgtcagttggctgctgatccgcttcatgctggtgatggtgccgatcgtgctgctgatcaacggtttcaccaagggcgactggaccgaggcgttcatgttcgctctcgccgtggcggtcggcctgaccccggaaatgctgccgatgatcgtcagcgccaacctggccaagggcgcggtggcgatgtcgcggcgcaaggtggtggtcaagcgcctcaacgcgatccagaacttcggcgccatggacgtgctctgcaccgacaagaccggcaccctgacccaggaccggatcatcctcgagcatcacgtcgacgttgccggccggcgctgcgaccgggtcctgcaaatggcctggctgaacagcttccaccagtccgggatgaagaacctgatggaccgcgcggtggtcgccttcgtcgaacagaacccgcgcatcacgccgtcggatgcctggcgcaaggtcgacgaactgcccttcgatttcgtccgtcggcgtctctcggtgatcctcgagggcaaggacggcgaacagctgctggtgtgcaagggcgcggtcgaggaaatgctcgagatcgccacccgcgtgcaccaggacggtgtcgacctgccgctcgacgaggaacgccgccgggccctgctggcgctggccgagcaatacaaccgcgacggcttccgcgtgctcctgctcggcacccgcagcctctcgcgcacggagtcccaggcccagtacggcgccagcgacgagcgcgacctggtgatcgccggcctgctgaccttcctcgatccaccgaaggaaaccgccggcccggccatcgccgcgttgcgcgagaacggcgtggcagtgaaggtgctcaccggcgacaacccggtggtcagcgcgaagatctgccgcgaggtcggcctggacgtcggcgagccgctgctcggtcgcgacatcgacctgatggacgatgccaccctgcaacgcctggccgaggagcgcacggtgttcgccaagctgacgccgctgcagaagtcgcgggtgctcaaggccctgcagggcaacggacacaccgttggcttcctcggcgacggcatcaacgacgcccccgcgctgcgagatgccgatgtcggcatctcggtggacagcggcaccgacatcgccaaggaatcggccgacatcatcctcctggaaaaaagcctgatggtcctggaggagggcgttatcaagggccgcgagaccttcggcaacatcatgaagtacctgaacatgactgccagctccaacttcggcaacgtgttctcggtactggtggccagcgccttcatccccttcctgccgatgctggcgatccacctgctgctgcagaacctgatgtacgacatctcccagctgtcgctgccgtgggacaagatggacaaggaattcctcgccaagccgcgcaagtgggactcgaagaacatcggccgcttcatggtctggatcggcccgacctcgtcgatcttcgacatcaccacctacgcgctgatgtggttcgtgttcgccgccaacagcccggaaatgcagtcgctgttccagtccggctggttcatcgagggcctgctctcgcagaccctggtggtgcacatgctgcgtacccagaagattcccttcatccagagcaccgcggcgctgccggtgatgctgatgaccgggctggtgatggcgctgggcatctacgtgccgttctcgccgctgggagcggtggtcggcctgcagccgctgccgtgggagtacttcccctggctggtgggcacgctgctctgctactgcgtcaccgcgcagaccatgaagaccctctacatccgccgcttcggccagtggttctga

SEQ ID NO: 107684 - protein, 903 aa, Pseudomonas aeruginosa
MSVATQRNTQLDTERRNDRLSMRAAREAQNSLETTLTNVRGRQDGLDQAEAAARLHADGPNEVAHDRPPHVLVQLLQAFNNPFIYVLMTLSAISFFTDFWLPLQDGEETDLTGVIIVLCMVLVSGLMRFWQEYRSGKAAEALKAMVRNTATVLRRDERGMRGELREIPMGELVVGDIVRLSAGDMIPADIRLIESRDLFISQAVLTGEALPVEKYDTLGAVREKSAKRIAADQQDLLELPNICFMGTNVVSGTATAVVVATGARTYFGSLARSIVGSRAQTAFDRGVNSVSWLLIRFMLVMVPIVLLINGFTKGDWTEAFMFALAVAVGLTPEMLPMIVSANLAKGAVAMSRRKVVVKRLNAIQNFGAMDVLCTDKTGTLTQDRIILEHHVDVAGRRCDRVLQMAWLNSFHQSGMKNLMDRAVVAFVEQNPRITPSDAWRKVDELPFDFVRRRLSVILEGKDGEQLLVCKGAVEEMLEIATRVHQDGVDLPLDEERRRALLALAEQYNRDGFRVLLLGTRSLSRTESQAQYGASDERDLVIAGLLTFLDPPKETAGPAIAALRENGVAVKVLTGDNPVVSAKICREVGLDVGEPLLGRDIDLMDDATLQRLAEERTVFAKLTPLQKSRVLKALQGNGHTVGFLGDGINDAPALRDADVGISVDSGTDIAKESADIILLEKSLMVLEEGVIKGRETFGNIMKYLNMTASSNFGNVFSVLVASAFIPFLPMLAIHLLLQNLMYDISQLSLPWDKMDKEFLAKPRKWDSKNIGRFMVWIGPTSSIFDITTYALMWFVFAANSPEMQSLFQSGWFIEGLLSQTLVVHMLRTQKIPFIQSTAALPVMLMTGLVMALGIYVPFSPLGAVVGLQPLPWEYFPWLVGTLLCYCVTAQTMKTLYIRRFGQWF

SEQ ID NO: 107685 - DNA, 2709 bp, Bacillus halodurans
  CDS (1)..(2709)
atgaagtggtatcaaatgggagaggaagaggtaaaaaaagcaacaggggtccttggggcagacggattgccgcaaagggaagtcgacaaacgattaaaaagggttggcttcaataaactggacgaaggggaatcggtgtcagccttgattctcttctttatgcaatttaaagatttcatggttctcgtccttcttgcagctacgcttatttcgggcttgcttggagaatatattgacgctattaccatcattttaattattctactaaatggcgtcctcggatttattcaggaacgaaaggcagaaaaatccctttcggcgttaaaagaattatcagcaccgcaaatggtcgttttacgtgatggcaaatggttaaaggttccagccgctactgttgtccctggcgatgtagtgaaactaacaagcggtgaccgagttggggcggatatccgcttacttgaaacggcaagccttcgcattgaggagtcctctttaacaggtgagtcgcttcccgttcataagcatggggacagaatggagcagaccgacttacagctaggcgaccaagcgaacatggcgtttatgggtacccttgtcaccgaggggcaaggaatagggattgtggtagcaacaggaatgaaaactgagatgggcaaaatcgctcacctgttgcaaacgacggaaacagtcattacgccgttacaacgtaagcttgagcaactagggaaagtgttgatcgctgttgcgcttttacttacggcaatggttgtcgtcattggggttatacagggtcatgatgcgtacacaatgtttcttgccggagtttcccttgccgtggctgcaatcccagaagggttaccggcaatcgtgaccgttgcccttgccctaggggtgcagcggatgatcaagagaagagcgattgtccgaaagctgcccgctgtggaaacgctcggctgtgcctccgtcatttgctctgataaaacaggtacgctcacgcaaaataaaatgacggtgacgcaagtatgggcaagtggtgaaacatggcatgtgtcagggacgggctatgagccccatggtctttttacgaaagggaaaaaggaaacggacccgaaaaggcaccggagtttacatctcttgctctcatacgggctcttatgcaataattcacagttgaagcagcggacggtaaaaaaagggatgttgaaaacaaaggaaagcacagcctaccacatcgaaggcgatccgacggaaggggctctgttagttgccgccatgaaggcaggcttctcccgggaacaattagatagacagtttaaaagactgaaagaatttccgttcgaatcgacccgcaaaatgatgagcgtcgttgttgaaaatgagaaagggcagcgttttgtcgtggcgaagggtgcacccgatgtcatcttacaggtgagtaaaaaaatccgttatcgcggagagcaggaagcgttaacccccaaacgccgggaagaggtagagcggacgattcaaacgatggcatcacaggcgctacgaacgattgccgttgcctacagaccgctcaggccaaatgagtcggtagacgaagcttatgaagcagagtgtgaccttacgtttatcggtttacaagggatgatcgatcctccacgtgaagaagtgtttgattcgattgaagaatgccgtcaagcaggaattaaaaccgttatgattacaggtgatcatcgccttacagcggctgcgatagcgaaaaagcttggcattttacccgctggagggaaagtcatagatgggacggagcttaaccacttaacagatcgtaggctaaccgagatggtcgatcaaatctacgtatacgcaagagtttctcccgaacataaattgaagattgtcaaggccatgcaggagcggggccacattgtagccatgacaggcgatggagtcaacgacgctccagcgatcaaagcagcgaatatcgggattgccatggggattacgggaacggatgtagcaaaagaggcctcttcccttattttgagcgatgataactttgcgacgattcgcgccgccattcgcgaagggcggaacatttacgataacattcgcaagttcattcgctacatgcttgcgtcaaacgtaggggaaatacttgttatgctgtttgccatgttgctcggcatgcctttgccgctcgttgcgacgcaaattctttggattaatctcgtgactgatggtttgcctgcaatggcgctcgggatggatcagcccgaaggaaacgtcatgaagcggccgccccgtcatccgcgagaagggatatttgctagggggcttgcatggaaaatcgtgagccggggatttatgattggcgttgtcacattggccgctttctggctgacgttacaagcgaatccagacgatttgacaagagctcagtccgtggcctttgttacccttgtgatggctcagctcattcacgtgtttgattgccgaagtgaatattcggtttttcaccgtaacccatttgagaacaaatatttagtcctagcggtgctttcgtccgttttattaatgctgatcgtgatctattaccctccattacagcaagtgttccataccgttccgttaaccgggcgtgaatggttactcattatcggaatggctgcaattccaaccgtcgttttaggaggatttcgcttactaaaggcaaaataa

SEQ ID NO: 107686 - protein, 902 aa, Bacillus halodurans
MKWYQMGEEEVKKATGVLGADGLPQREVDKRLKRVGFNKLDEGESVSALILFFMQFKDFMVLVLLAATLISGLLGEYIDAITIILIILLNGVLGFIQERKAEKSLSALKELSAPQMVVLRDGKWLKVPAATVVPGDVVKLTSGDRVGADIRLLETASLRIEESSLTGESLPVHKHGDRMEQTDLQLGDQANMAFMGTLVTEGQGIGIVVATGMKTEMGKIAHLLQTTETVITPLQRKLEQLGKVLIAVALLLTAMVVVIGVIQGHDAYTMFLAGVSLAVAAIPEGLPAIVTVALALGVQRMIKRRAIVRKLPAVETLGCASVICSDKTGTLTQNKMTVTQVWASGETWHVSGTGYEPHGLFTKGKKETDPKRHRSLHLLLSYGLLCNNSQLKQRTVKKGMLKTKESTAYHIEGDPTEGALLVAAMKAGFSREQLDRQFKRLKEFPFESTRKMMSVVVENEKGQRFVVAKGAPDVILQVSKKIRYRGEQEALTPKRREEVERTIQTMASQALRTIAVAYRPLRPNESVDEAYEAECDLTFIGLQGMIDPPREEVFDSIEECRQAGIKTVMITGDHRLTAAAIAKKLGILPAGGKVIDGTELNHLTDRRLTEMVDQIYVYARVSPEHKLKIVKAMQERGHIVAMTGDGVNDAPAIKAANIGIAMGITGTDVAKEASSLILSDDNFATIRAAIREGRNIYDNIRKFIRYMLASNVGEILVMLFAMLLGMPLPLVATQILWINLVTDGLPAMALGMDQPEGNVMKRPPRHPREGIFARGLAWKIVSRGFMIGVVTLAAFWLTLQANPDDLTRAQSVAFVTLVMAQLIHVFDCRSEYSVFHRNPFENKYLVLAVLSSVLLMLIVIYYPPLQQVFHTVPLTGREWLLIIGMAAIPTVVLGGFRLLKAK

SEQ ID NO: 107687 - DNA, 2709 bp, Pseudomonas aeruginosa
  CDS (1)..(2709)
atgaacggcatcccacccctgtcttcccgcgacgcccatgccagcccgccgcaacgggtgctggaacgattgcacagctccgccgccggtctggacgcggacgaagccgcccgccgcctggcggcgcacggctacaaccgattgcccgcgccgaaacgccaggggccgctgctgcgcttgctgcggcagttccacaacgtcctgctgtacatgatgctgttcgcctcgctggtcaccgcgctgctcggcttctgggtggacagtgcggtaatcctcctggcggtggtggtcaacgcgctgatcggtttcgtccaggagggcaaggcggccaacgcgctggacgccatccgcgacatgctttcgctgcatgccctggtcctgcgcgacggccagcgccaggcgctggacgccgaacgcctggtaccgggcgacgtggtgctgctggcctccggcgaccgggtgccggccgacctgcggctgttcgaaacgaagaacttccatgtcgacgagtcggccctgaccggcgagtcggtgccggtggagaagggctgcgtcgcggtggccatcgacgcgctgctcggcgaccgccgttgcatggcctattccggcaccctggtgaccagcggccaggcgcgcggagtggtggtcgccaccgccggggataccgaactgggccggatcggtacgctgttgcgcgaagtccgcaccctggccactccgctgctgcgacagatcgccagcttcagtcgctggctggccctggcgatcctgctgctggccggcgccactttcgtcctcggcaccctctggcagggccagccgatggtggacatgttcatgctggtggtggcgctgaccgcctcggcgattcccgagggactgccggcgatcatgacggtgatcctcgccctcggcgtacagcgcatggcccggcgcaacgccatcgtcagccgcctgccggcggtggagacgctgggttcggtgacggtgatctgctcggacaagaccggcaccctgacccgcaacgagatgaccgtgcagcgtatcgtcaccgccgaccaggtaatcgaggtcagcggcgccggttacgcccccctgggtggtttcagccacaacggcgaaggcctcgatcccgccggacgcgacgatctgcaggagatcggtcgcgcggcgctgttgtgcaacgaggcgcgcctgcaccaggagggcgaggcatggcaactggagggcgaccccaccgaaggcgcgctgctcagcctcggcctcaagctgggcctcgatccgcaggcgctggcggcggaacggccacgcagcgatgcgattccgttcgagtccgagcatcgcttcatggccaccctgcaccacgaccacgcaggccaggcgatggtctacctgaagggcgcgccggagcgcatcctcgacatgtgcgaggctgaacgggtgggcgactcggtgcggccgctggacccggactactggcggcgcctggccaccgacaccgccgctcgcggtctgcgcctgctggccatcgcccgacgggcgatgccggcggagcagcgcacgctggatttcgccgacgtggaacatggcttcaccctgctggccctggtgggcatcatcgaccctccgcgcgaggaagccgtggccgcggtcgccgaatgccaggcggcgggtatcgcggtgaagatgatcaccggcgaccacgtcgacaccgcgcgggcgatcggcgccatgctcgggatcggcatcgaccggccggcgctgaccggcgcggagatcgagttgctcgacgaccagcgcctgcgcgaagtgctgccgggcgtcgatgtgttcgcccgcgccagccctgagcacaagctgcgcctggtgcaggccctgcaggccagcggcgaggtggtggcgatgaccggcgacggggtcaacgatgcgccggcgctgaagcgcgccgacgtcggcgtagcgatgggcaacaagggcaccgaggcggccaaggaggcggctgaggtggtcctcgccgacgacaatttcgccaccatcgccaatgccgtgcgcgagggaagggcagtctacgacaacctgaagaaattcatcctcttcatgctgccgaccaacggtggcgaggcgctgatcgtgatcgccgcgatcctgttccagttgaccctgccgatgacgccggcgcagatcctctggatcaacatggtcacctccagcaccctgggcctggcgctggccttcgatccggccgagcgcggcctgatgcagcgtccgccgcgtccgccggcggagcccctgttgtcgctgttcttcgtctggcgggtgctgctggtctcgctgctgatgatggcgggcgccctgggcctgttcctctgggagctggagcatggcaccgggctggagagcgcgcggaccatggcggtgaacagcgtggtggtgtgcgagatgttctacctgctcaacagccggcatatctacgattcggtgctcagccgcgagggcctgttcggcaaccgccaggtcttgctggcgatcgccgcctgcgtgatgctgcaactgctctatacctatgcgccgccgttgcaggcgctgttcggctcggtcggcctggccccgggcgagtgggcgcgggtgctgctggccgggctcggcctgttctgcgtcgccgaactggaaaagtggctatgtcgccgggtccgtgcccggcaggcctga

SEQ ID NO: 107688 - protein, 902 aa, Pseudomonas aeruginosa
MNGIPPLSSRDAHASPPQRVLERLHSSAAGLDADEAARRLAAHGYNRLPAPKRQGPLLRLLRQFHNVLLYMMLFASLVTALLGFWVDSAVILLAVVVNALIGFVQEGKAANALDAIRDMLSLHALVLRDGQRQALDAERLVPGDVVLLASGDRVPADLRLFETKNFHVDESALTGESVPVEKGCVAVAIDALLGDRRCMAYSGTLVTSGQARGVVVATAGDTELGRIGTLLREVRTLATPLLRQIASFSRWLALAILLLAGATFVLGTLWQGQPMVDMFMLVVALTASAIPEGLPAIMTVILALGVQRMARRNAIVSRLPAVETLGSVTVICSDKTGTLTRNEMTVQRIVTADQVIEVSGAGYAPLGGFSHNGEGLDPAGRDDLQEIGRAALLCNEARLHQEGEAWQLEGDPTEGALLSLGLKLGLDPQALAAERPRSDAIPFESEHRFMATLHHDHAGQAMVYLKGAPERILDMCEAERVGDSVRPLDPDYWRRLATDTAARGLRLLAIARRAMPAEQRTLDFADVEHGFTLLALVGIIDPPREEAVAAVAECQAAGIAVKMITGDHVDTARAIGAMLGIGIDRPALTGAEIELLDDQRLREVLPGVDVFARASPEHKLRLVQALQASGEVVAMTGDGVNDAPALKRADVGVAMGNKGTEAAKEAAEVVLADDNFATIANAVREGRAVYDNLKKFILFMLPTNGGEALIVIAAILFQLTLPMTPAQILWINMVTSSTLGLALAFDPAERGLMQRPPRPPAEPLLSLFFVWRVLLVSLLMMAGALGLFLWELEHGTGLESARTMAVNSVVVCEMFYLLNSRHIYDSVLSREGLFGNRQVLLAIAACVMLQLLYTYAPPLQALFGSVGLAPGEWARVLLAGLGLFCVAELEKWLCRRVRARQA

SEQ ID NO: 107689 - DNA, 2538 bp, Clostridium acetobutylicum
  CDS (1)..(2538)
atgattaatgaaaatagggcagcaagcggtttgtcagaagaggaggctaaaagattacgaaaaaaatatggctataatacaatacaaaaaaagaagaatatttcaatgataaagatattcttatcacagtttaacgatgttatgatatgggtacttatagccgcaactattatttcaggacttatgggagaaaaggcagatgcgttaaccataattgtaattataataatgaatgcaattattggatttgtgcaagagtttaaaacagaaaaatcattagaggcgctaaaaaaacttacagcaccaacaacaaaagtaataagaaatggaagcataagaataatggatgcagctaatttagttccaggagatttagttgttttggatacaggagatagaattcctgctgattgtatattaattgatgggacaaacatgatggtggacgaatcgctacttactggggaatctattggagtatctaagaataataaggatagcaacttgtatatgggaactacagtacttacaggaaggtgtcaggcaagagtaattaaaataggaatgacaacggagatgggcaagattgcaaatatgcttgataacatagatcaagaaaagacaccgcttaaagagaagttagcatctttaggtaaaatattagttatactgtgtatagtaatatgtgtggttgttacagtgcttggaataataagaggtgaggataaatatgaaatgttcctcttaggagtaagtttagcagttgcagcaattccagaaggacttccagctatagtaactgtagcattagccattggtgtttctagaatgcttaaaagaaatgcacttgtaagaaaacttcccgcagttgagacgctgggatgtacatctataatatgtagtgataagacaggtactttaactcaaaataagatgacagtaaaagctatgtattttaataatcagatttatgaaaaagaactatattcagaagaaagatttgaacttcttaagagaactttcatatactgtaatgattgtgattacaattttaaagaaaaaggtattgataagtgtctttttggagatccaacagaaacggcattaataagagcattttttaaagatactggaaaactaaagaagtttatttcagaggaaaagaggataagagaggaaccttttgattctaagactaaaatgatgactgtaataagcaaaggtgcaaatggaacaagtttatacttaaaaggtgctccagagagggtaatagaaaagtgtaagtatatatatataaacaataaggtggaattatttacttcaacatataaatccaaagtgaattcggtacttgaaagtatgtcaaggaaagcattaagatgcattgcttgtgcatacaaaaaggagaacataaataaagatggagacatgatttttttaggaattgcaggaatgattgatccaccaagattagaagttaaggatgctgttcttaaatgtagagttgcaggcataactccagttatgataacaggagatcataaaaatacagcatttgctatagcaaaggaattgaatatatgttcagatgtatctgaagttataagtggtgaagagcttgataagttaagcgaaaaggatttatataaaaaaacagacaaaataagagtttttgcaagagtaagtccagaacataaacttaaaattgtaagggcatttaaaaagaagaataaagttgttgcaatgacaggtgatggagtaaatgacgcaccagcaataaaagaagcagatatagggatatcaatgggagtatcaggtacagatgtaacaaaagaggcctcttcaatgatacttttggatgacaactttgctacaattgtagcagcagtagaagagggaagagttatatataataatattaggaaatttataagatatcttttgtcatgtaatttaggagaggtattaacaatgttcctatcatcagtatttaatttacaaactcctctattacctatacaaattttgcttataaatttggcaacagatggtcttccagcattagcgcttggagtagatccaccagataaggatattatggatgataagcctagagacagaaaggaaggaatcttttccagaggacttagtgaaaaaattattataagaggatgtcttataggagtttgtacaattttatcatttttggtaggcctatacatgggatttggattaaagacaagtagaacaatggcgttaggtacattaatcatgtcccaattagtacacgtttttgaatgtagatctgaaaagcactccctatttgaaataaaattatttactaatatataccttctaggagcagtcagtatttctgtaataatgcttgtatgtgttgtttatatcccatttatggaagtgctttttcatacttctgcattaagtattactcaatggattatagtactatttttctcaagctttatagcattgataaacagtctatatttgtatcataataaaagcaaaaatatataa

SEQ ID NO: 107690 - protein, 845 aa, Clostridium acetobutylicum
MINENRAASGLSEEEAKRLRKKYGYNTIQKKKNISMIKIFLSQFNDVMIWVLIAATIISGLMGEKADALTIIVIIIMNAIIGFVQEFKTEKSLEALKKLTAPTTKVIRNGSIRIMDAANLVPGDLVVLDTGDRIPADCILIDGTNMMVDESLLTGESIGVSKNNKDSNLYMGTTVLTGRCQARVIKIGMTTEMGKIANMLDNIDQEKTPLKEKLASLGKILVILCIVICVVVTVLGIIRGEDKYEMFLLGVSLAVAAIPEGLPAIVTVALAIGVSRMLKRNALVRKLPAVETLGCTSIICSDKTGTLTQNKMTVKAMYFNNQIYEKELYSEERFELLKRTFIYCNDCDYNFKEKGIDKCLFGDPTETALIRAFFKDTGKLKKFISEEKRIREEPFDSKTKMMTVISKGANGTSLYLKGAPERVIEKCKYIYINNKVELFTSTYKSKVNSVLESMSRKALRCIACAYKKENINKDGDMIFLGIAGMIDPPRLEVKDAVLKCRVAGITPVMITGDHKNTAFAIAKELNICSDVSEVISGEELDKLSEKDLYKKTDKIRVFARVSPEHKLKIVRAFKKKNKVVAMTGDGVNDAPAIKEADIGISMGVSGTDVTKEASSMILLDDNFATIVAAVEEGRVIYNNIRKFIRYLLSCNLGEVLTMFLSSVFNLQTPLLPIQILLINLATDGLPALALGVDPPDKDIMDDKPRDRKEGIFSRGLSEKIIIRGCLIGVCTILSFLVGLYMGFGLKTSRTMALGTLIMSQLVHVFECRSEKHSLFEIKLFTNIYLLGAVSISVIMLVCVVYIPFMEVLFHTSALSITQWIIVLFFSSFIALINSLYLYHNKSKNI

SEQ ID NO: 107691 - DNA, 2535 bp, Methanobacterium thermoautotrophicum
  CDS (1)..(2535)
atgtttaaaatgaaatgggctgatatgagtttagatgaagttttaaaggaacttaaaacgtccaggaagggtttaagccaggacgaggcatcgaggagacttgagaaatacgggaagaacgaactcgttgaggagaagaaggctggcccggtgaagctattcctcagccagttcatggacatactcataatactcctcatactggctgccgttgcatcctacttcgtgggtgacgtccttgactctgcagtcatcctctttgttgtggttgtaaacgccaccgttggattcatccaggagtaccgggccgagcgtgccatggagaaactcaagggtctggtatcgacagaagctgtcgtcataagggacggtgagaccctgaggatccctgcatccgagctaaccctgggagacatggtgatcatagaggagggagataatgtacccgccgacctccggttgatagaaacctatgatctccggatagacgaatcagccctcaccggggaatcaatacccgtcaggaagacacatgaaaatcctgaagatgaaagggatgttattgcattcatggactctaacgttgtctcagggcgcggcaagggggctgtgatagccaccggcatggagacctccatgggtaaaatcgccaggatgatacaggaggatgagggtaaaacacccctccaggagaagataatctccctagggaagaacctcggcctcatagcagtggtggtatgtgcccttgtatttgcaatacagttcctccgcggcctgccactggtggacacattcatgacagcagtttcccttgccgtcgcatctgtacctgagggactgccagcaatactcacactgacccttgcccttggaatgcagaggatggccaggagcaacgccatagtgaggagactccttgcagtggagacactcggttcctgctctgtgatctgcacagacaagacaggtacactgacccacaaccggatgaccgtgagggaatcagagctcacatcacctgaaatggccctcctggtatgcgcactctgcaacaacgccacatcatctgaggggggtgtgataggtgaccccacagatgctgccatactgagcttcgcagctgagaagggctacctgcgggatgaactcgaaaggaagtacccccgtctggcagagataccccttgacagtacaagaaagaggatgagcaccataaaccagctggaggacggaaggtacctcctcgtgaagggagcccccgagataatactcagaagatgccgttacatcgacagcggtgatggtgttaaggaactgactgatgaagaagtggaaaggtggctctccagactcaatgatatgacctcaagggccctccgggtgcttgcactggcctacagaaaactccctgacggtgacgatgaggagaaggacctggtgtttgtcggacttgttggtatgatggatccgccaagaagggaggctgctgatgccatagaaacctgtaagagggccggtataaaggttgttatgattacaggggatcacagggacaccgctgttgccatagcacatgaactgggactcatggacaacgggatggccctcacaggcagggagcttgatgagctcagtgacgaggagttccatgaaatcgttgaggatgtgagggtctatgcacgtgtttttcccgagcagaaggtcaggatagttgaggccctccagggcaggggccatgtggtcgccatgaccggcgacggggtgaacgatgccccggccctcaagaaggccgccatcggtgtggctatgggcagcggtacagatgtggccagggaatcctccgacatggtcctccaggatgataacttcgcaaccatcgtcagggcggttaaggagggcagaactatattcgataatataaggcgttttgttaagttccagctctcaacaaacgtgggggccatcctgacaattgtgtcagcatccctcatcaacctcccggtccccttcaacccgatacagatactctggatcaacataataatggatggaccacctgcacagtccctgggtgttgagccccctgagtcagatataatgctccgcggacctgaaagggagaatatactcccagggaggaacctcctgaggataatccttgcaggtgctgtgatggccgccggtaccctggggctctacatgtacatgctatcatcaggagcggggattgagagggccatgacagtggccttcacggtgttcgtcgtcttccagatattcaacgtcttcaactgcaagtcacggactggcctgtcaaacagggcgctgatccttgccgttgtggcctcactggccctgcagatcctcgtgatctacctttcaccccttgagggcatattcaggactgtgccactatcagtggtggactgggtgctgatagtcctggtggcatcactgatactcatcctcgaggctgtcctgagattctctgatgggagaaataaagtaaaggagaaccgtgcaaacccctga

SEQ ID NO: 107692 - protein, 844 aa, Methanobacterium thermoautotrophicum
MFKMKWADMSLDEVLKELKTSRKGLSQDEASRRLEKYGKNELVEEKKAGPVKLFLSQFMDILIILLILAAVASYFVGDVLDSAVILFVVVVNATVGFIQEYRAERAMEKLKGLVSTEAVVIRDGETLRIPASELTLGDMVIIEEGDNVPADLRLIETYDLRIDESALTGESIPVRKTHENPEDERDVIAFMDSNVVSGRGKGAVIATGMETSMGKIARMIQEDEGKTPLQEKIISLGKNLGLIAVVVCALVFAIQFLRGLPLVDTFMTAVSLAVASVPEGLPAILTLTLALGMQRMARSNAIVRRLLAVETLGSCSVICTDKTGTLTHNRMTVRESELTSPEMALLVCALCNNATSSEGGVIGDPTDAAILSFAAEKGYLRDELERKYPRLAEIPLDSTRKRMSTINQLEDGRYLLVKGAPEIILRRCRYIDSGDGVKELTDEEVERWLSRLNDMTSRALRVLALAYRKLPDGDDEEKDLVFVGLVGMMDPPRREAADAIETCKRAGIKVVMITGDHRDTAVAIAHELGLMDNGMALTGRELDELSDEEFHEIVEDVRVYARVFPEQKVRIVEALQGRGHVVAMTGDGVNDAPALKKAAIGVAMGSGTDVARESSDMVLQDDNFATIVRAVKEGRTIFDNIRRFVKFQLSTNVGAILTIVSASLINLPVPFNPIQILWINIIMDGPPAQSLGVEPPESDIMLRGPERENILPGRNLLRIILAGAVMAAGTLGLYMYMLSSGAGIERAMTVAFTVFVVFQIFNVFNCKSRTGLSNRALILAVVASLALQILVIYLSPLEGIFRTVPLSVVDWVLIVLVASLILILEAVLRFSDGRNKVKENRANP

SEQ ID NO: 107693 - DNA, 2745 bp, Streptococcus pneumoniae
  CDS (1)..(2745)
atgacagaaagagagtctgttttgcacacaatgtcaaggaggagacacatgtcaaaagaacaaaaacgccaagcgttttatactcagagccctgaagaggtcttgcaggctgtggatgcgaccgagcaaggtttgtcatcaagtgaggcggaaaagcgccttgccgaatttgggcacaatgaactcgaagaaggcgagaaacgatcaatcttggtcaaattcatcgagcaatttaaggatttgatgattatcatcctagttgcggcagcaatcttgtcagtcgtgacttctggtggggaagatatcgcagatgccattatcatcctagctgtggttatcatcaacgctgcctttggtgtttaccaagaaggaaaagctgaagaagctattgaagccctcaaatccatgtctagtccagttgcccgcgttcttcgtgatggacacatggcagagattgactctaaagaattggtaccaggcgatatcgttgcccttgaagcaggtgacgtggtaccagcggacctacgtttgatagaagccaactctcttaaaattgaagaagcagccttgacaggtgaatctgtaccagtcgaaaaagacttgtcagtcgagcttgcgacagatgctggtattggtgaccgtgtcaacatggccttccaaaactcaaacgtaacctatggtcgtgggatgggtgttgttgtcaatacaggtatgtacactgaagttggtcatattgctggtatgcttcaagatgcggatgagactgatacaccactcaaacaaaatttgaacaacctttctaaggtcttgacctatgctatcttggtcattgcccttgttacttttgtagtgggtgtcttcattcaagggaaaaatccacttggtgagttgttgacttctgttgcccttgccgttgcagccattccagaaggacttcctgctatcgttaccatcgttctttctcttggtactcaagttttggccaaacgacattccatcgttcgtaagttgccagcagttgaaacacttggttcaactgaaatcatcgcttctgataagactggtacgctgactatgaacaagatgacagtcgaaaaagtcttctacgatgcggttctacatgactcagctgatgatattgaactaggtcttgaaatgccactacttcgttcagttgtcttggccaatgatacgaaaatcgatgtggaaggtaacttgattggtgacccaaccgaaacagcctttatccaatatgccttggacaagggctatgatgtcaaaggtttcttagagaaatatcctcgtgtagctgaattgccatttgactctgaccgtaagctcatgtcaacagttcacccattgccagatggtcgtttccttgtagcagtcaagggtgcgccagaccaactcttaaaacgttgtcttcttcgtgataaggctggggatattgctccgattgatgagaaggttacaaatctcattcgtacaaacaattctgaaatggctcatcaagccttgcgtgtccttgcaggtgcttataagattatcgatagtattccagaaaatctcacttctgaagagcttgaaaatgatttaatttttactggtttgattgggatgattgaccctgaacgtcctgaagccgctgaggctgttcgtgtggctaaggaagcgggaatccgtccaattatgattacaggtgaccaccaagacacagcggaagccattgccaaacgtttgggaatcattgacgcaaacgatacagaaggtcacgttttaactggtgctgaactcaatgaactgtcagatgaagaatttgaaaaagtcgttggtcaatactctgtttatgcccgtgtgtctccagaacacaaggttcgtatcgtcaaggcttggcaaaaacaaggtaaagtcgttgccatgacaggtgacggtgtcaatgacgcgccagctctgaaaacagccgatatcggtatcggtatgggaatcactggtacagaggtttctaagggggcttctgatatgattcttgcagatgataactttgcgactattatcgtcgcagtggaagaaggacgtaaggtcttctcaaacattcaaaagactattcagtacctactttctgctaatactgctgaagtattaaccatcttcctatcaaccttgtttggttgggatgtcttacagccggttcatcttttgtggatcaacttggtaacggataccttcccagctatcgctcttggtgttgaacctgcggaacctggtgtcatgaatcataaaccacgtggacgcaaggcaagcttcttctcaggtggtgttttgagttctatcatttatcaaggtgtactccaagcagctcttgttatgagtgtttatggccttgcgattgcttacccagttcatgtgggtgacaatcatgctattcatgcagatgccctaacgatggcctttgcaacccttggtttgattcagctcttccatgcctacaatgtcaagtctgtctaccaatccatcttgacagttggcccattcaagtctaagacctttaactggtccatcttggtatcctttatccttctcatggcaacaatcgttgtagaaccgcttgaaggaatcttccacgtaaccaaactagacttgtcacaatggggaattgttatggctggaagcttctcaatgattatcatcgtcgaaatcgttaagtttattcaacgcaaactcggttttgacaagaatgcgatttaa

SEQ ID NO: 107694 - protein, 914 aa, Streptococcus pneumoniae
MTERESVLHTMSRRRHMSKEQKRQAFYTQSPEEVLQAVDATEQGLSSSEAEKRLAEFGHNELEEGEKRSILVKFIEQFKDLMIIILVAAAILSVVTSGGEDIADAIIILAVVIINAAFGVYQEGKAEEAIEALKSMSSPVARVLRDGHMAEIDSKELVPGDIVALEAGDVVPADLRLIEANSLKIEEAALTGESVPVEKDLSVELATDAGIGDRVNMAFQNSNVTYGRGMGVVVNTGMYTEVGHIAGMLQDADETDTPLKQNLNNLSKVLTYAILVIALVTFVVGVFIQGKNPLGELLTSVALAVAAIPEGLPAIVTIVLSLGTQVLAKRHSIVRKLPAVETLGSTEIIASDKTGTLTMNKMTVEKVFYDAVLHDSADDIELGLEMPLLRSVVLANDTKIDVEGNLIGDPTETAFIQYALDKGYDVKGFLEKYPRVAELPFDSDRKLMSTVHPLPDGRFLVAVKGAPDQLLKRCLLRDKAGDIAPIDEKVTNLIRTNNSEMAHQALRVLAGAYKIIDSIPENLTSEELENDLIFTGLIGMIDPERPEAAEAVRVAKEAGIRPIMITGDHQDTAEAIAKRLGIIDANDTEGHVLTGAELNELSDEEFEKVVGQYSVYARVSPEHKVRIVKAWQKQGKVVAMTGDGVNDAPALKTADIGIGMGITGTEVSKGASDMILADDNFATIIVAVEEGRKVFSNIQKTIQYLLSANTAEVLTIFLSTLFGWDVLQPVHLLWINLVTDTFPAIALGVEPAEPGVMNHKPRGRKASFFSGGVLSSIIYQGVLQAALVMSVYGLAIAYPVHVGDNHAIHADALTMAFATLGLIQLFHAYNVKSVYQSILTVGPFKSKTFNWSILVSFILLMATIVVEPLEGIFHVTKLDLSQWGIVMAGSFSMIIIVEIVKFIQRKLGFDKNAI

SEQ ID NO: 107695 - DNA, 2508 bp, Aquifex aeolicus
  CDS (1)..(2508)
atgctgaaagcacattctctttcccctgaagagatattaaggattttaaagacggacaggagggggctctctgaagaggaggctaaaaagaggctaaaaatatacggaaagaacgagatagaggaagaagaggaaagtttaattaaggtcttctttaggcaatttaacaatccctttgtttacatcctgtttgttgcaagcggtatttccgcttacataggaaaaaaagaagattccctgataattcttgctattatattcgtgaactcccttctcggtttctttcaggagttcagggccataacatctttaaaggctttaaagaaattaacggaagtaaaaacaaaagtttacagagacggcaaattaaaagtaatacccgcttccgaactcgttcccggtgacgttgtctacattcaggagggagacgtagttcctgcggatataagacttattgaaagtgtaggccttatggttgatgaatcggttttaactggtgaatccgtgccggttgagaaaaacgcggacgttgttttgcctgaagatactcccgtttacaataggtcgaacgtagtatttaaaggcacgcacgttgtaaagggatgggcagtcggagtagtttacgcaacgggaagacaaacggagtttggaaagataagtgaaaaggcaaaggaaaagtccccggaaacaccattaatgagggctttgaaaaagttttcccttgcatggatggtaatcatctttttcttactctcaatccttttccttataggtatttatcagggaagagacatttacgaggttttactcctcatagtttccgagttggtatctgcagttccagagggcttgcctctcgtaataacgttcactttagtaattggtgcgattgccctttcacggagaaaggttctcataaggtaccttcccgctacggagacgcttgggagtacaacttttatatgttctgacaagacgggaaccataacagaagggaaactaaaagtccaggaattcttcgccctgaacgagaagtttttaaacctcatttctgcactctgcaactcgtcggacggcgagagtggggatccggttgatcttgctcttctcagatggcttgaagaaaacgacatagactggaagaaactgagggaagaatacagaacggttaaagttttcccctttgatacaaaaaagaggtatatggctgtaattgttgaaaaggagggcaagtattacctgctcgtgaagggtgcctttgaaactttatcaaatttttccgaaggtatttccgaagaattaataaaagttcacgacgttcttgcggaaaacggcctgagagtcctcttcttcgcttacgccgaaattccagagcctgttgaagatatagaaagcttaaaactgaaacccgctggttttgtcggatttcttgatcctccaaaagagggtgtaaaggaagcagttgtgaacgcaagaagggcgggaataagggttatcatgataacgggcgataacttaaaaaccgcagtagcagtagcgaagcaaaccgaaatatacagggaaggtgacttagccgttgagggaaaagatctttctaaatattcagatgcggaactttacaatttgttgaagagggtttctgtcattgcaagggcacttcccgaagataagtacagggttgtaaaagtccttcaggaaaaaggggaaatagtcgcggttacgggagacggtgtgaacgacgttccagcccttaaggttgccgacataggcgtagctatgggttctggaactgaagcggcaaagagtgtagctaagatggtaataactgataacaacctaaaagttatagtggaggccgttaggtgggggaggataatagtcaggaatataaagagggcgattacttacctcctcaccacaagctttggtgaaataaccttactttcttccgcaatactgatgaaattacctctgccgctttatcccactcagatactctggataaacatagttaccgacggagttcaggataaaactttccccttcaacaaagaggaaatagacgttatgaaggaaaaacctcagaagcctgagaaggtattcctggacaaaaggctttttttaagatttttaaccggaggtttattcataggatttataaacttaattctcttcaaacacctcctaagcgtttattcatatgaggttgcagtaactataacctttacctcaatggttgtcaatcaatgggctgtaggaattcagactgtaagggattaccccttcttttacaagccttggaggaatttccagatgaacccatacatatttataggcatatttataggattgatccttcagcttttggcaatatacgttttccctaactactttcacgcagttcccctctcattagaacactggttttacgtaatcttaacaacattatcagttttcatcttcatagaaataaggaaattagtttttacaattttcagtgagaggtaa

SEQ ID NO: 107696 - protein, 835 aa, Aquifex aeolicus
MLKAHSLSPEEILRILKTDRRGLSEEEAKKRLKIYGKNEIEEEEESLIKVFFRQFNNPFVYILFVASGISAYIGKKEDSLIILAIIFVNSLLGFFQEFRAITSLKALKKLTEVKTKVYRDGKLKVIPASELVPGDVVYIQEGDVVPADIRLIESVGLMVDESVLTGESVPVEKNADVVLPEDTPVYNRSNVVFKGTHVVKGWAVGVVYATGRQTEFGKISEKAKEKSPETPLMRALKKFSLAWMVIIFFLLSILFLIGIYQGRDIYEVLLLIVSELVSAVPEGLPLVITFTLVIGAIALSRRKVLIRYLPATETLGSTTFICSDKTGTITEGKLKVQEFFALNEKFLNLISALCNSSDGESGDPVDLALLRWLEENDIDWKKLREEYRTVKVFPFDTKKRYMAVIVEKEGKYYLLVKGAFETLSNFSEGISEELIKVHDVLAENGLRVLFFAYAEIPEPVEDIESLKLKPAGFVGFLDPPKEGVKEAVVNARRAGIRVIMITGDNLKTAVAVAKQTEIYREGDLAVEGKDLSKYSDAELYNLLKRVSVIARALPEDKYRVVKVLQEKGEIVAVTGDGVNDVPALKVADIGVAMGSGTEAAKSVAKMVITDNNLKVIVEAVRWGRIIVRNIKRAITYLLTTSFGEITLLSSAILMKLPLPLYPTQILWINIVTDGVQDKTFPFNKEEIDVMKEKPQKPEKVFLDKRLFLRFLTGGLFIGFINLILFKHLLSVYSYEVAVTITFTSMVVNQWAVGIQTVRDYPFFYKPWRNFQMNPYIFIGIFIGLILQLLAIYVFPNYFHAVPLSLEHWFYVILTTLSVFIFIEIRKLVFTIFSER

SEQ ID NO: 107697 - DNA, 3186 bp, Arabidopsis thaliana (mouse-ear cress)
  CDS (1)..(3186)
atggggaaaggaggtgaagattgcgggaataagcaaactaatagttctgaattggtcaagtctgatacttttcctgcttggggtaaagatgtgtcggaatgcgaagagaagtttggtgttagtcgtgagaaaggtttgagcactgatgaggtgttgaaacggcatcagatctatggtttgaatgaattagagaagcctgagggtacttctatttttaagctgattttggaacagtttaatgatacattggttcgtattcttttggcggctgctgttatttcctttgtcttagccttctttgatggcgacgaaggtggtgagatgggtatcaccgcatttgttgagccgcttgttatttttctcatcttgattgttaatgccattgttggcatctggcaagaaactaatgctgagaaggcgttggaagctttgaaagagattcagtctcagcaagctaccgtcatgcgtgatgggactaaggtttccagtttgcctgcaaaggagcttgttcctggtgatattgtggaactgagggttggtgataaggtgcctgctgatatgcgtgtggttgctttgatcagttcaactttgagagtcgagcaggggtccttaacaggagagagtgaggcagtgagcaaaaccaccaagcacgtggatgagaatgctgatattcaaggaaagaaatgcatggtgtttgcaggaaccactgtcgtgaatgggaactgcatatgtttagttacagatactgggatgaatactgagattggaagggttcactcacagatccaggaagctgcacaacacgaggaagatacccctctgaagaaaaaacttaacgagtttggggaagttctgactatgatcattgggttaatttgtgcgttagtgtggctcatcaatgtcaaatactttctgtcatgggagtatgttgatggctggcccagaaactttaagttctccttcgagaagtgcacatattactttgagattgctgttgcactggcggttgctgcaattccagaaggtctgccagcagttattaccacatgtttggctcttggcactaggaagatggctcagaagaatgctctggttaggaagctacccagtgtggagactcttggatgcaccaccgtgatatgctctgacaaaactggaactcttacaaccaatcagatggctgtttcaaagctcgttgctatgggttcgaggatcggaactcttcgatctttcaatgttgaggggacctcgtttgatcctcgagatggaaagattgaagattggccaacgggtcggatggatgcaaatcttcagatgattgcaaaaattgctgccatttgcaacgatgctaatgttgagaaatctgatcagcaatttgtgtctaggggcatgcctactgaggcagctttgaaggttttggttgagaaaatgggatttcccgaaggattgaatgaagcttcatccgatggcaatgtcttacgttgttgtcggctatggagtgaactagaacaacggattgccacccttgagtttgaccgtgaccggaaatcaatgggagttatggtggattccagctcaggaaagaaactgctactggtcaagggtgccgtagaaaatgtattggaaaggagtacccatattcagctacttgatggttccactcgagagcttgaccaatactcaagggatcttattttacaaagcctacatgatatgtccttgagtgcattaagatgtctcggatttgcatactcagatgttccatcagattttgccacttatgatggcagtgaagaccatcctgctcatcagcaacttctcaacccatccaattattcatcaattgagtccaatctagtatttgttggatttgttggtttaagggatcctccaaggaaagaggtgcgtcaagccattgcagactgcagaacagcaggtattcgggtcatggttatcaccggagacaacaagagcacagcggaagcaatctgccgtgaaattggcgtatttgaagcagatgaagatatctcctcgagaagcttgacaggaaaagaatttatggatgttaaagatcagaagaatcatctaagacagacaggagggctcctgttctcaagggctgaaccaaaacacaaacaagagattgtcaggttactgaaagaagatggagaagtggttgccatgactggagatggagtcaatgatgctcctgccctgaagttggctgatattggtgtggctatgggcatttccgggacagaggtagcaaaggaggcatctgacttggtgttggcagatgataatttcagcaccattgttgcagctgttggtgaaggcaggtccatctataacaacatgaaggccttcatcaggtacatgatctcttccaacatcggtgaggttgcatcgatattcttgacagctgctcttggaatcccagaaggcatgatacccgttcaacttctgtgggtgaatctcgtaacagatggtcctccagctactgctttgggattcaacccccctgacaaggatattatgaaaaagcctcctcgtaggagcgatgactctcttatcactgcgtggatcctcttccgctatatggtgattggtttgtatgtgggagtagcaacggtgggagtattcatcatatggtacacacacaacagctttatgggcatagacctgagccaagacggtcacagccttgtgagctattcacagctcgcacattggggccaatgctcttcatgggaaggcttcaaagtgtctcctttcacagcaggctctcagactttctcgttcgactcaaacccttgcgactattttcagcagggtaaaatcaaggcatccacactctccctctcggtgttggtggccattgaaatgttcaactctctgaatgcactctcagaagatggcagcctggtgacgatgccaccctgggttaacccgtggctgctcctggcaatggctgtctcatttggactccactttgtgatattgtacgtcccattcttggctcaggtgtttggtattgtgccactgagcttgaacgagtggctgctagtgctggctgtgtcgctgccggtaattttgatagacgaagtgctcaagtttgtaggaaggtgcacgagtggctaccgctactcacctcgcactccctcagctaagcaaaaggaggagtaa

SEQ ID NO: 107698 - protein, 1061 aa, Arabidopsis thaliana (mouse-ear cress)
MGKGGEDCGNKQTNSSELVKSDTFPAWGKDVSECEEKFGVSREKGLSTDEVLKRHQIYGLNELEKPEGTSIFKLILEQFNDTLVRILLAAAVISFVLAFFDGDEGGEMGITAFVEPLVIFLILIVNAIVGIWQETNAEKALEALKEIQSQQATVMRDGTKVSSLPAKELVPGDIVELRVGDKVPADMRVVALISSTLRVEQGSLTGESEAVSKTTKHVDENADIQGKKCMVFAGTTVVNGNCICLVTDTGMNTEIGRVHSQIQEAAQHEEDTPLKKKLNEFGEVLTMIIGLICALVWLINVKYFLSWEYVDGWPRNFKFSFEKCTYYFEIAVALAVAAIPEGLPAVITTCLALGTRKMAQKNALVRKLPSVETLGCTTVICSDKTGTLTTNQMAVSKLVAMGSRIGTLRSFNVEGTSFDPRDGKIEDWPTGRMDANLQMIAKIAAICNDANVEKSDQQFVSRGMPTEAALKVLVEKMGFPEGLNEASSDGNVLRCCRLWSELEQRIATLEFDRDRKSMGVMVDSSSGKKLLLVKGAVENVLERSTHIQLLDGSTRELDQYSRDLILQSLHDMSLSALRCLGFAYSDVPSDFATYDGSEDHPAHQQLLNPSNYSSIESNLVFVGFVGLRDPPRKEVRQAIADCRTAGIRVMVITGDNKSTAEAICREIGVFEADEDISSRSLTGKEFMDVKDQKNHLRQTGGLLFSRAEPKHKQEIVRLLKEDGEVVAMTGDGVNDAPALKLADIGVAMGISGTEVAKEASDLVLADDNFSTIVAAVGEGRSIYNNMKAFIRYMISSNIGEVASIFLTAALGIPEGMIPVQLLWVNLVTDGPPATALGFNPPDKDIMKKPPRRSDDSLITAWILFRYMVIGLYVGVATVGVFIIWYTHNSFMGIDLSQDGHSLVSYSQLAHWGQCSSWEGFKVSPFTAGSQTFSFDSNPCDYFQQGKIKASTLSLSVLVAIEMFNSLNALSEDGSLVTMPPWVNPWLLLAMAVSFGLHFVILYVPFLAQVFGIVPLSLNEWLLVLAVSLPVILIDEVLKFVGRCTSGYRYSPRTPSAKQKEE

SEQ ID NO: 107699 - DNA, 2625 bp, Mycoplasma genitalium
  CDS (1)..(2625): transl_table=4
gtgaacagttgaacaggacttagtgaacaagcggcaattaaaagtcgtcaagaacatggtgctaattttcttcctgagaaaaaagctacccctttttggttgttatttcttcaacaatttaaaagtttagttgttattcttttactgctagctagcttgttatcgtttgtagttgctattgtcagtggtttgagaagtaactgaaactttaaccatgatctgattattgaatgggttcaaccttttattatcttattaactgtttttgccaattcactaattggttctatccaggaatttaaagcccagaaatctgctagtgctttaaagtccttgacaaagtctttcacaagggtttttaggaatggtgaattaattagcattaatgttagtgaagttgttgtaggagatattatttttgttgatgcaggagatattatccctgctgatggcaaattactacaggttaataacttacgttgtttggaaagctttttaactggtgaatcaactccagttgataagactattgatagcaatgaaaaagctactattcttgaacagacaaacttagttttttcaggggcacaagtagtttatggtagtggcgtttttcaagtggaagcagttgggattaaaacccaagttggaaaaattgctaaaactgttgatgatagtgtaactaaactctcacccttacaacaaaaactagagaagataggaaagtgatttagttggtttgggcttggtctttttgctgtagtttttcttgtccaaactgctttattaggatttgataatttcactaataactgatcaatagctttaattggtgctattgcgcttgttgttgcaattatccctgaagggcttgttacttttattaatgtgatctttgcattaagtgtgcagaaactaactaagcaaaaagccattattaagtatttatcagtaattgaaacacttggatcagtacaaattatctgtactgataaaactggtactttaacccaaaaccagatgaaagttgtcgatcacttctgttttaattcaacaacccaaactgatctagcaagagcattgtgcttgtgtaataatgcttctatttccaaagatgctaataaaacaggtgatcctactgaaattgctctcttggaatgaaaagatcgcagtcaattagatttaaaaacctattacagggtttatgaaaaagcctttgattcaatcagaaaacttatgacagttgttgttcaaaaagacaaccgcttcattgtgattgttaaaggtgctcctgatgtgttattaccattatgtaataacgttcaaaatgaagtaaagaacattgaaaacttacttgatcaaagtgctggtcaaggcttgcgtaccttagcagttgctttaaaggttttatataagtttgatcaaaacgatcagaagcaaattgatgaacttgaaaacaaccttgaattccttgggtttgttagtttacaagacccaccaagaaaagaaagtaaggaagcgattttagcgtgcaagaaagctaatataaccccaataatgattacaggggatcatcttaaaactgcaactgtaattgctaaagagttaggcattttaactttagataatcaagcagttttaggtagcgaactagatgaaaagaagatcttggattacagggtatttgctagagtaactccccaacaaaaattagccattgttagtgcttgaaaagaagcgggatttacagttagtgttactggtgatggggtgaatgacgcacctgcattaatcaagagtgatgtagggtgttgtatggggattactggggttgatattgcaaaagatgctagtgatctgattattagtgatgataatttcgctactatagtaaatggtattgaggagggtagaaaaacttttttaacttgtaaacgagttttattaaacctgtttttaacttcaattgcaggaacagttgtagttttattaggactattcatcttaggacaagtttttaaaactaatttattacaacaaggtcatgactttcaggtgtttagtcctacccaactgctaattattaacttgtttgttcatggttttcctgctgttgcattagcagtacaacctgttaaagaaaaattgatggtaggtagtttttctactaaaaatctgttttacaaccgccagggatttgatttaatctgacaatcactattcttaagctttttaactttattgttctatagcttaggaattatatatgcaattaataaccgtgatttacaaactagcggggatctaattaatcgtgctggatcaacgtgcggtttttttattttgggtgctagtgctgctttaaactcattaaacctaatggtagataaaccattgcttatgacaaacccttggttttttaagttagtttgaataggttcacttgcttctatactggtatttttattgatcatctttatcaaccctttagggttagtgtttaatgtcttgcaagatttaactaatcacccagttttaataagctatagttttgggggagttattttgtatatggggatgaatgaagttgttaaacttattagattaggttatggcaatatttaa

SEQ ID NO: 107700 - protein, 874 aa, Mycoplasma genitalium
MNSWTGLSEQAAIKSRQEHGANFLPEKKATPFWLLFLQQFKSLVVILLLLASLLSFVVAIVSGLRSNWNFNHDLIIEWVQPFIILLTVFANSLIGSIQEFKAQKSASALKSLTKSFTRVFRNGELISINVSEVVVGDIIFVDAGDIIPADGKLLQVNNLRCLESFLTGESTPVDKTIDSNEKATILEQTNLVFSGAQVVYGSGVFQVEAVGIKTQVGKIAKTVDDSVTKLSPLQQKLEKIGKWFSWFGLGLFAVVFLVQTALLGFDNFTNNWSIALIGAIALVVAIIPEGLVTFINVIFALSVQKLTKQKAIIKYLSVIETLGSVQIICTDKTGTLTQNQMKVVDHFCFNSTTQTDLARALCLCNNASISKDANKTGDPTEIALLEWKDRSQLDLKTYYRVYEKAFDSIRKLMTVVVQKDNRFIVIVKGAPDVLLPLCNNVQNEVKNIENLLDQSAGQGLRTLAVALKVLYKFDQNDQKQIDELENNLEFLGFVSLQDPPRKESKEAILACKKANITPIMITGDHLKTATVIAKELGILTLDNQAVLGSELDEKKILDYRVFARVTPQQKLAIVSAWKEAGFTVSVTGDGVNDAPALIKSDVGCCMGITGVDIAKDASDLIISDDNFATIVNGIEEGRKTFLTCKRVLLNLFLTSIAGTVVVLLGLFILGQVFKTNLLQQGHDFQVFSPTQLLIINLFVHGFPAVALAVQPVKEKLMVGSFSTKNLFYNRQGFDLIWQSLFLSFLTLLFYSLGIIYAINNRDLQTSGDLINRAGSTCGFFILGASAALNSLNLMVDKPLLMTNPWFFKLVWIGSLASILVFLLIIFINPLGLVFNVLQDLTNHPVLISYSFGGVILYMGMNEVVKLIRLGYGNI

SEQ ID NO: 107701 - DNA, 2673 bp, Bacillus subtilis
  CDS (1)..(2673)
atgaagtttcatgaaatgggacaaacagatttactagaggcaaccaatacgtccatgaaacaaggattaacagaaaaagaggtaaaaaaacgccttgacaagcatggaccaaacgagctgcaagaagggaaaaaaacttcagcgcttctcttgtttttcgcgcagttcaaagattttatggtgcttgtgcttctggcggcaacgttaatctcaggatttcttggtgaatatgtagatgcggttgcgattattgcgattgtgtttgtgaatggcatactcggtttctttcaagaaaggcgtgctgagcaatctcttcaggctttaaaagagctttcaacaccgcacgtcatggcactcagggaaggaagctggacaaagattccttctaaggaactggtgccgggtgatattgtgaaatttacgagcggggacagaattggcgcagacgttcgaattgttgaagcgagaagccttgaaatagaagaatcagcgctaaccggggaatcaatcccggttgtgaagcatgctgataaattgaaaaaaccggatgtttcactcggcgatattaccaatatggcatttatgggtacgattgtgacccgcggcagcggtgtcggggttgtcgtcgggacaggaatgaatacggctatggggaaaattgccgacatgcttgaatcggcagggacattgtcaaccccgctgcaaagaagactggagcagctcgggaagattttgattgttgttgcattgcttctgaccgtacttgtcgttgctgtcggtgttattcagggtcatgatctgtacagtatgtttttagcaggtgtctcgttagcggtagccgctattccggaggggctgccggcgattgtgacagtggcgctttcgcttggtgtacagaggatgattaaacaaaaatccattgttagaaagcttcctgctgttgaaacgcttgggtgtgcgtctatcatttgctcagataaaacagggacaatgacccaaaacaaaatgacagtgacgcatgtctggtccggagggaaaacatggagagtggcaggggccggctatgaaccgaaaggaagcttcacactaaacgaaaaagagatcagtgtcaatgaacataagccgcttcagcagatgcttctgttcggagcgctttgtaacaactccaatattgagaaaagagacggcgaatatgtgcttgacggagatccgacagagggagcgctgctcaccgcggcaagaaaaggcggtttttcaaaggagtttgttgaatctaattacagagtgattgaagaatttccgtttgattccgcacggaaaatgatgactgtcatcgtagagaatcaagacagaaagcgctatatcattacaaaaggtgcgccggatgtactcatgcagcgatcttcccgtatttattatgatggctcagcggctcttttttcaaatgaaagaaaagcagaaacagaggcggtattaagacatttggcatcacaggcgctcagaacgatagcggtcgcctacaggccgataaaagcaggcgaaacaccgtcaatggagcaggcggaaaaagatctgaccatgcttggcctttcaggtatcattgatcccccgcggccggaagtcagacaggcgattaaagaatgccgtgaagcgggaattaagaccgtcatgattacaggtgatcatgtagaaaccgctaaagcgatagcgaaagacttgcgcctccttccgaaaagcggcaaaatcatggacggcaagatgctgaatgaactttctcaagaagagctttctcatgtggtggaggatgtgtatgtatttgcccgcgtttcccctgaacataaactaaaaatcgtaaaagcctatcaggagaacgggcatattgtggcgatgacgggagacggcgtcaatgatgctcctgccattaaacaggctgatatcggcgtctctatgggcattaccgggacagatgtggccaaagaagcatcatctcttgttctcgtggatgataattttgcgacgattaaatcagcgataaaagaaggcaggaacatctacgaaaatatcaggaagtttatcagatacctgttggcgtctaacgtcggagaaatccttgtcatgctgtttgcgatgctgcttgcccttcctttaccgctggttccgattcagattttgtgggtcaacttggtgacggacggattgccggcaatggcgctcggcatggatcagccggaaggagacgtcatgaagcgcaagccccgtcatccgaaagaaggggtatttgcccgcaagctaggatggaaggtcgtttccagaggatttttaatcggagttgccactattttagcgtttatcattgtgtaccaccgcaatccggaaaacttggcttatgcccagacgatcgcgtttgccacattggtgctcgctcagcttattcacgtgtttgactgccgcagcgaaacttctgttttctctagaaatccgtttcaaaacctgtatttaatcggcgcggtattgtcatccattttgctgatgcttgtagtaatctactatccgccgcttcagccgattttccatactgtagccatcacgccgggggactggatgctcgtcatcggtatgtccgccatccctacttttttgctggcggggtcacttttaacaagaaaaaaataa

SEQ ID NO: 107702 - protein, 890 aa, Bacillus subtilis
MKFHEMGQTDLLEATNTSMKQGLTEKEVKKRLDKHGPNELQEGKKTSALLLFFAQFKDFMVLVLLAATLISGFLGEYVDAVAIIAIVFVNGILGFFQERRAEQSLQALKELSTPHVMALREGSWTKIPSKELVPGDIVKFTSGDRIGADVRIVEARSLEIEESALTGESIPVVKHADKLKKPDVSLGDITNMAFMGTIVTRGSGVGVVVGTGMNTAMGKIADMLESAGTLSTPLQRRLEQLGKILIVVALLLTVLVVAVGVIQGHDLYSMFLAGVSLAVAAIPEGLPAIVTVALSLGVQRMIKQKSIVRKLPAVETLGCASIICSDKTGTMTQNKMTVTHVWSGGKTWRVAGAGYEPKGSFTLNEKEISVNEHKPLQQMLLFGALCNNSNIEKRDGEYVLDGDPTEGALLTAARKGGFSKEFVESNYRVIEEFPFDSARKMMTVIVENQDRKRYIITKGAPDVLMQRSSRIYYDGSAALFSNERKAETEAVLRHLASQALRTIAVAYRPIKAGETPSMEQAEKDLTMLGLSGIIDPPRPEVRQAIKECREAGIKTVMITGDHVETAKAIAKDLRLLPKSGKIMDGKMLNELSQEELSHVVEDVYVFARVSPEHKLKIVKAYQENGHIVAMTGDGVNDAPAIKQADIGVSMGITGTDVAKEASSLVLVDDNFATIKSAIKEGRNIYENIRKFIRYLLASNVGEILVMLFAMLLALPLPLVPIQILWVNLVTDGLPAMALGMDQPEGDVMKRKPRHPKEGVFARKLGWKVVSRGFLIGVATILAFIIVYHRNPENLAYAQTIAFATLVLAQLIHVFDCRSETSVFSRNPFQNLYLIGAVLSSILLMLVVIYYPPLQPIFHTVAITPGDWMLVIGMSAIPTFLLAGSLLTRKK

SEQ ID NO: 107703 - DNA, 3673 bp, Bufo marinus (giant toad)
  CDS (222)..(3350)
aagcttccctgtcctgcctaaagatgtccaggtgtggggagaaccgtagctaacattggctccttgacgccacaacctctaaagctcttgcatttcggacaacctattggacgccctcctttcctggcctggtattattacctgtcttggtgtcttttgtgactttattccagatctgagcagcaggcttctgtatcagaagtaatataaaataagaaacaatgggaacagaggcaaattctgatgtctacagtacggcgattaatggaataaatgaaataggatatccagataaggaaaaggaagaagaccttggtctggaggttcagaagaagaaggagaagaaacaaaagaagaagaaaggcaagaatgttgatgatctgaaacaagaacttgatctagaagaccataaacttagtattgaagaactggaagcaaaatatgaaacaagtcttcaaggtcttaccagtgcaagagctgcagagattctggcgcgtgatggtcccaacacacttacaccgcctaaaggcactccagaaatcattaagttcctgaagcagatgattggcggcttctccctcctgctgtgggctggtgccatactctgctggattgcatatggaattctatatgctcaggatcataatacatcccgggacaacctgtacctgggtattgtccttgcagtggttgtcatcctcaccggctgttttgcctattttcaagaggctaaaagtactaacatcatggcgagcttcaatcagatgatcccgcagcaagctgttgtcactcggaatggacaaaagctagagattccggccaaggatcttgttgtaggagatctggtggatgtcaaaggaggagatcgaatcccagcagatctcaggatcatctttgctcaaggctgcaaggtggataattcatctctgactggtgagtcagaggctcaacctcgatccagtgaattcacacatgaaaaccctcttgagaccaaaaacatcgccttctactctactacctgcctggaaggtacagcaagaggtttcgtaataaatactggtgatcagacaattattggtcggattgcttcactggcatcaggagttggtaatgaaaagacccccatcgctgtggagattgaacattttgtgcatattgtggctggtgtggcagtgtctgttggagttctgtttttcatcattgcaatttgcatgggatattcggctctcaactctatcatcttccttattggcatcattgtggcaaatgtgcctgagggactccttgccactgtgacagtaactctctctttgactgcaaagcgaatggcaaaaaagaattgtcttgtgaagaacttggaggctgtggagactcttggctctacctccattatctgctccgacaaaacaggaaccctgacacaaaacagaatgactgtggcccatctctggtttgacgatcatatacacatagctgatacaagtgaagatcaatcacatcactcatttgagcagacacctgaaacatggaatgccttgtgcaagattgtgtctttgtgtaaccgtgccgagttcaaggctggacaggacgacgtgccaatcatgaagaaagtagcagttggagatgcttctgagacggccctgctaaaattctcagaggtgatcactgggaacgtgatgaacatccggagtcagaacaggaaggtctgcgaaatacctttcaattctaccaacaaattccagctatcaatacatgagactgatgatccccaagaccagagactcctgctcgtcatgaaaggtgccccagagagaatattagaaaaatgttccaccattatgattggaggcaaggagctgccactggatgagtctatgaaagattctttccagacagcttacatggagcttggaggacttggcgagagagtactaggattttgccacctctatctcccagaagaggaatatccctcatcctatgcatttgacatagaatccatgaattttccaacctcaaatctctgctttgttggacttctgtccatgatagatccacctcgttcaacagtgccagatgctgttacaaagtgtcggtctgcaggaattaaggttatcatggtaactggagaccatccaataacagcaaaggctatagctagaagtgttggtatcatttcagcggggagtgaaacagtggatgatattgccaaacgccttaacattcctgtggagcaggttaataagcgagaggcaaaggcagccgtggtgaatggtggagaactgaaggacatgtcatcggaagagctggatgacattctaactaatcatgcagagattgtatttgcccgaacctcacctcaacagaagctgatcatcgtggaaggctgtcagagacagaactatgtggttgctgtgactggtgatggcgttaatgactctccagctttgaagaaagcagacattggaattgccatgggtattgctggttcggatgctgccaaaaatgcagcagacatgattttgctggatgacaactttgcttccattgtcactggagtagaagaaggtcgtttaatctttgataatattaaaaagtcaattggctacaccctgaccaagaacgtcgctgagctctgcccattcctaatatacatcattgccgacatccctctgcctattggtaccatcaccatcctgttcattgacctcggtacagacattatcccatcagtttcatttgcctatgagaaggcagagagagacattatgaacaggaagcctcgcaggaagaatgtggaccgactggtgaaccagcagctggcgctctatgcctatctgcagattggaattattcagtctgtcggggcatttctgaattacttcactgtaatggctgagcaaggatttctgccccacactttagtgggcattcgtattgactgggaaaaaattaacaatcaggatttggaggacagttatgggcaggaatggacgttcagtcagaggcagttcctggagtggacagggtacacggccttctttgtcagtatcgttgtggaacagctggcagatcttatcattcggaagaccaggagaaattcagtctttcaacaaggtttatttagaaacaaatttctcctgatgggtttggcatcacaagtcatcatcgcagcattcctgtcttattgccctgaaatgccatatgccttgaagtttaccccattaagggctcagtactggtttgtggctgctccgtatgcacttctgatctttgtatatgatgaaatccgtaaactgttcatcaggcgttatcctggaagctggtgggacaagaacatgtattactgaggtggctgggccgtttccgtccttccctggtggtgtggattttgctgctattatacctatcctgtttgttgaacgaatcaggaagataaacttatgtattgtaaatgttctgtataaaattgtataatgaaaaagctattttaacaaaatactgtaatgtaaaaaaaaagatcattactccgttacttgcagagtactggaaatgtagattttgttaatagatgcagctttttatttcaaaaccaaactatgtcaaatcttttttcatgaatttatttttttcagtaaataaaaattggttcttatttgtaataaaaaaaaaa

SEQ ID NO: 107704 - protein, 1042 aa, Bufo marinus (giant toad)
MGTEANSDVYSTAINGINEIGYPDKEKEEDLGLEVQKKKEKKQKKKKGKNVDDLKQELDLEDHKLSIEELEAKYETSLQGLTSARAAEILARDGPNTLTPPKGTPEIIKFLKQMIGGFSLLLWAGAILCWIAYGILYAQDHNTSRDNLYLGIVLAVVVILTGCFAYFQEAKSTNIMASFNQMIPQQAVVTRNGQKLEIPAKDLVVGDLVDVKGGDRIPADLRIIFAQGCKVDNSSLTGESEAQPRSSEFTHENPLETKNIAFYSTTCLEGTARGFVINTGDQTIIGRIASLASGVGNEKTPIAVEIEHFVHIVAGVAVSVGVLFFIIAICMGYSALNSIIFLIGIIVANVPEGLLATVTVTLSLTAKRMAKKNCLVKNLEAVETLGSTSIICSDKTGTLTQNRMTVAHLWFDDHIHIADTSEDQSHHSFEQTPETWNALCKIVSLCNRAEFKAGQDDVPIMKKVAVGDASETALLKFSEVITGNVMNIRSQNRKVCEIPFNSTNKFQLSIHETDDPQDQRLLLVMKGAPERILEKCSTIMIGGKELPLDESMKDSFQTAYMELGGLGERVLGFCHLYLPEEEYPSSYAFDIESMNFPTSNLCFVGLLSMIDPPRSTVPDAVTKCRSAGIKVIMVTGDHPITAKAIARSVGIISAGSETVDDIAKRLNIPVEQVNKREAKAAVVNGGELKDMSSEELDDILTNHAEIVFARTSPQQKLIIVEGCQRQNYVVAVTGDGVNDSPALKKADIGIAMGIAGSDAAKNAADMILLDDNFASIVTGVEEGRLIFDNIKKSIGYTLTKNVAELCPFLIYIIADIPLPIGTITILFIDLGTDIIPSVSFAYEKAERDIMNRKPRRKNVDRLVNQQLALYAYLQIGIIQSVGAFLNYFTVMAEQGFLPHTLVGIRIDWEKINNQDLEDSYGQEWTFSQRQFLEWTGYTAFFVSIVVEQLADLIIRKTRRNSVFQQGLFRNKFLLMGLASQVIIAAFLSYCPEMPYALKFTPLRAQYWFVAAPYALLIFVYDEIRKLFIRRYPGSWWDKNMYY

SEQ ID NO: 107705 - DNA, 3853 bp, Catostomus commersoni (white sucker)
  CDS (135)..(3218)
tggatgatctgttgctgaatgtcgcacacatcagaaagagaagcacaaaagtgggaaagcaaatatattttaaaagggttttgaagggattggagcattgaaacaaaggggagcagtcgccgttacaagcgaaaatgggagttggggatggacgggaccagtatgagctggcagcaatgtcagagcaaagtgggaagaaaaagagcaaaaacaagaaggagaagaaagagaaagatatggatgagctgaaaaaggaagtggatttggatgatcacaaactgtctttggaagagctccaccataaatatggaacagatttgagcaaaggtctttcaaattctcgcgcagaagagatcctagcccgtgatggacctaatgccctcactccaccaccaaccactccagagtgggtcaagttctgcaagcagatgtttggaggtttctccatgctgttgtggaccggtgctgttctctgctttcttgcatatggcattctggcagcaatggaagatgagccagccaatgacaatctgtatttgggagttgtgctgtctgctgtggtcatcatcactggctgtttctcatactatcaagatgccaagagctctaagattatggactctttcaagaatttggttccacagcaagctctggttgtccgtgatggtgagaagaagcagattaatgcagaagaagtggtgatcggtgatctggtggaggtgaaaggtggtgacagaatccctgctgacctgagaatcatatcatcacatgggtgcaaggtggataactcctctctgactggagaatcagagcctcagacacggtccccagatttctcaaatgataatcctcttgagaccaagaatattgctttcttctccacaaactgtgttgaaggtactgcacgtggcattgtcatcagcactggagaccgtactgtaatgggccgtatcgccacccttgcatctggtctggaagttgggcgcacccccatctccattgaaattgagcatttcatccacatcatcacaggcgtggcagtcttcctgggtgtctctttcttactcttgtcacttgttcttggttactcctggttggaagctgttatctttcttattgggatcattgtggccaatgtgcccgaaggtcttcttgctacagtcacagtttgtctcacccttacagctaagcgtatggctaagaagaactgtttggttaagaaccttgaggcggttgaaacactgggctcaacctcaaccatctgttctgataaaactggcaccttaacgcagaatcgcatgaccgtagcccacatgtggtttgataaccagatccatgaggctgacaccacagaaaatcagagtgggacttcctttgaccgtagttcggacacctgggcgtctttggcacgcattgctgggctctgcaatagggctgtgttcctggcagagcaaattgatgtgcctattctgaagagagatgttgctggggatgcatctgagtctgctctgctgaaatgcattgagctctgctgtggatcagtaaaagaaatgagagaaaagttcaccaaagtggctgaaatcccttttaactctactaacaaataccagctgtcagtgcacaaaattccaagtggtggcaaagagtctcagcatctgctggtgatgaaaggagctccagagagaatcctggaccgctgtgctaccataatgatccaagggaaggaacaactattagatgatgaaattaaagaatcctttcagaatgcttatctggagcttgggggacttggagagagagtattgggtttctgccatttctaccttccggatgagcagtttccagaaggcttccagtttgatgctgatgatgtgaatttccccactgagaatctgtgctttgttggtcttatgtcaatgattgatccccctcgtgctgctgtacctgatgcggttggcaaatgcagaagtgcagggatcaaggttatcatggtcactggtgaccatccaatcactgccaaagccatagcaaagggtgttgggattatctctgagggcaatgagactgtggaagacattgctgctcgcttgaatatcccagtcaatgaggtcaaccccagagatgcaaaggcatgtgtggtccatggtggagacctgaaggacctctcctgtgaacagctagatgatattctgaaataccacacagagattgtatttgcaagaacatcaccacaacagaaactgatcatcgtggaggggtgtcagcgaacgggagccattgtggctgtaactggtgatggtgtgaatgattctccagcattgaagaaggctgatattggtgttgctatgggcattgctggctcagatgtatcaaaacaggctgctgacatgatcctgttagatgacaactttgcctcaattgtcacaggcgtagaggaaggccgtctgatctttgacaacttaaagaagtccattgcttacaccctgacaagtaacatccctgagatcacacccttccttttcttcattatcgccaacatccctctgcctctaggaactgttaccatattgtgtattgacctgggaacagacatgctccctgccatttccctggcatatgaggctgctgagagtgatatcatgaagagacagcccagaaacccgaaaacagacaaattagtgaatgaaagacttattagcattgcgtatggacaaataggtatgattcaggctctggctggatttttcacatactttgtcatccttgccgaaaatggctttttaccgccaaggctgctaggaattcgcatgaattgggacgacaagtatattaatgacctggaagacagttatggacaacagtggacatacgaacagagaaagattgtggagttcacttgccacactgcattcttcaccagcattgtgatcgtgcagtgggccgatttgattatctgcaagaccaggcgaaactctgtcttccagcagggaatgaagaacaaaatcctgatctttggattgtttgaagaaacagcattggctgctttcttgtcctactgccctggcatggatgtggccctcagaatgtatccactcaagcccaattggtggttctgtgccttcccctactctcttctcatttttatttatgatgaaatcagaaagctcatccttagacgtaaccctggaggttggatggagagagagacatactactagtccatcaggtcaacatgcaacctgtgtgttgtttttgtggcattaaagttacagaatttaacctctgtaaattttaaaatattttaaatagaacaagtgtagaactgaagatcctactggtactacattccattctaaagttagacttggaaaaaatgtaaacacgggaaaatattttaaaggtggaattttttcctcattaaaatgtttaactcctaaagacatgaattgtaattttgctatatatttaggaaatcatgaacactgacattaaaatgaagaatccagtcatatcagtaaccttataaaagctgttttattcaacatggtgagggtccgcacatgttagaatcacatgacctgccggatactacttgcttaatctcagtaaccatcctgttatagattacagtaatcatagctgactgtgaatacaacatttctacaacggcatctgaaactgaaaacgattgattttaaatgatggtgcatccaagctgctaggtgtcagtgtaaatccaagatgacacaaagaaaaaagttactgagtgcacctttaagtgttttatgtgaataaactatagatatggtcttattgaataaatacctgccttgtaggccacaatacacttttt

SEQ ID NO: 107706 - protein, 1027 aa, Catostomus commersoni (white sucker)
MGVGDGRDQYELAAMSEQSGKKKSKNKKEKKEKDMDELKKEVDLDDHKLSLEELHHKYGTDLSKGLSNSRAEEILARDGPNALTPPPTTPEWVKFCKQMFGGFSMLLWTGAVLCFLAYGILAAMEDEPANDNLYLGVVLSAVVIITGCFSYYQDAKSSKIMDSFKNLVPQQALVVRDGEKKQINAEEVVIGDLVEVKGGDRIPADLRIISSHGCKVDNSSLTGESEPQTRSPDFSNDNPLETKNIAFFSTNCVEGTARGIVISTGDRTVMGRIATLASGLEVGRTPISIEIEHFIHIITGVAVFLGVSFLLLSLVLGYSWLEAVIFLIGIIVANVPEGLLATVTVCLTLTAKRMAKKNCLVKNLEAVETLGSTSTICSDKTGTLTQNRMTVAHMWFDNQIHEADTTENQSGTSFDRSSDTWASLARIAGLCNRAVFLAEQIDVPILKRDVAGDASESALLKCIELCCGSVKEMREKFTKVAEIPFNSTNKYQLSVHKIPSGGKESQHLLVMKGAPERILDRCATIMIQGKEQLLDDEIKESFQNAYLELGGLGERVLGFCHFYLPDEQFPEGFQFDADDVNFPTENLCFVGLMSMIDPPRAAVPDAVGKCRSAGIKVIMVTGDHPITAKAIAKGVGIISEGNETVEDIAARLNIPVNEVNPRDAKACVVHGGDLKDLSCEQLDDILKYHTEIVFARTSPQQKLIIVEGCQRTGAIVAVTGDGVNDSPALKKADIGVAMGIAGSDVSKQAADMILLDDNFASIVTGVEEGRLIFDNLKKSIAYTLTSNIPEITPFLFFIIANIPLPLGTVTILCIDLGTDMLPAISLAYEAAESDIMKRQPRNPKTDKLVNERLISIAYGQIGMIQALAGFFTYFVILAENGFLPPRLLGIRMNWDDKYINDLEDSYGQQWTYEQRKIVEFTCHTAFFTSIVIVQWADLIICKTRRNSVFQQGMKNKILIFGLFEETALAAFLSYCPGMDVALRMYPLKPNWWFCAFPYSLLIFIYDEIRKLILRRNPGGWMERETYY

SEQ ID NO: 107707 - DNA, 5069 bp, Saccharomyces cerevisiae
  CDS (937)..(3693)
aagcttcctgaaacggagaaacataaacaggcattgctgggatcacccatacatcactctgttttgcctgaccttttccggtaatttgaaaacaaacccggtctcgaagcggagatccggcgataattaccgcagaaataaacccatacacgagacgtagaaccagccgcacatggccggagaaactcctgcgagaatttcgtaaactcgcgcgcattgcatctgtatttcctaatgcggcacttccaggcctcgagacctctgacatgcttttgacaggaatagacattttcagaatgttatccatatgcctttcgggtttttttccttccttttccatcatgaaaaatctctcgagaccgtttatccattgcttttttgttgtctttttccctcgttcacagaaagtctgaagaagctatagtagaactatgagctttttttgtttctgttttccttttttttttttttacctctgtggaaattgttactctcacactctttagttcgtttgtttgttttgtttattccaattatgaccggtgacgaaacgtggtcgatggtgggtaccgcttatgctcccctccattagtttcgattatataaaaaggccaaatattgtattattttcaaatgtcctatcattatcgtctaacatctaatttctcttaaattttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaatatgactgatacatcatcctcttcatcatcctcttcagcatcttctgtttcagctcatcagccaactcaagaaaagcctgctaagacttacgatgacgctgcatctgaatcttctgacgatgacgatatcgatgctttaatcgaagaactacaatctaatcacggtgtcgacgacgaagacagtgataacgatggtccagttgccgccggtgaagctagaccagttccagaagaatatttacaaactgacccatcttacggtttaacttccgatgaagttttgaaaagaagaaagaagtacggtttgaatcaaatggctgacgaaaaagaatctttagtcgttaagttcgttatgtttttcgtcggtccaattcaattcgttatggaagccgctgctattttggctgccggtttgtccgattgggtcgatttcggtgttatctgtggtttgttaatgttaaacgctggtgttggtttcgttcaagaattccaagctggttctattgtcgatgaattgaaaaagactttggctaacactgctgttgttatcagagacggtcaattggttgaaattccagccaacgaagtcgtcccaggtgatattttgcaattggaagatggtactgttatcccaactgatggtcgtattgtcactgaagactgtttcttgcaaatcgatcaatctgctattactggtgaatctttggctgtcgacaaacattacggtgaccaaactttctcttcttccactgttaagagaggtgaaggtttcatggttgttaccgctaccggtgacaacactttcgttggtagagctgctgctttggttaacaaagccgctggtggtcaaggtcatttcactgaagttttgaacggtattggtattatcttattggttttggtcattgccactttgttgttggtctggactgcttgtttctacagaaccaacggtattgttagaatcttgagatacactctaggtattactattattggtgtcccagtcggtttgccagctgtcgttaccaccactatggccgtcggtgctgcttacttggctaagaaacaagccattgttcaaaagttgtctgctattgaatccttggctggtgtcgaaatcttgtgttccgacaaaaccggtactttgaccaagaacaagttgtccttgcacgaaccatacactgttgaaggtgtttctccagacgacttgatgttgactgcttgtttggctgcttccagaaagaagaagggtttggatgctattgataaggctttcttgaagtctttgaagcaatatccaaaggctaaggacgctttgaccaagtacaaggttttggaattccatccatttgaccctgtctccaagaaggttactgccgttgtcgaatctccagaaggtgaaagaattgtttgtgttaagggtgctccattattcgtcttgaagactgtcgaagaagatcacccaatcccagaagatgtccatgaaaactacgaaaacaaggttgctgaattggcttctagagggttccgtgctttaggtgttgctagaaagagaggtgaaggtcactgggaaatcttgggtgttatgccatgtatggatccaccaagagacgatactgctcaaactgttagcgaagctagacacttgggtctaagagttaagatgttaactggtgatgctgttggtattgctaaggaaacttgtagacaattgggtttgggtaccaacatttacaacgctgaaagattaggtctaggtggcggtggtgacatgccaggttctgaattagctgattttgttgaaaatgccgatggtttcgctgaagttttcccacaacataaatacagagttgttgaaatcttgcaaaacagaggttacttggttgctatgactggtgatggtgttaacgatgctccatctttgaagaaggctgatactggtattgctgtcgaaggtgctactgatgctgccagatctgctgctgatattgttttcttggctcctggtctatctgctattattgatgctttgaagacctccagacaaatttttcacagaatgtactcttacgttgtttaccgtattgctttgtctctacatttggaaatcttcttgggtctatggattgctattttggataactctttggacattgatttgattgttttcatcgctattttcgctgatgttgctactttggctattgcttacgataatgctccttactctccaaagcccgttaaatggaacctaccaagattatggggtatgtctattattttgggcatagttttagctataggttcttggattaccttgactactatgttcttaccaaagggtggtattatccaaaacttcggtgctatgaacggtattatgttcttgcaaatttccttgactgaaaactggttgattttcattaccagagctgctggtccattctggtcttctatcccatcctggcaattggctggtgccgtcttcgctgtcgacatcatcgctaccatgtttaccttattcggttggtggtctgaaaactggactgatattgttactgtcgtccgtgtctggatctggtctatcggtatcttctgtgttttgggtggtttctactacgaaatgtccacttctgaagcctttgacagattgatgaacggtaagccaatgaaggaaaagaagtctaccagaagtgtcgaagacttcatggctgctatgcaaagagtctctactcaacacgaaaaggaaacctaatcctgttgaagtagcatttaatcataatttttgtcacattttaatcaacttgatttttctggtttaatttttctaattttaattttaatttttttatcaatgggaactgatacactaaaaagaattaggagccaacaagaataagccgcttatttcctactagagttattttatccacacacacaccttaaaatttttagattaaatggcatcaactcttagcttcacacacacacacacaccgaagctggttgttttatttgatttgatataattggtttctctggatggtactttttctttctttttctttcttggttattttccattttaaaatatgaaacgcacacaagtcataattattctaatagagcacaattcacaacacgcacatttcaactttaatatttttttagaaacactttatttagtctaattcttaatttttaatatatataatgcacacacactaatttattcattaattttttattgagtaggatttgaaaatatttggtatctttgcaagatgtttgtatagagggacaaagaatcgtctttattatggtcaaggctttacgtcataatagttcctgcccagctcttctataatactttaaagatctcttctcgtttgctccatttggaagtctcgcttacgtttatgcgcccatacagacactcaagatacacacttacatgaacgtatacaaatttactaacactacttgaaaatatgaaccacagtacatcatattaagacgtagtattcgatgattgaaggccgcctccgcgaatacctttactgattttgccggttaatcgcatcgaaatttcttcgtcacaagaaagcaaacaaatcgccaggccattctaccagtttccttttcttatgaagatgtaaaagctactaaccgcacattactctagatgactcagtttagtctgaccttctatactataactaccctggcgctatgatgatgagcggttcttttattgcggaaacgaaaattccgggaccggcgaaatttgcccggttttgtcgtaaccggcttcatgagtcggcttcaatagtagttgaatacttatttaaacagcagaacttaactcactcatcacgctgtttccgctgaattttctcaaaatatctaagcagtcaacaaatataaagaatattgaaatttgacagttttttgtcgctatcgatttttattatttgctgttttaaatcatggtttacactccatccaagggtccaagaactctttacgataaggtttttgatgcacatgttgtccatcaagatgaaaatggttcctttttgttgtatatcgacagacacttggttcatgaagtcacctctccacaagctt

SEQ ID NO: 107708 - protein, 918 aa, Saccharomyces cerevisiae [sequence omitted]

SEQ ID NO: 107709 - DNA, 2844 bp, Saccharomyces cerevisiae
  CDS (1)..(2844)
atgtcttccactgaagcaaagcaatacaaggagaaaccctcgaaagagtacctccatgccagtgatggcgatgaccctgcaaataattctgccgcttcttcgtcatcttcgtcttctacatcaacttccgcctcgtcatcggctgcagccgttccacggaaggccgcagccgcttctgccgctgatgattctgactcagatgaagatatagaccaattgattgatgaactacaatctaactacggtgagggtgatgaatctggtgaagaagaagtacgtactgatggggtgcacgctggccaaagggttgttcctgaaaaggacctttctacggaccctgcgtatggtttgacttcggatgaagtcgccaggagaagaaagaaatatgggttaaatcaaatggctgaggagaatgaatcgttgattgtgaagtttttgatgttcttcgtagggcctattcaattcgttatggaggctgctgctattttggctgccggtttgtctgattgggttgatgtcggtgtcatctgtgctttactgctattaaacgcatctgtcggatttattcaagaattccaggcaggttccatcgtagacgagctgaaaaagacgttggccaatactgcaacagttattagagatggccaattgatcgaaattccggctaatgaggtagttcctggtgagattttgcaattggaaagtggcacaattgctcccgcagatggtcgtattgtcactgaagactgttttttgcagatcgatcaatcggccatcactggtgaatccttagccgctgaaaagcattacggtgatgaggtgttctcctcatccactgtgaaaaccggcgaggcttttatggttgttactgccactggtgacaataccttcgtcggtagggctgccgccttagtggggcaggcttccggtgtagagggccatttcactgaagtattgaatggaattggtattatcttacttgttctagttatcgctactttgttgttggtctggaccgcatgtttctatagaacggtcggtattgtaagcattttgagatatactttgggtataaccatcattggtgtcccagtcggtttgccagcagttgttaccacgaccatggctgtcggtgcagcttacttggctaagaagcaagccattgttcaaaagttatctgctattgaatcccttgctggtgttgagattttatgttctgacaagactggtactttaaccaaaaacaagttatctttacacgaaccctacactgtcgaaggcgtttctccggacgacttgatgttgaccgcttgtttagctgcctctagaaagaagaaaggtttggatgctattgataaggcttttttgaagtcattgattgagtatccaaaagctaaagacgccctgaccaagtacaaagttttggaattccatccgttcgaccctgtctcaaaaaaggttaccgctgttgtagaatccccagaaggtgaaagaattgtttgtgtcaagggagccccattgtttgtcttgaagactgttgaagaagatcacccaattccggaagatgtgcatgaaaactacgaaaataaggttgctgaactagcttctagaggtttccgtgctttaggtgttgctagaaagagaggggaaggtcactgggaaatcttgggtgttatgccatgtatggacccccctagagatgacaccgctcaaacaatcaatgaggccagaaaccttggtttgagaatcaagatgttaaccggtgacgctgttggtatcgcgaaagaaacgtgtaggcaattaggacttggtacaaacatttataacgcagaaaggttaggtctgggaggtggaggtgatatgcctggttcagagttggctgattttgttgaaaatgccgatggtttcgcagaagttttcccacagcataaatacagagtcgttgaaatcttgcaaaacagaggttacttggttgctatgactggtgatggtgttaacgatgccccatctttgaagaaggctgatactggtattgctgtcgaaggtgctaccgatgctgccagatcagccgctgatattgttttcttggcccctggtctctctgctattattgatgccttaaagacttctagacagattttccacagaatgtactcctatgttgtttatcgtattgccctatccttacatttggagattttcctgggtttatggattgctattttaaacaactctttggatatcaatttgatcgtttttattgctattttcgcagacgttgccactttaactattgcttatgacaatgctccttatgctcctgaacctgtgaaatggaacctaccaagattatggggtatgtctattattttgggcatagttttagctataggttcttggattactttaaccaccatgttcttgcctaatggtggtattatccaaaattttggtgccatgaatggtgtcatgttcctgcagatttcactaactgaaaattggttaatttttgtcactagagctgctggcccattctggtcttccattccatcgtggcagttagccggtgccgttttcgccgttgatattattgctaccatgtttaccttatttggctggtggtctgaaaactggactgatattgtgtcagtcgttcgtgtctggatttggtccattggtattttttgtgtattgggaggattttactatattatgtccacgtctcaagcctttgataggttgatgaatggtaagtcattaaaggaaaagaagtctacaagaagtgtcgaagatttcatggctgctatgcaaagagtttctactcaacacgaaaaaagcagttag

SEQ ID NO: 107710 - protein, 947 aa, Saccharomyces cerevisiae
MSSTEAKQYKEKPSKEYLHASDGDDPANNSAASSSSSSSTSTSASSSAAAVPRKAAAASAADDSDSDEDIDQLIDELQSNYGEGDESGEEEVRTDGVHAGQRVVPEKDLSTDPAYGLTSDEVARRRKKYGLNQMAEENESLIVKFLMFFVGPIQFVMEAAAILAAGLSDWVDVGVICALLLLNASVGFIQEFQAGSIVDELKKTLANTATVIRDGQLIEIPANEVVPGEILQLESGTIAPADGRIVTEDCFLQIDQSAITGESLAAEKHYGDEVFSSSTVKTGEAFMVVTATGDNTFVGRAAALVGQASGVEGHFTEVLNGIGIILLVLVIATLLLVWTACFYRTVGIVSILRYTLGITIIGVPVGLPAVVTTTMAVGAAYLAKKQAIVQKLSAIESLAGVEILCSDKTGTLTKNKLSLHEPYTVEGVSPDDLMLTACLAASRKKKGLDAIDKAFLKSLIEYPKAKDALTKYKVLEFHPFDPVSKKVTAVVESPEGERIVCVKGAPLFVLKTVEEDHPIPEDVHENYENKVAELASRGFRALGVARKRGEGHWEILGVMPCMDPPRDDTAQTINEARNLGLRIKMLTGDAVGIAKETCRQLGLGTNIYNAERLGLGGGGDMPGSELADFVENADGFAEVFPQHKYRVVEILQNRGYLVAMTGDGVNDAPSLKKADTGIAVEGATDAARSAADIVFLAPGLSAIIDALKTSRQIFHRMYSYVVYRIALSLHLEIFLGLWIAILNNSLDINLIVFIAIFADVATLTIAYDNAPYAPEPVKWNLPRLWGMSIILGIVLAIGSWITLTTMFLPNGGIIQNFGAMNGVMFLQISLTENWLIFVTRAAGPFWSSIPSWQLAGAVFAVDIIATMFTLFGWWSENWTDIVSVVRVWIWSIGIFCVLGGFYYIMSTSQAFDRLMNGKSLKEKKSTRSVEDFMAAMQRVSTQHEKSS

SEQ ID NO: 107711 - DNA, 3251 bp, Candida albicans
  CDS (344)..(3031)
caaaactatataagtacccattacaattccattaaattaattcatattcaattgtatttccatttttccctttttcttttcttttctttttcttattcaattagtttaatattatttttttaaaataacttattcttttcaactttagaggaaataaaaaaggagaaagaaaaaaaaagactcaccccaactgaatctatcatttgttaatatttatttataccacaccatataaatacctagtttttttttttttttttgtttgttaaatcactttttttttcaatctttgtttttggttaattaatcttaagaataagggatttttatatatatataaaccatgagtgctactgaaccaaccaacgaaaaggttgataaaatcgtctccgatgatgaagacgaagacattgaccaattagtcgctgatttacaatctaacccaggtgctggtgatgaagaagaagaggaggaaaatgactcttccttcaaagccgtcccagaagaattattgcaaactgacccaagagttggtttgactgatgatgaagtcaccaaaagaagaaagagatacggtttgaatcaaatggctgaagaacaagaaaacttggttcttaaattcgtcatgttctttgttggtccaattcaattcgttatggaagccgctgctgttttggctgctggtttagaagattgggtcgatttcggtgttatctgtgctttattgttattgaatgcttttgttggttttatccaagaataccaagctggttctattgtcgatgaattgaaaaagactttggccaactctgctcttgttgttagaaacggtcaattagttgaaatcccagctaacgaagttgttccaggtgatatcttgcaattggaagacggtaccgttattccaactgatggtagaattgtttctgaagattgtttgttacaagttgatcaatctgctattactggtgaatctttagctgtcgacaaaagaagtggtgactcttgttactcttcttctactgttaagactggtgaagcctttatgattgttactgctactggtgactctactttcgtcggtagagctgctgctttggttaacaaagcttccgctggtactggtcatttcactgaagtcttgaacggtattggtactaccttgttggtctttgtcattgttactttgttggtcgtttgggttgcttgtttctacagaaccgttagaattgttccaatcttgagatacactttagccatcactattattggtgttccagttggtttgccagctgtcgttaccactaccatggctgtcggtgctgcttacttggccaagaaacaagctattgtccaaaaattgtctgccattgaatctttggctggtgttgaaatcttgtgttccgataaaaccggtactttgaccaagaacaaattgtccttgcacgaaccatacactgttgaaggtgttgaaccagatgacttgatgttgactgcttgtttagctgcttctagaaagaagaagggtttggatgccattgataaagctttcttgaaatctttgatcaactacccaagagctaaagctgctttgccaaaatacaaggttattgaattccaacctttcgatcctgtctccaagaaagttactgctattgttgaatcaccagaaggtgaaagaattatttgtgttaagggtgccccattattcgtcttaaagactgttgaagatgaccacccaatcccagaagatgtccacgaaaactaccaaaacaccgttgccgaatttgcttccagaggtttcagatctttgggtgttgccagaaagagaggtgaaggtcattgggaaattttgggtattatgccatgtatggatccaccaagagatgatactgctgccactgtcaatgaagctagaagattaggtttaagagttaagatgttaactggtgatgccgttggtattgctaaagaaacttgtcgtcaattaggtttgggtactaacatttacgatgccgacagattaggtttgtccggtggtggtgacatggctggttctgaaattgctgatttcgttgaaaatgccgatggtttcgctgaaggttttcccacaaataaatataatgccgttgaaatcttacaatctagaggttacttggttgccatgactggtgatggtgttaacgatgccccatctttgaagaaagctgatactggtattgctgtcgaaggtgctactgatgctgcccgttctgctgccgatattgttttcttggccccaggtttgtctgccattattgatgctttgaaaacttctagacaaattttccacagaatgtactcttatgttgtttaccgtattgccctttcattgcacttggaattgttcttaggtttatggattgctatcttgaacagatctttggatattaacttgattgtcttcattgccattttcgctgatgttgccactttggccattgcttatgataatgctccatacgatccaaaaccagttaaatggaacttgccaagattgtggggtatgtccattgtcttgggtattattttggctattggtacttggattactttgactactatgttgttgccaaaaggtggtattatccaaaactttggtggtttagatggtattttgttcttacaaatttccttgactgaaaattggttgattttcgtcaccagagctcaaggtccattctggtcatcaatcccatcatggcaattatctggtgctgtcttgattgttgatatcattgccacttgtttcaccttgtttggttggtggtctcaaaactggactgacattgtcactgttgtcagaacctggatttggtctttcggtgtcttctgtgtcatgggtggtgcttactacttgatgtctacttccgaagcctttgacaacttctgtaacggtagaaaaccacaacaacacactgacaagagatccttggaagatttccttgtgtctatgcaaagagtatctactcaacacgaaaaatctacttaaatttgatgatatcgttgttgatgtgaataattggagattaatattaatcgacaattgttattactaattttgcatgtttgtttttgtcattgtttttttatattttattacccccccttaaaccttctttcaacagttgaaatttgaatttgttttttaaagaagaaaatattgattcaatttaattttcactaatactgctactacaccattatattcg

SEQ ID NO: 107712 - protein, 895 aa, Candida albicans
MSATEPTNEKVDKIVSDDEDEDIDQLVADLQSNPGAGDEEEEEENDSSFKAVPEELLQTDPRVGLTDDEVTKRRKRYGLNQMAEEQENLVLKFVMFFVGPIQFVMEAAAVLAAGLEDWVDFGVICALLLLNAFVGFIQEYQAGSIVDELKKTLANSALVVRNGQLVEIPANEVVPGDILQLEDGTVIPTDGRIVSEDCLLQVDQSAITGESLAVDKRSGDSCYSSSTVKTGEAFMIVTATGDSTFVGRAAALVNKASAGTGHFTEVLNGIGTTLLVFVIVTLLVVWVACFYRTVRIVPILRYTLAITIIGVPVGLPAVVTTTMAVGAAYLAKKQAIVQKLSAIESLAGVEILCSDKTGTLTKNKLSLHEPYTVEGVEPDDLMLTACLAASRKKKGLDAIDKAFLKSLINYPRAKAALPKYKVIEFQPFDPVSKKVTAIVESPEGERIICVKGAPLFVLKTVEDDHPIPEDVHENYQNTVAEFASRGFRSLGVARKRGEGHWEILGIMPCMDPPRDDTAATVNEARRLGLRVKMLTGDAVGIAKETCRQLGLGTNIYDADRLGLSGGGDMAGSEIADFVENADGFAEGFPTNKYNAVEILQSRGYLVAMTGDGVNDAPSLKKADTGIAVEGATDAARSAADIVFLAPGLSAIIDALKTSRQIFHRMYSYVVYRIALSLHLELFLGLWIAILNRSLDINLIVFIAIFADVATLAIAYDNAPYDPKPVKWNLPRLWGMSIVLGIILAIGTWITLTTMLLPKGGIIQNFGGLDGILFLQISLTENWLIFVTRAQGPFWSSIPSWQLSGAVLIVDIIATCFTLFGWWSQNWTDIVTVVRTWIWSFGVFCVMGGAYYLMSTSEAFDNFCNGRKPQQHTDKRSLEDFLVSMQRVSTQHEKST

SEQ ID NO: 107713 - DNA, 3275 bp, Zygosaccharomyces rouxii, Candida mogii
  CDS (176)..(2938)
tcgacgatggtcatcgacgtgatgtccaggagtataaaactgctctatagaactctcatatttttgcagcctagcctaccgtggtagcaatcgcttaacctatacctttgtccttcgcttagctttcatttagcctttttcgggataggttaactaacaattcttaagtttagcaatgtctgacgagcgtattactgagaagccacctcatcagcaaccggaatctgagggggaaccagtcccagaggaggaagttgaagaggaaactgaagaggaagtcccagatgagcaatcctctgaagacgatgatattgatggattgatcgatgaacttcaatcccaagaagcgcacgaagaagcagaggaagatgatggtcctgcagcagctggtgaagctagaaagatcccagaagaattgttgcagaccgatccttctgtcggtttgtcatccgatgaagttgttaacagaagaaagaagtacggtttgaatcaaatgcgtgaagaatccgaaaacttgcttgtcaagtttttgatgttcttcatcggtccaattcaatttgttatggaagccgctgctgttttggctgccggtttagaagattgggtcgatttcggtgttatctgtggtttactgttcttgaacgctggtgttggtttcattcaagaattccaagccggttctattgtcgaggaattgaagaagaccttggcaaacactgctactgttattagagatggttccgttcaagaagcaccagctaacgaaattgttccaggtgatatcttgaagttggaagatggtaccgttatcccagctgatggtcgtttggttactgaggaatgtttcttgcaagttgaccaatcttccattactggtgaatccttggctgttgacaaacattacggtgatgaagttttctcctcttctactgttaagagaggtgaaggtttcatgattgttactgctactggtgacaacacttttgtcggtagagctgcttctttggttaatgctgctgccggtggccaaggtcactttactgaagtgttgaacggtattggtgttattttgttggttcttgttgtcattactttgttattgatctggactgcttgtttctacagaaccgtccgtattgttccaattttgagatacactctaggtatcaccattgttggtgttccagtcggtttgccagctgttgttaccactactatggctggtggtgctgcttacttggctaagaagcaagctattgttcaaaagttgtctgccattgaatctttggcaggtgtcgaaattttgtgttctgataaaaccggtactttgaccaagaacaagttgtctttgcacgaaccatacactgttgaaggtgtttcttctgatgacttgatgttgactgcctgtttggccgcttccagaaagaagaagggtttggatgctatcgataaggctttcttgaaatctttggctcaatatccaaaggccaagggtgctttgaccaagtacaaggttttggaattccacccatttgacccagtctccaagaaggttaccgctgttgttgaatctcctgaaggtgaaagaattatctgtgttaagggtgctccattgttcgttctaaagactgtcgaagaggaccacccaattccagaggatgtccatgaaaactacgaaaacaaggtcgccgaattagcttccagaggtttcagagcccttggtgttgctagaaagagaggagaaggtcactgggaaatcttgggtgttatgccatgtatggatcctccaagagacgatactgctgctactgttaacgaagctaaacgtttaggtctaagtgttaagatgttgactggtgatgctgttggtattgctaaggaaacctgtagacaattgggtctaggtaccaacatctatgacgctgagagattaggtctaggtggtggtggttccatgccaggttctgaaatgtacgattttgttgaaaatgctgatggtttcgctgaagttttccctcaacacaagtttgctgttgttgacattttgcaacaaagaggttacttggttgccatgactggtgatggtgttaacgacgctccatctttgaagaaggctgataccggtattgccgtcgaaggtgctactgatgccgcccgttctgctgctgatatcgttttcttggctcctggtctatctgctatcattgatgctctaaagacttctagacaaattttccacagaatgtacgcgtacgttgtttaccgtattgccctatctttgcacttggaaatcttcttgggtctatggattgctattttgaaccactccctagatattgatttgattgttttcattgctattttcgctgatgttgctactttggctattgcctacgataatgctccattctctccaagccctgttaagtggaacttaccaagattatggggtatgtccattatgatgggtattattttggctgctggtacttggatcactttgaccactatgttcttgccaaagggtggtatcatccaaaactttggttccattgacggtattttgttcttggaaatttctttgaccgaaaactggttaattttcattactagagccgttggtccattctggtcttctatcccatcttggcaattagctggtgcagtcttcgtggttgatgtggttgctactatgttcactttgttcggatggtggtctcaaaactggactgacattgtcactgtcgtccgtatctacatctggtctatcggtattttctgctgcttgggtggtgcttactacttgatgtctgaatcggaaacttttgatagattgatgaatggtaagccattgaaggaaaacaagtctaccagatctgttgaagacttcttggcttctatgagaagagtctctactcaacacgaaaagggtaactaatctaatttcgattaaaatttctaatccctttttttttaatacgttgagtgaaccctgatacctttttgatgtactattaattttcctttttgagctaatactattttggcattagaatttcatttggtttttcttcttcgagagtgataggaatggttcttttgattattggtaggatgaaataagagaaagtgatcttgagtgaattgggttaattttttctttaatagtattaaatcacacacacacacacacacagatacacaaaagataaaaatcacacgtacacaattgctaaagaatctttactatttcttcctacctttgataaatgaaa

SEQ ID NO: 107714 - protein, 920 aa, Zygosaccharomyces rouxii, Candida mogii
MSDERITEKPPHQQPESEGEPVPEEEVEEETEEEVPDEQSSEDDDIDGLIDELQSQEAHEEAEEDDGPAAAGEARKIPEELLQTDPSVGLSSDEVVNRRKKYGLNQMREESENLLVKFLMFFIGPIQFVMEAAAVLAAGLEDWVDFGVICGLLFLNAGVGFIQEFQAGSIVEELKKTLANTATVIRDGSVQEAPANEIVPGDILKLEDGTVIPADGRLVTEECFLQVDQSSITGESLAVDKHYGDEVFSSSTVKRGEGFMIVTATGDNTFVGRAASLVNAAAGGQGHFTEVLNGIGVILLVLVVITLLLIWTACFYRTVRIVPILRYTLGITIVGVPVGLPAVVTTTMAGGAAYLAKKQAIVQKLSAIESLAGVEILCSDKTGTLTKNKLSLHEPYTVEGVSSDDLMLTACLAASRKKKGLDAIDKAFLKSLAQYPKAKGALTKYKVLEFHPFDPVSKKVTAVVESPEGERIICVKGAPLFVLKTVEEDHPIPEDVHENYENKVAELASRGFRALGVARKRGEGHWEILGVMPCMDPPRDDTAATVNEAKRLGLSVKMLTGDAVGIAKETCRQLGLGTNIYDAERLGLGGGGSMPGSEMYDFVENADGFAEVFPQHKFAVVDILQQRGYLVAMTGDGVNDAPSLKKADTGIAVEGATDAARSAADIVFLAPGLSAIIDALKTSRQIFHRMYAYVVYRIALSLHLEIFLGLWIAILNHSLDIDLIVFIAIFADVATLAIAYDNAPFSPSPVKWNLPRLWGMSIMMGIILAAGTWITLTTMFLPKGGIIQNFGSIDGILFLEISLTENWLIFITRAVGPFWSSIPSWQLAGAVFVVDVVATMFTLFGWWSQNWTDIVTVVRIYIWSIGIFCCLGGAYYLMSESETFDRLMNGKPLKENKSTRSVEDFLASMRRVSTQHEKGN

SEQ ID NO: 107715 - DNA, 3301 bp, Arabidopsis thaliana (mouse-ear cress)
  CDS (134)..(2980)
gaaccacctaatctctcctcctctccttctctctattttgccggaatacatatgatcgagtgaaacggcggacaaagctgtcgtgttgagtactaattcgccgtcgtttttctcagtgaaggagtggtgagagatgtcgagtctcgaagatatcaagaacgagactgttgatctggaaaaaattccgattgaggaagttttccagcagctaaaatgttcaagggaaggattgacaacgcaggaaggggaggacaggattcagatctttggccccaacaagctcgaagagaaaaaggaaagcaaacttctgaagtttttggggtttatgtggaatccactttcatgggtcatggaaatggctgcaatcatggccattgctttggccaacggtgatggtaggcctccggattggcaggattttgttggtattatctgtctgttggttatcaactctaccatcagttttatcgaagaaaacaatgctggtaatgctgctgctgctcttatggctggtcttgctcctaaaaccaaggttcttagggatggaaagtggagtgaacaagaagctgctattcttgtcccaggagatattgttagcattaaattaggagacattatcccagctgatgcccgtctacttgaaggtgatcctttaaaggttgaccaatctgctctaactggagagtcccttcctgtaaccaagcacccgggtcaagaagttttctctggttcaacctgcaaacaaggagaaatcgaggcggttgttattgccactggggttcataccttcttcggtaaagctgctcaccttgtggacagcactaaccaagttggacatttccagaaggttcttacagccattgggaacttctgtatctgttccattgctatcggtatggtgattgagatcatcgtcatgtatccgatccaacgccgaaagtacagagatggaattgacaaccttttggtcctcttgatcggtggtatccccattgctatgcctacagtcttgtccgtgaccatggctattgggtctcacaggttgtctcagcaaggtgccatcaccaagcgtatgactgccattgaagagatggcaggaatggatgtcctgtgcagtgacaaaaccgggacactaaccctcaacaaattgagtgtggacaaaaacttggtcgaggttttctgcaagggtgtggagaaagatcaagtcctattatttgcagctatggcttccagggttgagaaccaggatgccattgatgcagccatggttgggatgcttgctgatccaaaggaggctagagctggaatcagggaagttcacttccttccattcaaccctgtggataagagaactgctttgacttacattgacggcagtggtaactggcacagagtcagtaaaggtgctcctgagcagatcctcgaacttgccaaagccagcaatgatcttagcaagaaggtgctctccattattgacaagtatgctgagcgtggtcttaggtcgttggctgttgctcgccaggtggtgccagagaaaacaaaggaaagcccaggtgcgccatgggaatttgttggcttgttgccactttttgatcccccaagacatgacagtgctgaaacaattcgacgggctttgaatcttggtgttaacgtcaagatgatcactggtgaccaacttgctattggtaaggaaactggtcgcagacttggaatgggaacaaacatgtatccatcttcggctcttcttggtacacacaaagacgcaaacctcgcatccattcctgttgaggagttgattgaaaaggctgatggatttgccggagtcttcccagagcacaaatacgaaattgtgaaaaagttgcaggagaggaagcatattgttggaatgactggtgatggtgtcaatgatgcccctgctctaaagaaagctgatatcggtattgctgttgctgatgctacagatgctgctcgtggtgcttcagatatcgtgctcactgagcctggactcagcgttattatcagtgctgttctcaccagcagagctattttccagagaatgaagaactatactatctatgcagtctcaatcaccatccgtattgtgtttggtttcatgcttattgctttgatatgggaatttgacttctcagccttcatggttctgatcattgccattcttaacgacggtaccatcatgacaatctcaaaggacagagttaagccatctcccacacctgatagctggaaacttaaagaaatttttgctactggagtcgttctaggaggctaccaggccatcatgactgttattttcttctgggcggcgcacaagactgactttttctcggacacattcggtgtgaggtccattagggacaataaccacgagctaatgggtgcggtgtacttacaagttagtatcattagtcaagctctgatcttcgtcacaagatcaaggagttggtcttttgttgaacgtcctggagcattgctgatgattgctttcctcattgcacaactgattgctactttgattgcggtttacgccaactgggaatttgcaaagattaggggtattggatggggatgggctggtgtgatctggctatacagtattgtcacatacttcccattggacgttttcaagtttgccattcgatacatcttgagcggaaaggcgtggctcaacttgtttgagaacaagacggctttcacgatgaagaaagattacggaaaagaagagagagaggctcaatgggcacttgctcaaaggacacttcacggtttacagccaaaagaagctgttaacatcttccctgagaaaggaagttacagagaattgtctgagatcgctgagcaagctaagagaagagctgagatcgctaggcttagggagctgcacacactcaagggacatgtggaatcagtcgtgaagctaaagggcttggacattgaaactcccagtcactacactgtgtagtaaaaccaaacatatgactgatcttcgatcctctcatgttttgtcttcttcttcttctttttttcttcaccacctcttatgattattattcacatagggagagatctttgtttattgccataactcttcccaaaccttattgttagtgttcttgtttctcaaatatgtacttttgcataatttgctcttttgaagaaacaaggcatgcctttgtgtttggcatttggcacatgcacattctcttctttgctcttattccatgagcctatgtaatcttaatcttcttctttttcgtaatccaacttttcttccggcttcttt

SEQ ID NO: 107716 - protein, 948 aa, Arabidopsis thaliana (mouse-ear cress)
MSSLEDIKNETVDLEKIPIEEVFQQLKCSREGLTTQEGEDRIQIFGPNKLEEKKESKLLKFLGFMWNPLSWVMEMAAIMAIALANGDGRPPDWQDFVGIICLLVINSTISFIEENNAGNAAAALMAGLAPKTKVLRDGKWSEQEAAILVPGDIVSIKLGDIIPADARLLEGDPLKVDQSALTGESLPVTKHPGQEVFSGSTCKQGEIEAVVIATGVHTFFGKAAHLVDSTNQVGHFQKVLTAIGNFCICSIAIGMVIEIIVMYPIQRRKYRDGIDNLLVLLIGGIPIAMPTVLSVTMAIGSHRLSQQGAITKRMTAIEEMAGMDVLCSDKTGTLTLNKLSVDKNLVEVFCKGVEKDQVLLFAAMASRVENQDAIDAAMVGMLADPKEARAGIREVHFLPFNPVDKRTALTYIDGSGNWHRVSKGAPEQILELAKASNDLSKKVLSIIDKYAERGLRSLAVARQVVPEKTKESPGAPWEFVGLLPLFDPPRHDSAETIRRALNLGVNVKMITGDQLAIGKETGRRLGMGTNMYPSSALLGTHKDANLASIPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWEFDFSAFMVLIIAILNDGTIMTISKDRVKPSPTPDSWKLKEIFATGVVLGGYQAIMTVIFFWAAHKTDFFSDTFGVRSIRDNNHELMGAVYLQVSIISQALIFVTRSRSWSFVERPGALLMIAFLIAQLIATLIAVYANWEFAKIRGIGWGWAGVIWLYSIVTYFPLDVFKFAIRYILSGKAWLNLFENKTAFTMKKDYGKEEREAQWALAQRTLHGLQPKEAVNIFPEKGSYRELSEIAEQAKRRAEIARLRELHTLKGHVESVVKLKGLDIETPSHYTV

SEQ ID NO: 107717 - DNA, 3226 bp, Arabidopsis thaliana (mouse-ear cress)
  CDS (48)..(2897)
accttcacttgctctcttttttccgaagaatctggcacagagagaagatggcgagtggcctcgaggatatcgtgaacgagaatgttgatttggagaaaatacctattgaggaagtgttccagcagttgaaatgcagcagagaaggtttatctggagcagaaggagaaaacagactccagatctttggccccaacaaactcgaggagaagaaggaaagcaagttactcaagttcttgggttttatgtggaaccctctctcttgggtcatggaagcagctgcaatcatggctattgccttggctaatggcggtggaaagccaccggattggcaagattttgtcggtatcgtttgtcttttggttatcaattcaactatcagttttgtcgaagaaaacaatgctggaaatgctgctgctgctcttatggctggtcttgctcccaaaactaaggttctaagagatggcaaatggtcagagcaagaagcttctattcttgttcctggagatattgtgagcatcaagcttggtgacatcattcctgctgatgcacgtcttcttgaaggtgatcctttaaaagtcgaccaatctgctttgaccggagaatctcttcccgcaacgaaaggtccaggggaagaagttttctccggttctacctgcaagcaaggtgagattgaagcggttgtgatagccactggagtccatactttcttcggtaaagcggctcatctagtcgacagcacaaaccaagttggacatttccagaaagttcttacggcgattggaaacttctgcatatgttccatagctgttggtattgcgattgagatcgttgtcatgtatccgatccagcgcagacactacagagacggaatcgacaatcttcttgttcttttgattggtggtatccccattgcaatgcctactgtcttgtctgtcacaatggctattggatctcacaagttgtctcaacaaggagctatcacaaaacgaatgaccgccattgaagaaatggctggtatggatgttctgtgcagcgataaaaccgggactctcacgctaaacaagcttagtgttgacaagaatcttattgaggtttattgtaaaggcgttgagaaagatgaagttttgctttttgctgctagagcttcaagagttgagaaccaagatgctattgatgctgctatggttggaatgctcgctgatccaaaagaggcaagagctggaatcagagagattcacttcctaccattcaatccagttgataagcgaaccgctttgacgtttatcgacagcaacggaaactggcaccgagtaagcaaaggagctcccgagcagattcttgatctctgtaacgcgagagctgatctgaggaagagagtccactctacaatcgataagtacgctgagcgtggacttaggtcattagctgtttcaagacagactgtaccagagaaaacaaaagaaagctctggtagtccatgggaatttgttggtgtgttgcctctgtttgatcctccaagacatgatagtgccgaaaccattagaagagctctagacctcggtgtcaatgtcaagatgattactggtgatcaacttgctattgcgaaagagacaggacgtagacttggaatgggatcaaacatgtacccatcctcttctttactcggtaaacacaaagacgaagccatggctcacattcctgttgaggatttgattgagaaagctgatggctttgctggagtcttcccagagcacaaatacgaaattgtgaagaagttgcaagaaaggaagcatatctgtggtatgactggagatggagtgaatgacgctccagcattgaagaaagcggatataggtatcgctgtggcggatgcaactgacgctgcacgaggtgcttctgatattgtcctcaccgagccaggtctcagtgtgatcatcagcgcggttctaaccagtagagccatcttccagagaatgaagaactacacaatatatgcagtctcaattaccattcgtatagtgtttgggtttatgctcattgctctaatatggaagttcgacttttcaccattcatggttttgatcattgctatattaaacgatggaaccatcatgactatctcaaaggacagagtcaagccttctccaacaccagatagctggaaactcaaagaaatcttcgcaaccggcgttgttcttggaggctacatggctataatgactgttgttttcttctgggccgcatacaaaaccgatttcttcccgagaacattccacgtgagagacttgagaggcagtgaacatgagatgatgtctgctttatacttacaagtcagtattgtgagccaagctcttatattcgtcactcgatctagaagctggtcttttacagaacgacctggatatttcttgctaattgctttctgggtagcacaattgattgcaacggctattgcggtttacggtaattgggaatttgcaagaatcaaaggaataggatggggatgggctggagtaatctggctttacagtattgtcttctactttccattagacataatgaaattcgcaatccgttacatactagccggaacagcctggaagaatatcattgacaacaggactgcgtttaccactaagcaaaactatggaatagaggagagggaagcacaatgggctcatgcacaaaggactttacacggtcttcagaacactgaaacagccaacgttgtcccggagagaggtggttacagagaactgtctgagattgcaaatcaagccaagagacgagctgagatcgcaaggcttagggaacttcatacgcttaaaggacatgtagagtcagtggtgaagctaaagggactagacattgagacagctggtcactacaccgtttaataaagatttaacaagaagatgattaaggaagaagaagatccttttgtttaagagatgataatgatgatgattttataacaagagaataaggttttttttctgtgtatgttaagttcctctaaactcctggggtttttcttccttccttattcatggttttagactttaattataaccatgtgtttttgtttcccctctcttgaataaaaaagagaagatactaatatcataggtttaatacgtttatgttttataaaagttcaatagatattgtttttggatattatgtgaacataacaatatttataaattcacctttcaattttctt

SEQ ID NO: 107718 - protein, 949 aa, Arabidopsis thaliana (mouse-ear cress)
MASGLEDIVNENVDLEKIPIEEVFQQLKCSREGLSGAEGENRLQIFGPNKLEEKKESKLLKFLGFMWNPLSWVMEAAAIMAIALANGGGKPPDWQDFVGIVCLLVINSTISFVEENNAGNAAAALMAGLAPKTKVLRDGKWSEQEASILVPGDIVSIKLGDIIPADARLLEGDPLKVDQSALTGESLPATKGPGEEVFSGSTCKQGEIEAVVIATGVHTFFGKAAHLVDSTNQVGHFQKVLTAIGNFCICSIAVGIAIEIVVMYPIQRRHYRDGIDNLLVLLIGGIPIAMPTVLSVTMAIGSHKLSQQGAITKRMTAIEEMAGMDVLCSDKTGTLTLNKLSVDKNLIEVYCKGVEKDEVLLFAARASRVENQDAIDAAMVGMLADPKEARAGIREIHFLPFNPVDKRTALTFIDSNGNWHRVSKGAPEQILDLCNARADLRKRVHSTIDKYAERGLRSLAVSRQTVPEKTKESSGSPWEFVGVLPLFDPPRHDSAETIRRALDLGVNVKMITGDQLAIAKETGRRLGMGSNMYPSSSLLGKHKDEAMAHIPVEDLIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMLIALIWKFDFSPFMVLIIAILNDGTIMTISKDRVKPSPTPDSWKLKEIFATGVVLGGYMAIMTVVFFWAAYKTDFFPRTFHVRDLRGSEHEMMSALYLQVSIVSQALIFVTRSRSWSFTERPGYFLLIAFWVAQLIATAIAVYGNWEFARIKGIGWGWAGVIWLYSIVFYFPLDIMKFAIRYILAGTAWKNIIDNRTAFTTKQNYGIEEREAQWAHAQRTLHGLQNTETANVVPERGGYRELSEIANQAKRRAEIARLRELHTLKGHVESVVKLKGLDIETAGHYTV

SEQ ID NO: 107719 - DNA, 2763 bp, Neurospora crassa
  CDS (1)..(2763)
atggcggaccactcggccagcggcgctcctgcgctgtcgaccaacatcgagagcggaaagttcgacgagaaggcggcggaggctgccgcttaccagcctaagcccaaggttgaggacgatgaggatgaggacatcgatgccctcattgaggatctcgagtcccatgatggacacgatgctgaggaggaagaagaggaggccactcctggtggcggccgtgttgtccccgaggacatgctccagactgacacccgtgtcggtctcacatccgaggaggttgtccagcgccgtcgcaagtacggtctcaaccagatgaaggaggagaaggagaaccacttcctcaagttcctcggtttcttcgtcggtcccattcagttcgtcatggagggtgctgccgtccttgctgctggtctcgaagactgggttgatttcggtgtcatctgcggtttgttgcttcttaacgccgttgtcggtttcgttcaggaattccaggctggttctatcgtcgacgagttgaagaagactcttgctctcaaggctgtcgttctccgtgatggtactctcaaggagattgaggcccccgaggtcgttcccggtgatatcctccaggttgaggagggtaccattatccccgctgatggtcgcatcgtcaccgatgatgctttcctccaggttgatcagtctgctcttaccggcgagtctcttgctgtcgacaagcacaagggtgaccaggtcttcgcttcctccgctgtcaagcgtggtgaggctttcgtggtcatcaccgccaccggtgacaacaccttcgtcggtcgtgccgctgccctcgtcaacgctgctagcggtggctctggtcacttcactgaggttctgaacggtatcggtaccattctcctcatcctcgtcatcttcactctcctcatcgtctgggtttcctcgttctaccgttccaaccccatcgtccagatcctcgagttcacccttgccatcaccatcatcggtgtccccgtcggtcttcccgctgtcgtcaccaccaccatggctgtcggtgccgcctacctcgccaagaagaaggccatcgtccagaagctctccgctatcgagtcccttgctggcgtcgagattctctgctctgacaagactggtaccctcaccaagaacaagctctccctccacgacccctacaccgtcgctggtgtcgaccccgaggatctcatgcttactgcctgcttggccgcttcccgcaagaagaagggtattgatgccatcgacaaggctttcctcaagtccctcaagtactacccccgcgccaagtccgttctctccaagtacaaggttctccagttccaccccttcgaccccgtctccaagaaggtcgtcgccgttgtcgagtctccccagggtgagcgcatcacttgcgtcaagggtgcccctcttttcgttttgaagactgtcgaggaggaccaccccatccccgaggaggttgaccaggcctacaagaacaaggttgctgagttcgctacccgtggtttccgttctcttggtgttgcccgcaagcgtggcgagggctcttgggagattctcggtattatgccctgcatggaccctccccgtcacgatacctacaagactgtctgcgaggccaagactctcggtctctccatcaagatgcttactggtgatgccgtcggtattgctcgcgagacttctcgccagctcggtctcggtaccaacatctacaacgctgagcgcctcggtcttggtggtggtggtgacatgcccggctctgaggtctacgacttcgttgaggctgccgatggtttcgccgaggtcttcccccagcacaagtacaacgtcgtcgagattcttcagcagcgtggctaccttgttgccatgactggtgacggtgtcaacgatgctccctcgctcaagaaggccgatactggtattgctgtcgagggttcctccgatgctgcccgctccgctgccgatatcgtcttccttgcccctggtctcggtgccatcattgatgccctcaagacttctcgccagattttccaccgcatgtacgcctacgttgtctaccgtatcgctctgtctatccacttggagatcttcctcggtctctggatcgccattctcaaccgttccctcaacattgagcttgttgtcttcatcgccattttcgccgatgttgccacccttgccattgcctacgacaacgccccctactcgcagacccccgtcaagtggaaccttcccaagctctggggtatgtccgtcctcctcggtgtcgtccttgccgtcggtacctggatcactgtcaccaccatgtacgctcagggtgagaacggcggtatcgtccagaacttcggtaacatggacgaggtcctcttcctccagatctctctcactgagaactggctcatcttcatcactcgtgccaacggtcccttctggtcctctatcccctcgtggcagctcagcggtgctatcttcctcgttgatatccttgccacctgcttcaccatctggggttggttcgagcactccgacacctccatcgtcgccgttgtccgtatctggatcttctccttcggtatcttctgcatcatgggcggtgtctactacatcctccaggacagcgttggcttcgataaccttatgcacggcaagtcccctaagggcaaccagaagcagcgctcgcttgaggactttgttgtctctctccagcgtgtctctactcagcatgagaagtcgcaataa

SEQ ID NO: 107720 - protein, 920 aa, Neurospora crassa
MADHSASGAPALSTNIESGKFDEKAAEAAAYQPKPKVEDDEDEDIDALIEDLESHDGHDAEEEEEEATPGGGRVVPEDMLQTDTRVGLTSEEVVQRRRKYGLNQMKEEKENHFLKFLGFFVGPIQFVMEGAAVLAAGLEDWVDFGVICGLLLLNAVVGFVQEFQAGSIVDELKKTLALKAVVLRDGTLKEIEAPEVVPGDILQVEEGTIIPADGRIVTDDAFLQVDQSALTGESLAVDKHKGDQVFASSAVKRGEAFVVITATGDNTFVGRAAALVNAASGGSGHFTEVLNGIGTILLILVIFTLLIVWVSSFYRSNPIVQILEFTLAITIIGVPVGLPAVVTTTMAVGAAYLAKKKAIVQKLSAIESLAGVEILCSDKTGTLTKNKLSLHDPYTVAGVDPEDLMLTACLAASRKKKGIDAIDKAFLKSLKYYPRAKSVLSKYKVLQFHPFDPVSKKVVAVVESPQGERITCVKGAPLFVLKTVEEDHPIPEEVDQAYKNKVAEFATRGFRSLGVARKRGEGSWEILGIMPCMDPPRHDTYKTVCEAKTLGLSIKMLTGDAVGIARETSRQLGLGTNIYNAERLGLGGGGDMPGSEVYDFVEAADGFAEVFPQHKYNVVEILQQRGYLVAMTGDGVNDAPSLKKADTGIAVEGSSDAARSAADIVFLAPGLGAIIDALKTSRQIFHRMYAYVVYRIALSIHLEIFLGLWIAILNRSLNIELVVFIAIFADVATLAIAYDNAPYSQTPVKWNLPKLWGMSVLLGVVLAVGTWITVTTMYAQGENGGIVQNFGNMDEVLFLQISLTENWLIFITRANGPFWSSIPSWQLSGAIFLVDILATCFTIWGWFEHSDTSIVAVVRIWIFSFGIFCIMGGVYYILQDSVGFDNLMHGKSPKGNQKQRSLEDFVVSLQRVSTQHEKSQ

SEQ ID NO: 107721 - DNA, 3365 bp, Torpedo californica (Pacific electric ray)
  CDS (121)..(3189)
catttcatccggttccggtggtggaggaggaggttcgggccacgtggggcaaactgcttcaccttcataatttaattattttaaacttttatttataatctagtcgcatttggaaggaaaatggggaaaggggctgcaagtgagaagtatcagcccgcagcaacatcagaaaatgccaagaattcaaagaaaagcaagtcgaagactacggatctagatgaacttaagaaagaagtgtcgttggatgatcataaactgaatttggatgaactacaccagaaatatggtacagacctgacacagggtctcacgcctgctcgtgcaaaagagattcttgctcgtgatggccctaatgcactgacgcctcctcccacaactcctgagtggataaagttctgtaggcagctctttggtggcttctcaatcctcctgtggactggagcaattctttgctttctcgcctatggtatccaggttgcaaccgtggataacccagcaaatgataatttgtacctcggagttgtgttgtccactgtggtcataataactggttgtttctcgtactaccaagaagctaagagctcaaaaatcatggattctttcaagaacatggtaccccagcaagctctggttatcagagatggagaaaagagtagtattaatgctgagcaggtggttgttggagatctggtagaggtaaaaggtggtgatcgtatccctgcagatttgcgaataatctctgcatgtagttgcaaggtggataattcttcattaacaggagaatctgaacctcagagtagatcccctgaatattccagtgaaaatcccctggagacaaaaaacatagctttcttctcaaccaattgtgttgaaggtactgctcgaggtattgtcatcaatataggtgaccatactgttatgggcaggattgccactttagcgtctggactggaagttggacagactccaattgctgctgagattgaacatttcatccacatcattactggagtggcagttttccttggtgtgtccttcttcattctctcactcattctgggatacacctggcttgaagcagtcatcttcttgattggaatcattgttgccaatgtgccagaaggattacttgctactgtcacggtatgcctaaccctgacagcgaaacgtatggcacggaaaaactgcctggtgaagaatcttgaagctgtggagacactaggatccacctcaaccatttgctcagacaaaactggaaccttaacacaaaatcggatgactgtcgcccacatgtggtttgacaaccaaattcatgaagctgatacaactgaaaaccagagtggaatttcttttgacaagacttctctatcttggaatgcactttcccgcattgctgcattatgcaaccgggcagttttccaggcaggacaagacagtgtgccaatattgaagagaagtgttgctggagatgcctctgaatccgctctcttgaagtgtattgagttgtgttgtggatcagtttcgcaaatgagggatcgcaacccgaagattgtggaaataccattcaactccaccaacaaatatcagctctctatacatgagaatgacaaagctgacagccgctacctgttggtgatgaagggagcaccagaacggattcttgaccgctgctccactatccttctgaatggcgaagataagccactgaatgaggagatgaaggaagctttccagaatgcttacttggagctgggtggcttgggggagagagtgctagggttctgccatttgaaactctcgaccagtaagtttcctgaagggtatccgtttgatgtggaagagccaaattttccaatcactgatctttgctttgttggactgatgtctatgattgatccaccccgtgctgctgtaccagatgccgttggcaagtgcaggagtgctgggatcaaggttattatggtaactggtgaccatcctatcactgctaaagccattgcaaaaggtgtagggatcatctcagaaggaaacgagactgtagaagacattgctgcacgcctgaatattcctgtcaatcaggttaaccccagggatgccaaagcgtgtgttgtccacggcacagatcttaaagatttgagccatgaaaatttggatgatattttacactatcatactgagatagtctttgctcgaacttctcctcagcagaaactgattatcgtggagggctgccagcgtcagggtgccattgtagctgtgacaggtgatggtgtgaatgactctcctgctttgaagaaagctgatattggtgttgctatgggtattgctggttctgatgtctccaaacaagctgctgacatgatactgttagatgataactttgcctccattgtcactggcgtggaagaaggtcgtttgatttttgataacctaaagaaatctattgcatacaccttgaccagcaacatccctgaaattacacccttcctggtattcatcatcgcaaatgtcccactgccacttggaactgttaccatcctctgtattgatctgggtactgacatggtccctgccatctctctcgcttatgaacgtgctgaaagtgatataatgaagagacagccacgtaatcctaaaacggacaaattggtgaacgagagattgatcagtatggcatatggacaaataggaatgatccaggccttgggtggttttttctcatattttgtgattttggctgagaatggattcctcccaattgatctaattggaatacgtgaaaaatgggatgagttgtggacgcaggacctagaagacagttatggccaacaatggacttatgaacagcggaaaattgtcgaatatacctgtcacacatcattctttgtcagcattgtgatagtgcagtgggctgacttgattatctgcaagaccagaagaaactcaatctttcaacagggcatgaagaacaagattcttatctttggattgtttgaagagactgcacttgctgcttttctttcatacactcctggcactgatatagcactcaggatgtacccactcaaacccagctggtggttctgtgcctttccatacagtcttataatatttctttatgatgaagcacgaaggttcatcctccgtaggaatcctggaggttgggtggaacaagaaacatattattagaagaacaaatgctaatacaccgacagtttttgtctgccttaactgttaaacatttactaaagtgctaatagtggtgagtggagatgaactgttttgtaagaaacaaaactgaaacagttggtagttttatataaactttttacgtataactaaaataaattggattatcaatttgt

SEQ ID NO: 107722 - protein, 1022 aa, Torpedo californica (Pacific electric ray)
MGKGAASEKYQPAATSENAKNSKKSKSKTTDLDELKKEVSLDDHKLNLDELHQKYGTDLTQGLTPARAKEILARDGPNALTPPPTTPEWIKFCRQLFGGFSILLWTGAILCFLAYGIQVATVDNPANDNLYLGVVLSTVVIITGCFSYYQEAKSSKIMDSFKNMVPQQALVIRDGEKSSINAEQVVVGDLVEVKGGDRIPADLRIISACSCKVDNSSLTGESEPQSRSPEYSSENPLETKNIAFFSTNCVEGTARGIVINIGDHTVMGRIATLASGLEVGQTPIAAEIEHFIHIITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTENQSGISFDKTSLSWNALSRIAALCNRAVFQAGQDSVPILKRSVAGDASESALLKCIELCCGSVSQMRDRNPKIVEIPFNSTNKYQLSIHENDKADSRYLLVMKGAPERILDRCSTILLNGEDKPLNEEMKEAFQNAYLELGGLGERVLGFCHLKLSTSKFPEGYPFDVEEPNFPITDLCFVGLMSMIDPPRAAVPDAVGKCRSAGIKVIMVTGDHPITAKAIAKGVGIISEGNETVEDIAARLNIPVNQVNPRDAKACVVHGTDLKDLSHENLDDILHYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLVFIIANVPLPLGTVTILCIDLGTDMVPAISLAYERAESDIMKRQPRNPKTDKLVNERLISMAYGQIGMIQALGGFFSYFVILAENGFLPIDLIGIREKWDELWTQDLEDSYGQQWTYEQRKIVEYTCHTSFFVSIVIVQWADLIICKTRRNSIFQQGMKNKILIFGLFEETALAAFLSYTPGTDIALRMYPLKPSWWFCAFPYSLIIFLYDEARRFILRRNPGGWVEQETYY

SEQ ID NO: 107723 - DNA, 3321 bp, Nicotiana plumbaginifolia (curled-leaved tobacco)
  CDS (106)..(2964)
ctaaaaaaaaatctgccgttcaatgatttataccgagtgaaatcaatcaatcaatcgttttcgtttggtgttttgtcgttggtttgatttttccgtggagcagagatggcaaaagctatcagcctcgaggagatcaaaaatgagactgttgatctggagaaaatccccattgaagaagtgtttgaacagctgaaatgtacccgggagggtctgagtgccgacgaaggagccagcaggcttcaaatctttggacccaacaagttggaagagaaaaacgaaagcaaaatactcaagttccttgggtttatgtggaatcctctctcatgggtcatggaagctgctgctgtcatggcaattgcactggctaatggagatggaaagcccccggattggcaagactttattggtatcatttgtttgctggtgatcaattcaactatcagttttattgaagaaaacaatgctggaaatgctgctgcagctcttatggctggacttgcacccaaaacgaaggtgcttagagatgggcgttggagtgaacaggaagccgctattctggttccaggggatattattagtgtcaaattgggagacatcattcctgctgatgctcgtcttcttgaaggcgatcctttaaagattgatcaatctgctcttactggagaatctcttcctgtgaccaagaatcctggggatgaagttttctctggctcaacttgcaaacaaggtgaacttgaagctgtagttattgctactggagttcacactttcttcgggaaggcagcacatcttgttgacagcaccaacaatgttgggcatttccagaaagtgctaactgccatcggaaacttttgtatctgttcaattgctattggtatgctcgttgagattatagtcatgtacccaattcagcacaggaagtacagggatggaattgacaatctgttggtgctcttgattggaggcattcccattgctatgccaactgtgttgtcagtcactatggctattggatcacataggctctcccagcaaggtgccatcaccaagagaatgactgcaattgaagagatggctggaatggatgtgctgtgcagtgacaagactggtaccttgactctcaacaagttgagcgtcgacagaaacttggtcgaggtgtttgcaaagggagtagataaagagtacgtgctcctccttgccgcaagggcctctagagtagaaaatcaggatgcaattgatgcttgcatggtcggaatgcttgcagatccaaaagaggcacgagccggtatcagggaggtgcatttcttgcccttcaatccagtggacaagagaactgctttaacatatattgacaacaataacaactggcatcgtgccagcaagggagctcctgagcagattttggacctttgtaacgctaaggaagatgtcaggagaaaggttcactcaatgatggataaatacgccgagcgtgggttgagatcattggctgtcgctagaaggacagtaccagagaaatcaaaagagagccctggtggccgatgggaatttgtaggattgctacccctctttgatcctcccaggcatgatagtgctgagaccatccgtagagctctcaaccttggtgtaaatgttaagatgatcactggggatcaattggctattgctaaggagactggccgtaggcttggaatgggaacaaacatgtacccatcagcatctctacttggtcaagacaaggattcagccattgcttcacttccaatagaagaattaatcgagaaggcagatggatttgctggagtatttcccgagcacaagtatgaaattgtgaaaaagttgcaagagagaaagcacattgtgggaatgaccggcgatggtgtcaacgatgctcctgctttgaagaaggcagatatcggaattgctgttgcagatgctacggatgctgcacgaggcgcttctgacatcgtgctcactgaaccaggtctaagtgttatcattagtgctgtgttgaccagtagagctattttccagaggatgaagaattacacaatatatgcagtttccatcacaatccgtattgtgtttggtttcatgttcattgctctgatatggaagtacgacttctctgcatttatggttttgatcattgccatcctaaacgacggaaccattatgacaatctcaaaggatagagtgaaaccatctccaatgcccgatagctggaaattgaaagaaatctttgcaactggtgttgttcttggaggttaccaggcactgatgactgttgttttcttttgggccatgcatgacactgatttcttctcggacaaatttggtgttaagtcacttaggaatagtgatgaagaaatgatgtctgctttgtacctgcaagtgagtattatcagccaggctttgattttcgtgacccgttcacgcagctggtccttccttgaacgcccgggaatgctgttagttattgctttcatgattgcccagctggttgccactttaattgctgtatatgccaactgggcttttgcaagagtcaaaggatgtggctggggatgggctggtgtcatctggctttacagcattattttctacctcccacttgacataatgaaatttgccatccgctacatcttaagtggaaaggcttggaataacttgcttgataacaagactgctttcaccaccaagaaagactatggcaaagaagagagggaagctcaatgggcacttgctcagagaacactacatgggcttcaaccaccagaagccacaaatctcttcaatgaaaagaacagctacagggaactgtctgaaatcgctgaacaagcaaagaggagagcagagatggccaggcttcgcgagctgcatactctcaagggtcacgttgagtcggtggtgaagctgaaaggtctggatatcgaaacgatccagcagcattatacagtttgagaaagctaatgaatcttacacaagaaagggagaggcaggatgagaaatccaatgttaattagagaacaaagagaaggttttggccttgaccagataaaaacaaatttgtctgataaagggggaaaacttttatcttctgtgatcttccccccatctatttttacttaacttcgttatgtattttgattttgaagcgccgcccattgaaagggagggattgtgtccaagttttttccaacattttaatggtgaagtgacatctccttgtaacaacactactactcttccaaattcacctcctctttcttttttccttgtttttcatttgatgagaatgtctctatcagctttttgcac

SEQ ID NO: 107724 - protein, 952 aa, Nicotiana plumbaginifolia (curled-leaved tobacco)
MAKAISLEEIKNETVDLEKIPIEEVFEQLKCTREGLSADEGASRLQIFGPNKLEEKNESKILKFLGFMWNPLSWVMEAAAVMAIALANGDGKPPDWQDFIGIICLLVINSTISFIEENNAGNAAAALMAGLAPKTKVLRDGRWSEQEAAILVPGDIISVKLGDIIPADARLLEGDPLKIDQSALTGESLPVTKNPGDEVFSGSTCKQGELEAVVIATGVHTFFGKAAHLVDSTNNVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDRNLVEVFAKGVDKEYVLLLAARASRVENQDAIDACMVGMLADPKEARAGIREVHFLPFNPVDKRTALTYIDNNNNWHRASKGAPEQILDLCNAKEDVRRKVHSMMDKYAERGLRSLAVARRTVPEKSKESPGGRWEFVGLLPLFDPPRHDSAETIRRALNLGVNVKMITGDQLAIAKETGRRLGMGTNMYPSASLLGQDKDSAIASLPIEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMFIALIWKYDFSAFMVLIIAILNDGTIMTISKDRVKPSPMPDSWKLKEIFATGVVLGGYQALMTVVFFWAMHDTDFFSDKFGVKSLRNSDEEMMSALYLQVSIISQALIFVTRSRSWSFLERPGMLLVIAFMIAQLVATLIAVYANWAFARVKGCGWGWAGVIWLYSIIFYLPLDIMKFAIRYILSGKAWNNLLDNKTAFTTKKDYGKEEREAQWALAQRTLHGLQPPEATNLFNEKNSYRELSEIAEQAKRRAEMARLRELHTLKGHVESVVKLKGLDIETIQQHYTV

SEQ ID NO: 107725 - DNA, 3796 bp, Synechococcus sp
  CDS (810)..(3590)
aattcaggctgtggattgggctgcaggtaagaatcctaaaattgccatccttggttgaatcctacgcggggttcctggtctcattttctctttgaccgctttggcaacaggcttaatttctgctgtgcaatttactgtattggtcttgatgggtacaactactgtttattcctgtgtactagcgactgagcagtgtctagagactggaggcccaagcagtgaaataatccaagagtctcgagagggcttaagttttataagctgttgctactagagttgaataaaaagattgttaggactcagtattaaggtctagtctgccaggtcaaatgagctgaaaagcctgaataacaaggccgagtttttcttttgaaaaatttttatggctggattaatctatgccctactgaaatttttacgctgtgcatcattggcggaatttcaattttctttgcatgcaaacacaaggaaaaccagttttccaaaaacacttgattccctaattttaatcactatctcaatctagcacgaatttttagtgctgatgatcatttttgaggattattcgtggataatcacagagtcaaggtcttagtagccatgagaatactgggttagcctcggcgatcgcaggatcctagttaaccgcctctcggttgtccttcggggtcttagtcggagatgctctgggcgaaaaaggccaatttctcacctgactctgcctcgaaatactgctgccagaactcaacttgattgccatagctatcggcaattgacacttttcagctgtctgcttgtcctgatcgaaaatgaagggtgctattgtgtcagcctcgttgactgatgttcgccagccgatcgctcactggcatagtttgaccgttgaggaatgtcatcaacagctcgatgctcatcgaaatggcttaactgctgaagttgctgccgatcgcctagcgctgtatggccccaatgaattggtggagcaagcaggccgcagcccattgcagattctgtgggaccagttcgccaacatcatgttgttgatgctgctagcggtggctgtagtctctggagcgctagacctgagagatggccaatttcccaaggatgcgatcgcaattttggtgatcgtggttctgaatgcggtgctgggttatctgcaagaaagccgcgctgagaaggcgttggctgcactcaaaggcatggcggctcctttggttcgggtgcggcgcgacaatcgcgatcaggaaatccccgtcgcaggcttagtacccggtgatctgatcctgttggaggcaggcgaccaagtaccggcagacgcgcgcttggtcgaaagtgccaacttgcaggtgaaagagtcggcgctaactggcgaggccgaagcggtgcagaagctggcggatcagcaattgccgaccgatgtggtgattggcgatcgcacgaactgtctgtttcaagggacggaagtcctgcagggccgtggtcaggctttggtctatgccacgggcatgaacacagagctggggcggattgcgacgttgctccaaagtgtagagagtgaaaagacgccgcttcagcagcgcttggacaagttgggcaatgtactggtcagcggcgctttgatcctggtggcgattgtcgttggtttgggggtgctgaatggtcagtcttgggaggatttgctctccgttggcctgagcatggcagtggcgatcgtgccagaagggctacccgctgtgatcaccgtggcactggcgatcgggactcagcgcatggtgcaacgcgaaagtttgattcggcgcttacccgccgtggaaacgcttggctcagtcacaaccatctgttccgataagaccggcacgctgacccaaaacaagatggtggtgcagcagatccatactctcgaccacgatttcacggtgacgggcgagggctatgtgccagcgggccattttttgattgggggtgaaattattgtcccgaacgactatcgcgacctgatgctgttgttggccgcgggagcggtctgcaatgatgcagcgttggtggccagcggcgagcactggagcattgtgggcgatcccacggaaggttcgctgctgaccgtggctgcgaaggcaggaattgacccggaaggactacagcgggtgctaccacgccaggatgagatccccttcacctctgagcggaagcgcatgagtgtggtggtggctgatctgggagagacgaccctaacgattcgggaagggcaaccctacgtcctcttcgtcaaaggttcagcggagctgatcttagaacgctgtcagcattgctttggtaatgcccagcttgagtcactcactgccgctacacgccagcagatcttggcagcaggagaagccatggccagcgcaggaatgcgcgttttggggtttgcctaccgtccctcggcgatcgcggatgtggatgaggatgccgagacagatctgacttggctgggcttgatgggtcagattgatgcgccgcgcccagaagtccgagaggcggtccagcgctgtcggcaagccggcattcgcacactgatgatcactggcgatcacccgctcactgctcaggcgatcgcccgggatttaggcatcacggaagtgggccatcccgttctgacggggcaacaactctcagccatgaatggggctgaactcgatgccgctgtgcgatcggtggaagtttatgctcgagtggctcctgagcacaaactgcggatcgttgagtcgctccaacgccaaggggaatttgttgccatgaccggcgacggcgtcaatgacgcccccgccctgaagcaggccaatatcggtgtggcgatgggaattacgggcaccgatgtcagcaaagaagccagcgatatggttctgctggacgataactttgccactattgtggcggcagtggaagaaggccgcattgtctacggcaacattcgcaaatttattaagtacattctcggcagcaacatcggcgagctgttaacgatcgctagcgccccgcttttaggtttgggcgcggttcccctaacacccctgcaaatcctctggatgaacctggtcacggatggcattcccgctttggctttggcagttgagcccggcgacccaacgatcatgcagcgccggcctcacaatccgcaagagagtatttttgcgcggggactgggcacttacatgctgcgggtcggggttgtcttctcggccttcacgattgtgctgatggtgattgcttaccaatacacgcaggttccgttaccggggctagatccgaagcgctggcaaacgatggtgtttacgacgttgtgcttggcccagatgggacatgcgatcgcagtgcgcagtgatctcttaaccatccaaacaccgatgcgaacgaacccttggctctggctctcggtcattgtgacggcgttgctccagcttgctctggtttatgtatccccgcttcagaagttctttggcacccatagcctcagccagctcgatctggcgatttgtctgggcttcagtctcctgctctttgtgtacctcgaagctgaaaagtgggtgcgccacggtcggtattgataccaaaccgatccggaacggaattggattgagcgggtttacaaccttgcctgctgctccctagcctcccctcattgagttggctcaccgccctttttgcgcgctgttgaagagatggcttcagcgatcgcgcgggggatcaccgattgtaagcaagattgcagtccagaactggaatgaagcgcgatcgccctctggggtcgacc

SEQ ID NO: 107726 - protein, 926 aa, Synechococcus sp
MKGAIVSASLTDVRQPIAHWHSLTVEECHQQLDAHRNGLTAEVAADRLALYGPNELVEQAGRSPLQILWDQFANIMLLMLLAVAVVSGALDLRDGQFPKDAIAILVIVVLNAVLGYLQESRAEKALAALKGMAAPLVRVRRDNRDQEIPVAGLVPGDLILLEAGDQVPADARLVESANLQVKESALTGEAEAVQKLADQQLPTDVVIGDRTNCLFQGTEVLQGRGQALVYATGMNTELGRIATLLQSVESEKTPLQQRLDKLGNVLVSGALILVAIVVGLGVLNGQSWEDLLSVGLSMAVAIVPEGLPAVITVALAIGTQRMVQRESLIRRLPAVETLGSVTTICSDKTGTLTQNKMVVQQIHTLDHDFTVTGEGYVPAGHFLIGGEIIVPNDYRDLMLLLAAGAVCNDAALVASGEHWSIVGDPTEGSLLTVAAKAGIDPEGLQRVLPRQDEIPFTSERKRMSVVVADLGETTLTIREGQPYVLFVKGSAELILERCQHCFGNAQLESLTAATRQQILAAGEAMASAGMRVLGFAYRPSAIADVDEDAETDLTWLGLMGQIDAPRPEVREAVQRCRQAGIRTLMITGDHPLTAQAIARDLGITEVGHPVLTGQQLSAMNGAELDAAVRSVEVYARVAPEHKLRIVESLQRQGEFVAMTGDGVNDAPALKQANIGVAMGITGTDVSKEASDMVLLDDNFATIVAAVEEGRIVYGNIRKFIKYILGSNIGELLTIASAPLLGLGAVPLTPLQILWMNLVTDGIPALALAVEPGDPTIMQRRPHNPQESIFARGLGTYMLRVGVVFSAFTIVLMVIAYQYTQVPLPGLDPKRWQTMVFTTLCLAQMGHAIAVRSDLLTIQTPMRTNPWLWLSVIVTALLQLALVYVSPLQKFFGTHSLSQLDLAICLGFSLLLFVYLEAEKWVRHGRY

SEQ ID NO: 107727 - DNA, 3146 bp, Solanum tuberosum (potato)
  CDS (64)..(2922)
atcaaccctttttctgcttagtttttgacttgttgctgctggttttcgtttgattttaccgagatggcgaaagctataagcctcgaagagatcaaaaatgagactgttgatctggagaaaatccccattgaagaagtgtttgaacaactaaaatgttcgcgagagggtctgacttcggacgaaggagccaacaggcttcaaatctttggaccgaacaagttggaagagaaaaaagaaagcaaaatactgaagttcctggggtttatgtggaatcctttgtcatgggttatggaggctgcggctatcatggccattgcactggctaatggaaatggaaagcccccagattggcaagattttgttggtattgtttgcttgctggtgatcaattcaactatcagttttattgaagaaaacaatgctggaaatgctgccgcagctcttatggctgggcttgctcccaaaaccaaggttcttagagatgggcgatggagtgaacaggaagctgctattctggtgcctggtgatattataagtgtcaagttgggagacattgttcctgctgatgctcgtcttcttgaaggtgatcctttaaagattgatcaatctgcccttacaggagaatctcttcccgtgacaaagaatcctggagatgaagttttctctggatcaacctgcaaacaaggtgaacttgaagctgtagtcattgccactggagttcacactttctttggcaaggcagcacaccttgttgacagcacaaacaatgttggtcatttccagaaagtgctaacagccataggaaacttctgtatctgctccattgcagttggtatgctgattgagattattgtcatgtatccaatccagcacaggaagtacagggatggaattgacaatctcttggtgctccttattggtggtattcccattgctatgcctactgtgttgtcagtcactatggctattggatcccacaggctctcccaacagggtgccatcaccaagagaatgactgctattgaagaaatggctggaatggatgtgctgtgcagtgacaagacaggtaccttgactcttaacaagttgagtgtcgacaaaaccttggtcgaggtgttcgttaagggagtagataaagaatatgtgctcctccttcccgcaagggcctctagagttgaaaatcaggatgcaattgatgcttgcatggttggcatgcttgccgatccaaaagaggcacgagctggtatcagggaggtgcatttcttgcccttcaatccagtggacaagagaactgctttaacatatattgacaacaatggcaactggcaccgtgccagcaagggagctcctgagcagattttggacctatgtaactgtaaggaagatgtcaggagaaaggttcattcaatgattgataaatacgctgaggctgggttgaggtcactggctgtagctagacaggaagtgccagagaaatcaaaggagagcgctggaggtccatggcaatttgttggattgctacccctctttgatccccccagacatgatagtgctgagaccatccgtagagctctcaaccttggtgtaaatgttaagatgatcactggggatcaattggctattgccaaggagactggccgtaggcttggaatgggaacaaacatgtacccgtcagcatctttacttggtcaagacaaggattcatctattgcttcacttcctgtagaagagttgattgagaaggcagatggatttgctggagtatttcctgagcacaaatatgagattgtaaagaagttgcaggagagaaagcacattgtgggaatgactggtgatggtgtgaacgatgctcctgctttgaagaaggcagatattggaatcgctgttgcagatgctactgatgcagcccgaggtgcttctgatatcgtgctcactgagccaggtctaagtgttatcatcagtgctgtgttgaccagtagagctattttccagaggatgaagaattacacaatatatgcagtttccatcacaatccgtattgtgtttggtttcatgcttattgctctgatatggaagtacgacttctctgcatttatggttttgatcattgccatcctaaatgatggaaccattatgacaatctcaaaggatagagtgaaaccatctccaatgcctgatagctggaagttgaatgaaatctttgcaactggtgttgttcttggaggataccaagcattgatgactgttcttttcttctgggcgatgcatgacactaaattcttctcggacaaatttggtgtgaaggatattagggaaagtgatgaagaaatgatgtctgctttgtacctgcaagtgagtattatcagccaggctttgattttcgtgacccgttcacgaagctggtcctttgttgaacgcccaggagctctgttaatgattgctttcttgatcgcccaactggttgccactttaattgctgtctatgccgactggacttttgcaagagtcaaaggatgtggatggggatgggctggtgtcatctggattttcagcattgttacctacttcccacttgacataatgaaattcgccatccgctacatcttaagtggaaaggcttggaataacttgcttgacaacaagactgctttcaccaccaagaaagactatggaaaagaagagagggaagctcaatgggcacttgctcagagaactttacatggacttcaaccaccagaagcctcaaacctgttcaacgaaaagaacagctaccgagaactgtctgaaattgctgaacaagcaaagaggagagcagagatggctaggcttcgtgagctgcacacactcaagggtcatgttgaatcagtggtgaagctgaaaggtctggatatcgaaacgatccagcagcattatacagtttaagaaacataatcatcatatctacacaagaaagggcatgttaattactgtattaattagaaaagaagagacacacaagcttttggcctttaaccacatataaaaaattgtcttaagataaagggggaaaactttcgtcttctgtgatctttccccccctcctctcatctattttctttaacttcgttatgtattttgaagcaccacccattgaaagggattgtgtc

SEQ ID NO: 107728 - protein, 952 aa, Solanum tuberosum (potato)
MAKAISLEEIKNETVDLEKIPIEEVFEQLKCSREGLTSDEGANRLQIFGPNKLEEKKESKILKFLGFMWNPLSWVMEAAAIMAIALANGNGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAVGMLIEIIVMYPIQHRKYRDGIDNLLVLLIGGIPIAMPTVLSVTMAIGSHRLSQQGAITKRMTAIEEMAGMDVLCSDKTGTLTLNKLSVDKTLVEVFVKGVDKEYVLLLPARASRVENQDAIDACMVGMLADPKEARAGIREVHFLPFNPVDKRTALTYIDNNGNWHRASKGAPEQILDLCNCKEDVRRKVHSMIDKYAEAGLRSLAVARQEVPEKSKESAGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGASDIVLTEPGLSVIISAVLTSRAIFQRMKNYTIYAVSITIRIVFGFMLIALIWKYDFSAFMVLIIAILNDGTIMTISKDRVKPSPMPDSWKLNEIFATGVVLGGYQALMTVLFFWAMHDTKFFSDKFGVKDIRESDEEMMSALYLQVSIISQALIFVTRSRSWSFVERPGALLMIAFLIAQLVATLIAVYADWTFARVKGCGWGWAGVIWIFSIVTYFPLDIMKFAIRYILSGKAWNNLLDNKTAFTTKKDYGKEEREAQWALAQRTLHGLQPPEASNLFNEKNSYRELSEIAEQAKRRAEMARLRELHTLKGHVESVVKLKGLDIETIQQHYTV

SEQ ID NO: 107729 - DNA, 3409 bp, Phaseolus vulgaris (kidney bean)
  CDS (314)..(3169)
gaattcggcacgagaaggaagggagcactgtgagaggttcacggcttccactttcacatcaccaaacaaactcatctcttcacaaactcctcttctccttcaatctctttccttctgcttcctttttcccctctctgcatttattttcttttggacttttccactcatgcaccctccaaacccctctatttaaccctctctttctcctacacccttcatctccctcataattccacacactcattatacatactaatacccttcttcttcttcatcttcttcctcatcttcttcctcatatccaacatccaacatgggtggcatcagcctcgaagagataaaaaacgagaacgtcgatctggaacgcattcccatagaggaagtgtttgagcagctgaaatgttcaagagcaggtctaacatcagacgaaggggccaacaggctccaagtctttggaccaaacaaattggaagagaaaaaggagagcaagtttttgaagttcttgggctttatgtggaaccctttgtcttgggtcatggaagctgctgctatcatggccattgctttggcaaatggaggaggaagaccaccagattggcaagattttgtgggaatcattgctctgctagtgataaactccacaatcagttttattgaggaaaacaatgctggaaatgctgctgctgctcttatggctggtttagctcccaagactaaggtactaagggatgggcgatggagtgaacaagatgctgcaattttagtaccaggagacataatcagcatcaagttaggagatatcattgcggctgatgctcgtcttcttgagggtgatcctctgagtgttgatcagtcggctttgacgggagaatctcttccagtgacaaagagttcctcagatgaagtgttttcgggatcaacggttaagaagggagagatagaagctgttgtgattgccactggagtgcacaccttttttggcaaagcagcacatctagtggacagcaccaaccaagttggacactttcagaaagtactcacagcaattggtaacttctgcatttgctcaattgctattggaatcgccatcgagctcatagtcatgtacccaattcaacaccgaaagtacagggatggaattgacaatctgttagtgctcttgattggaggaatccccattgccatgccaacagtgttgtctgtcactatggctattggttctcacaggctttctcagcagggtgccatcacaaaaagaatgacggctattgaggaaatggacgggatggatgtcctatgcagtgacaaaactgggactctcactttgaataagttgagtgttgatagaaacttgattgaggtgtttgccaagggtgttgagaaagagtatgttatccttctggcagccagagcttccaggactgaaaatcaggatgccattgatgctgcaattgttggcatgcttgctgacccaaaggaggcacgtagtggtattagagaggtacatttccttccattcaatcctgtagacaagaggactgcacttacctacattgattctgatggaaattggcatagatctagcaaaggggctcctgagcagataatcactctttgcaactgcaaagaggatgtcagaaaaaaggttcatgcagtaattgataagtttgctgagcgtggacttcgatctttaggtgttgcaagacaggaagtacctgaaaaatcaaaagatggtgctggtggaccatggcaatttgttggtctgctaccattgtttgatcctcccagacatgatagtgctgaaaccattagaagagctctaaatcttggtgtgaatgttaagatgattactggggatcagcttgccattggaaaggaaacgggtcgaaggctcggaatgggaacaaacatgtatccttcatctgcattgcttggccaagacaaggatgcttctatttcagctcttccagttgatgagttgattgataaggctgatggatttgcaggagtatttcctgagcacaaatatgaaattgttaagcggctgcaagagaggaagcatatatgtggaatgacaggtgatggtgtaaacgatgcccctgcattaaagaaagcagatattggaattgctgttgctgatgccacagatgctgctagaagtgcttctgatattgtccttactgaacctggtctaagtgtcattattagtgcagtgctgactagcagggcaattttccagaggatgaagaactatactatctatgctgtgtcaatcaccatccgtattgtgtttggtttcttgtttattgcgttgatctggaagtttgattttgcacccttcatggttttgattattgccatactaaatgatggtaccattatgaccatatcaaaggatagagtgaaaccatctccacttcctgatagctggaaattgagggagatattcgctactggcgttgtgctaggcagctacatggctctaatgacagtgatatttttttgggcaatgaaagataccaacttcttctcgaacaagtttggtgtgaggtcactgagacttagtcctgaggaaatgatggcagccttatacctacaagtcagtataataagtcaggctctaatctttgtcacaaggtcccgcagttggtcttttgctgaaaggccgggtcttctcctactaggagcttttctgattgctcagttggtagcaacttttatagcagtatatgctaactggggctttgcaagaataaagggaatgggatggggttgggctggtgtaatctggctttacagtgtggtaacctatatccctcttgatattctcaaatttgcaatccgctatatactaagtgggaaggcttgggacaatcttttggagaacaagactgctttcaccacaaagaaagactacggcaaagaagagagggaagctcaatgggcggctgcacagaggacacttcatggtcttcagccaccggaaacttccaaccttttcaatgacaagaatagctacagggagctttcagagattgcagaacaagccaaaagacgagctgaagttgcaaggcttagggagcttcatactctaaagggacacgttgagtcagtggtgaagttgaaggggcttgacattgacacaattcagcagcactatacagtttaaggagcttggacaagcttcaagaagaatcgattcagtgcttttttttgagaacaaaatcacatataatgacgaagaaaggctcaaagaccatgctcaatccatcttttaagttacataagaaaatgagtcctgtgcaaatttgaatggtctctctcactgtctccatcttttctaggagatactatgttctttacgtatcaaataacataattggtagggtttaaaaaaaaaaaaaaaaaa

SEQ ID NO: 107730 - protein, 951 aa, Phaseolus vulgaris (kidney bean)
MGGISLEEIKNENVDLERIPIEEVFEQLKCSRAGLTSDEGANRLQVFGPNKLEEKKESKFLKFLGFMWNPLSWVMEAAAIMAIALANGGGRPPDWQDFVGIIALLVINSTISFIEENNAGNAAAALMAGLAPKTKVLRDGRWSEQDAAILVPGDIISIKLGDIIAADARLLEGDPLSVDQSALTGESLPVTKSSSDEVFSGSTVKKGEIEAVVIATGVHTFFGKAAHLVDSTNQVGHFQKVLTAIGNFCICSIAIGIAIELIVMYPIQHRKYRDGIDNLLVLLIGGIPIAMPTVLSVTMAIGSHRLSQQGAITKRMTAIEEMDGMDVLCSDKTGTLTLNKLSVDRNLIEVFAKGVEKEYVILLAARASRTENQDAIDAAIVGMLADPKEARSGIREVHFLPFNPVDKRTALTYIDSDGNWHRSSKGAPEQIITLCNCKEDVRKKVHAVIDKFAERGLRSLGVARQEVPEKSKDGAGGPWQFVGLLPLFDPPRHDSAETIRRALNLGVNVKMITGDQLAIGKETGRRLGMGTNMYPSSALLGQDKDASISALPVDELIDKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFLFIALIWKFDFAPFMVLIIAILNDGTIMTISKDRVKPSPLPDSWKLREIFATGVVLGSYMALMTVIFFWAMKDTNFFSNKFGVRSLRLSPEEMMAALYLQVSIISQALIFVTRSRSWSFAERPGLLLLGAFLIAQLVATFIAVYANWGFARIKGMGWGWAGVIWLYSVVTYIPLDILKFAIRYILSGKAWDNLLENKTAFTTKKDYGKEEREAQWAAAQRTLHGLQPPETSNLFNDKNSYRELSEIAEQAKRRAEVARLRELHTLKGHVESVVKLKGLDIDTIQQHYTV

SEQ ID NO: 107731 - DNA, 3369 bp, Zea mays (maize)
  CDS (206)..(3052)
gaattcggggcggtggaacagaggaggagcccgactgaggctaggcggcggaggcctgggcggacggatccatgagaagaagcggacccttcctttctcgcacgggaagagtagcgaggaggcgcgggccccgtgcgggtatgcccgtgcctgccgtcgcgtccgcctctaggactagggtccgctccagcgccagccgtccgccatgggtgggctcgaggagatcaagaacgaagccgtcgatctggagaacatccccatcgaggaggtgttcgagcagctgaaatgcacccgcgaggggctgagctccagcgagggccagcagcgtctcgagatctttggccccaacaggctcgaggagaagaaggagagcaaggtcctcaagttccttgggttcatgtggaacccgctgtcatgggtcatggagatggctgccatcatggctattgcactcgccaacagtggtggcaagcccccggactggcaggacttcgtcggtatcatcgtgctcttggttatcaactccaccatctccttcattgaggagaacaatgccggcaacgcggccgccgcactcatggccaaccttgctccaaaaaccaaggttctgagagatggccgatggggcgagcaagaggctgcaatcttggttcctggtgacatcatcagcatcaagcttggcgatatcatccctgccgacgctcgtcttctcgagggtgatccactcaaggttgaccagtctgcgcttactggagaatccctcccggttaccaagggcccaggggacgaagtcttctcgggttccacttgtaagcagggtgagatcgaggccgtggtcattgccaccggagtgcacaccttcttcggcaaggccgctcatcttgtggacagcaccaaccaggtcggacacttccagcaggtgctgacagcaatcggtaacttctgcatctgctccattggggtcggcatcctcgttgagatcatcgtcatgttcccaatccagcaccggaggtaccgcagcggaatcgagaacctgttggtcctcttgatcggtggtatcccaatcgccatgcctaccgtgctttcagttaccatgccgattggttcgcacaagctgtcacagcagggtgccatcactaagaggatgactgccattgaggagatggctggtatggacgtgctttgcagtgacaaaaccggcacactcaccctcaacaagcttagcgtcgataagaacctcgtcgaggtgttctgcaaaggcgtcgacaaagaccatgtgttgctgttggctgcaagggcttcaagaactgagaacctggacgctatcgatgccgccatggttggcatgcttgctgatcctaaggaggccagggctggtataagggaaatccacttcttgcccttcaaccctgttgataagaggactgctctgacgtacattgatgccgatggcaactggcaccgtgtcagcaagggtgctcctgaacagattcttgacctgtgccactgcaaggaggatctgaggcggaaggtgcactctattatcgacaagtatgccgagcgtggtcttcgttcgcttgctgttgccagacaggaagtacctgagaaaaacaaggagagtccgggggggccatggcagttcgttggtctgttgcgggtgtttgatccgcctaggcatgacagcgctgagacaattcgcaaggctcttgttcttggtgttaacgtcaagatgatcacgggtgatcagcttgctattggtaaggagactggaaggaggcttggcatgggtaccaacatgtatccatcctctgcgctgctcggccaaaacaaggatcgtacgcttagcgctcttcctgtagatgagctcattgagaaggccgatggttttgccggagtcttccctgaacacaagtacgagatcgtgaagagactgcaggagaagaagcacatcgttggtatgactggagatggtgtcaacgatgccccggctcttaagaaggctgacatcggtattgctgttgcggatgctactgacgctgcgaggagtgcttccgacattgtccttactgagccaggtcttagcgtaattatcagcgccgtcctcaccagcagagcaatcttccagaggatgaagaactacaccatctatgcagtttccatcacaatccgtatagttctcggatttatgctcattgcgttgatctggcaatacgatttctctcccttcatggttcttatcatcgctatcctcaatgacggtacaatcatgaccatctctaaggacagagttaagccatctccgttgcccgacagctggaagctaaaggagatttttgctacgggcatcgtacttggaggctaccttgctctgatgactgtcattttcttctgggctatgcacaagacggacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcgtcgctcaacttgttgccacccttatcgctgtctacgccaactggcgtttcgccaggatcaagggtatcggctggggctgggcaggtgtcgtctggctctacagcatcgtcttctacttccccctggacctgctcaagttcttcatccgcttcgtgctcagcggcagggcatgggacaacctcctcgacacgcgaattgcattcacgcggaaaaaagaccttcggaaaggagagagggaggcgcagtgggccaccgcgcagaggacgctgcacgggctccagccgccggagtccaacacgctgttcaacgacaagagcagctaccgcgagctgtccgagatcgccgagcaggccaagagacgagctgagatcgcgaggctgagggagctcaacaccctcaagggccacgtggagtcggtggctaagctcaagggcctggacatcgacaccatccagcagaactacacggtgtgagagcccctctctgcgatgtcgacgacaacacctttgctgcccgacgggagccatctgattacagataaaaattttccgtaagctgtaaagctctataccaccagatactgccatatgatggtatggttcggtacccgtctttctagggagtttcttttctctctctctctctttttctattgttatgtttttcaatagtggagtgtgcgcgtgttgtaatcgtttttacctgcgttttcctctaactagccggtgactgccgggaagcgaggtgaagaaataatgcaactaaaattctctgccaaaaaaaaaaaaaa

SEQ ID NO: 107732 - protein, 948 aa, Zea mays (maize)
MGGLEEIKNEAVDLENIPIEEVFEQLKCTREGLSSSEGQQRLEIFGPNRLEEKKESKVLKFLGFMWNPLSWVMEMAAIMAIALANSGGKPPDWQDFVGIIVLLVINSTISFIEENNAGNAAAALMANLAPKTKVLRDGRWGEQEAAILVPGDIISIKLGDIIPADARLLEGDPLKVDQSALTGESLPVTKGPGDEVFSGSTCKQGEIEAVVIATGVHTFFGKAAHLVDSTNQVGHFQQVLTAIGNFCICSIGVGILVEIIVMFPIQHRRYRSGIENLLVLLIGGIPIAMPTVLSVTMPIGSHKLSQQGAITKRMTAIEEMAGMDVLCSDKTGTLTLNKLSVDKNLVEVFCKGVDKDHVLLLAARASRTENLDAIDAAMVGMLADPKEARAGIREIHFLPFNPVDKRTALTYIDADGNWHRVSKGAPEQILDLCHCKEDLRRKVHSIIDKYAERGLRSLAVARQEVPEKNKESPGGPWQFVGLLRVFDPPRHDSAETIRKALVLGVNVKMITGDQLAIGKETGRRLGMGTNMYPSSALLGQNKDRTLSALPVDELIEKADGFAGVFPEHKYEIVKRLQEKKHIVGMTGDGVNDAPALKKADIGIAVADATDAARSASDIVLTEPGLSVIISAVLTSRAIFQRMKNYTIYAVSITIRIVLGFMLIALIWQYDFSPFMVLIIAILNDGTIMTISKDRVKPSPLPDSWKLKEIFATGIVLGGYLALMTVIFFWAMHKTDFFSDKFGVRSIRDSEHEMMSALYLQVSIVSQALIFVTRSRSWSFVERPGLLLVTAFVAQLVATLIAVYANWRFARIKGIGWGWAGVVWLYSIVFYFPLDLLKFFIRFVLSGRAWDNLLDTRIAFTRKKDLRKGEREAQWATAQRTLHGLQPPESNTLFNDKSSYRELSEIAEQAKRRAEIARLRELNTLKGHVESVAKLKGLDIDTIQQNYTV

SEQ ID NO: 107733 - DNA, 3258 bp, Heterosigma akashiwo
  CDS (129)..(3062)
gtggaaccgcatttttgagagcttgctatactctcttttgcccaccgttatccccaaagacttcccacaccacataattgacctttcagaagtgcattgttcctccaggatttaagtcgacgggagccatgcagaagcctcccctcaaccgaaaggcctctgatcgggccatggagcttaacaagcaatcgcctgccacaggagggccggtccttttcgaccggaagagatccatgagcattgatgatgtcatggaggagagagaaaagcaagactcatccggtggccccattaagctgggtgatatcagaagcgaggactttagacggtcctttcattctgggcgttctcatgatctggatattgaagacccctccagctcagctgctgcggagagctttgaaccatctactgggcttacaactgaagaggctgaaatcttgttaaaacaatgggggaaaaacgaacttatcgaaaagacgaaatccaagctcgaaattttcattgagcagttcacagccccaatgcccatcatgatttggattgccatccttattgaggcagttcttgaaaactggcctgatatgtacattctgtgtggcttgcaggcaatcaacggtggtgtcggtttctatgagatggtaaaagctggcaatgcagttgcagcactgaaggcgtcactgcagcccaaagctatttgccaccgtgatggtcagttcaaaaacatgaatgcaaccctgctggtgccaggtgaccttgtgatccttggagcaggggcagctgtgccagccgattgcatgatcaatgaaggccagattgaggtggatcaggcagctctcactggagagtcgctgcctgtgaccatgctcaagggagataaccccaagatgggttccacggtggcgcgtggggaggtggaagctaccgtaacagccactggcatgaacacattcttcggcaagactgccaatcttatccagtctgtagatgagcttggtcacctacagaagatccttctgtacatcatggcgttcctgattgtgctctccttcctgctctgcggcatcaccctttggtacctgctggaccaaggcgaggacttcaaggagtccatctcttttgtggtggtgctgctggtcgcctcgatccccattgccatcgaggtggtggtgacggcgaccatggccctgggctcccgggagctggcgaagatggacgccattgtggcccggctcagcgccattgaggagctggccggcatgaacatgctttgctctgacaaaactggtaccttgaccctgaacaagatggtgatccaggacgactgtccaatgtttgtggatggcatcaccccagaggacgtcatcctccatgccgcgctggctgccaagtggaaagagcccccgaaggacgccttggacaccatggtgctcggggcctgcgacgtgagcctgtgcaaccctttcacccagctggactacaccccctttgacccgaccctgaagcgcacggaggccgagctgaagggcccggacgggaagacgttcaaggtgacgaagggcgcgccgcacatcgtgctggacctgtgccacgacaagaagcgcatcgaggaggccgtggacttcaaggtgctggagctggccgagcggggcatccggtccctggcggtggcgcgcaccaacgcgaagggccagtggttcatgctgggcatcctgaccttcctggaccccccgcggccggacaccaagctgaccatcgagcgcgcgcgcgtgcacggcgtggaggtgaagatggtgaccggcgaccaccaggtcatcgccaaggagaccgcgcgcgtgctggacatgggcaccaacatcctgggctgcgacggcctgcccacgctggatgccgagggcaagctgcccagcggcgccgagatggccgacatctgccaacgggtggtggactgcaacggctttgcccaggtgttcccggagcacaagttcgtcatcgtggaggccgtgcgcatgggcggctttgaagtgggcatgaccggcgatggtgtgaacgacgcccccgctttgaagcgcgcggacattggtattgccgtgcaaggggccacagatgccgcgcgtgccgcagctgacattgtgcttacttcgcccggtctgactgtggtggtggaggccatcatcgtggcgcgcaagatttttgcccggatgaagagcttcattgtctacagagtggcatgcaccctgcagctgctggtgttcttctttgtgggcgtgctctggctgcacccccaggattacaactcggagttcccccggttctggggcatgccggtgattgcgctgatcatgatcacactgctgaatgacggcaccatcatttccatcgcgtacgacaacgtgcagagctcgaagaaccccgaggtgtggaacctgccggccgtgtacgtggtgtccacggtgctgggcatgatcgcctgcgtgagcagcatcctgctgctgcactgggcgctggactccaccagccccacctcgctgttcaacaagttcggcgtggagctggagtacgccgaggtgatggcggtgatgtacctgaaggtctcactgtcggacttcctcacgctgtttgcctcgcgcacgcacggacccttctgggtgcagaagccgggcaagctgctggcggccgccttcctcttcgccgtgggcctttccacggccaactccctcacttggccctttggggagggcatggccgcgctcccgccggtggcgccgccgccgtctgggcatactgtttggtgtggttcctcatccaggactttggcaagaccattctgtacatgtggatgcacaagtacaacatccttgggatcaacaactccaagagtgtcgtcgctaaacaccaccgcggagaatatgctgatgcggatgaggaggctggaggagggtatggtagtgtcccaacaaatgatactactggtgcttcaggttctggaaagaatggtgagaagaggcatctgctcaagtaatctcagtggaagctctttgcttagtcgttgtctgtactgatgatcgcatcatcattacatgttgttgcttatgggggccctcttgcccaccatgcttcataccgtttatttttttctggtaatcttaagtatagtcagtatgaatttttgtagtatatagtagtagtagtattataataatagtttcataagtataatcatgatggcatcatttaaaagccaaaaaaacaaaaaac

SEQ ID NO: 107734 - protein, 977 aa, Heterosigma akashiwo
MQKPPLNRKASDRAMELNKQSPATGGPVLFDRKRSMSIDDVMEEREKQDSSGGPIKLGDIRSEDFRRSFHSGRSHDLDIEDPSSSAAAESFEPSTGLTTEEAEILLKQWGKNELIEKTKSKLEIFIEQFTAPMPIMIWIAILIEAVLENWPDMYILCGLQAINGGVGFYEMVKAGNAVAALKASLQPKAICHRDGQFKNMNATLLVPGDLVILGAGAAVPADCMINEGQIEVDQAALTGESLPVTMLKGDNPKMGSTVARGEVEATVTATGMNTFFGKTANLIQSVDELGHLQKILLYIMAFLIVLSFLLCGITLWYLLDQGEDFKESISFVVVLLVASIPIAIEVVVTATMALGSRELAKMDAIVARLSAIEELAGMNMLCSDKTGTLTLNKMVIQDDCPMFVDGITPEDVILHAALAAKWKEPPKDALDTMVLGACDVSLCNPFTQLDYTPFDPTLKRTEAELKGPDGKTFKVTKGAPHIVLDLCHDKKRIEEAVDFKVLELAERGIRSLAVARTNAKGQWFMLGILTFLDPPRPDTKLTIERARVHGVEVKMVTGDHQVIAKETARVLDMGTNILGCDGLPTLDAEGKLPSGAEMADICQRVVDCNGFAQVFPEHKFVIVEAVRMGGFEVGMTGDGVNDAPALKRADIGIAVQGATDAARAAADIVLTSPGLTVVVEAIIVARKIFARMKSFIVYRVACTLQLLVFFFVGVLWLHPQDYNSEFPRFWGMPVIALIMITLLNDGTIISIAYDNVQSSKNPEVWNLPAVYVVSTVLGMIACVSSILLLHWALDSTSPTSLFNKFGVELEYAEVMAVMYLKVSLSDFLTLFASRTHGPFWVQKPGKLLAAAFLFAVGLSTANSLTWPFGEGMAALPPVAPPPSGHTVWCGSSSRTLARPFCTCGCTSTTSLGSTTPRVSSLNTTAENMLMRMRRLEEGMVVSQQMILLVLQVLERMVRRGICSSNLSGSSLLSRCLY

SEQ ID NO: 107735 - DNA, 2619 bp, Mycoplasma pneumoniae
  CDS (1)..(2619): transl_table=4
gtgaataagtgaactgggttgagtgctgcggccgttttagaaagccgcgcacagcatggtgctaatttaattcctacaaaaaaattaacccctttttgactactgttcttagaacagttcaagagcttagtggtgatcttactgctggtagctaccatcctttcactagtggttgccattattagtggggttaatgctaactggttgtttgaccacaaccttgttattgagtgaacccaaccgtttgtaattttgataacggtgttggccaactccctgattggctccattcaggaatttaaagcgcaaaagtcagctcacaccttaaagtccctaacgcaaccctttacgcgggtattccgtgaagaaggcttggtttcgttaccggtgggtgaagttgttgtcggtgacattatctttctggaagcgggtgatattattcccgctgacgggaaggtgctgcaagcgaaccacctccgctgtatggagagctttttaactggtgaatcagtcccagttgataaaagtgtggttaacaccggtggcaagggtttgttggaacaaacaaacctactcttttctggtgcccaagtggtctttggtagtggtgtattcgaagtaactgctgtggggttaaatacccaagtcggtcaaattgtcaaaacagtggacagtagtgcaactaagctatcgcccctacagcaaaaactggaaaaagtggggaagtggtttagctggtttggccttggtttattcgttgtcgttttcctagtgcagttagggttacttggttttcacaactttagcgctaactgatcgattgccttaattggtgcaattgccttagtagtcgctattatccctgagggcttagtgacctttattaacgttatttttgccttaagtgtgcagaagctcaccaaacaaaaggcaattattaagtacctagctgcaatcgaaacactcggtggcgtgcaaatcatttgtaccgacaaaactggtactttaacacaaaacaagatgaaggtcgtggactatttctgttttagtaacactacccaaacagacttagcacgtgctttgtgtttgtgcaacaatgctacagtcaacactaacggagacagcaccggtgatccaactgaaattgcccttttgcaatggttggaccgtgatggtttggaattaaaccactacacacgcgtgtacgaaaaggcatttgattccaaccgcaagcttatgagtgtggtggtgcaaaaggacaaccgttttattgtgattgtcaagggcgcacacgatgtcttgttaccgttatgtaagggcttggatagcaaccaaattaagcctttaattgatgaacgtgctagcaacggcttgcgcaacttagcggtgggactcaaggttttatactgctttgatccagaaaatacccaaactgtcaacgaattggaaagcgaactcgactttttgggttctgttagcttacaagatccaccacgaattgaaagtaaagctgccattatggcgtgtcaccaagccaacattaccccaattatgatcactggtgatcacctcaaaaccgctactgcaattgccaaagaattgggcattctgaccgatgaaaggcaagccattttaggagtcgatttagaccccgctaaaattatggagtaccgcgtctttgccagagtaacgccgcagcaaaagctagaaatagttaatgcctgaaagcaagcgggttacacggtagccgttactggtgatggggtcaatgatgcgcccgctttagtgactagtgatgttggttgttgtatgggacaaacgggggttgacattgccaaagatgccgctgatgtcattattagcgatgacaactttgccacaattgttaacgggattgaacagggtcgtaaaacctttttgacctgtaaacgggtgttgtttaacctctttttaacctcaattgctggcacgattgtcgtgttattgggtttatttgtattaggggaagtctttcgtgaacaactcagcaaagcaaaccataacttccaggtctttacccctacgcaactgctaattattaacctctttgttcacggctttcccgctgtggccttagcgatccaacccgtccaggaaaaactgatgttaaaaccgttttccaccaaaaatctgttttacaaccgtggcgggttcgatttaatctgacaatccttgctgttgagctttttaaccctacttttctacagtttagggatggtctatgccattaatgatccggagttaggcaaatccggtgatttaattaaccgggctggtgcgacctgtggttttatggtgttagggggcagtgcagctttaaattccttaaacctaatggtggatcgaccattggtagctactaacccaaagcactatggcattgtgtgactaggggcgttgtcctcgatctttgtcttcttattaattattttcattaaccccttggggttagtgtttagtacattaaaagaccttactgcccacccggttttaattggttatagctttgggggcgtgcttttatatatgacaattaacgaagttgttaaacttattaggttaagttatgggtctgtttaa

SEQ ID NO: 107736 - protein, 872 aa, Mycoplasma pneumoniae
MNKWTGLSAAAVLESRAQHGANLIPTKKLTPFWLLFLEQFKSLVVILLLVATILSLVVAIISGVNANWLFDHNLVIEWTQPFVILITVLANSLIGSIQEFKAQKSAHTLKSLTQPFTRVFREEGLVSLPVGEVVVGDIIFLEAGDIIPADGKVLQANHLRCMESFLTGESVPVDKSVVNTGGKGLLEQTNLLFSGAQVVFGSGVFEVTAVGLNTQVGQIVKTVDSSATKLSPLQQKLEKVGKWFSWFGLGLFVVVFLVQLGLLGFHNFSANWSIALIGAIALVVAIIPEGLVTFINVIFALSVQKLTKQKAIIKYLAAIETLGGVQIICTDKTGTLTQNKMKVVDYFCFSNTTQTDLARALCLCNNATVNTNGDSTGDPTEIALLQWLDRDGLELNHYTRVYEKAFDSNRKLMSVVVQKDNRFIVIVKGAHDVLLPLCKGLDSNQIKPLIDERASNGLRNLAVGLKVLYCFDPENTQTVNELESELDFLGSVSLQDPPRIESKAAIMACHQANITPIMITGDHLKTATAIAKELGILTDERQAILGVDLDPAKIMEYRVFARVTPQQKLEIVNAWKQAGYTVAVTGDGVNDAPALVTSDVGCCMGQTGVDIAKDAADVIISDDNFATIVNGIEQGRKTFLTCKRVLFNLFLTSIAGTIVVLLGLFVLGEVFREQLSKANHNFQVFTPTQLLIINLFVHGFPAVALAIQPVQEKLMLKPFSTKNLFYNRGGFDLIWQSLLLSFLTLLFYSLGMVYAINDPELGKSGDLINRAGATCGFMVLGGSAALNSLNLMVDRPLVATNPKHYGIVWLGALSSIFVFLLIIFINPLGLVFSTLKDLTAHPVLIGYSFGGVLLYMTINEVVKLIRLSYGSV

SEQ ID NO: 107737 - DNA, 2718 bp, Synechocystis sp
  CDS (1)..(2718)
atggatttccccaccttaagttcttacctccatcaccatcgaccaggggaagacattcttgcagatttgcacaccgatccaggtttaggtctgacagcggaggcggtggcccagcgttacgaacaatatggccgcaacgaattgaaatttaaaccgggcaaaccagcttggttgcgttttctgctgcaatttcaccaacctctgctctacattctgctcattgctggtacggttaaggcttttctcggctcctggaccaacgcctgggttatttggggagttaccctagtcaacgccatcattggttacatccaagaagcgaaagcagaaggggcgatcgcctccttggccaaggcagtaacaacagaagccacagtgttgagagatgggcaaaatctacggattccttcccaggatttagtcatcggtgacattgtttccctcgcttcgggggataaggtgccagcggatctaaggctgttaaaagtgcgtaatctccaggtggatgagtcggctttgacgggggaagcagtgccggtggaaaaggcggtggaacttttaccggaggaaacgcccctggccgaaaggttaaacatggcctatgcggggagctttgtcacctttggtcagggaaccggggtggtagtagctactgccaatgccacggaaatggggcaaatttcccaatccatggaaaagcaggtcagcctcatgacccctttgacccgtaagtttgccaaatttagccacacactgctctacgtaattgttaccctggcggccttcacctttgcggtgggttggggacggggtggttcccctttggaaatgtttgaagcggcggtggccttggccgttagtgccattcccgaaggtttgcctgctgtggtgaccgtcaccttggcgatcggggtgaatcgcatggctaaacgtaacgccattatccgtaaactgcccgctgtggaggcgttgggtagtgccacggtggtttgctccgataaaactgggaccctaacggagaatcagatgacagtgcaagcggtgtatgcggggggcaaacattacgaagttagcggcggtggttacagtcccaaaggagaattttggcaagtgatgggagaagaagtggataacgttttgttggatggtttacccccagtgttggaagaatgtttgctgacgggcatgctctgtaacgattcccaactggaacatcggggggatgattgggcggtggtgggggatcccacggagggagcactgctagcttcggcggccaaggctggtttcagtcaagccggtttggcaagtcaaaaaccccgtttagattccattccctttgaatcggattatcaatacatggcaactctccacgatggggacggcagaacaatttacgtcaaaggttcagtggagtccttactacaacggtgtgaatccatgctcctcgatgatggtcaaatggttagcatcgaccgaggggaaattgaggaaaatgttgaggatatggcccaacagggtctaagagtgttggcctttgctaaaaaaaccgtggagccccatcaccatgcgattgaccacggggatattgaaacagggctaatatttttaggtttacagggcatgatcgacccgccacgaccggaggccattgccgcagtccacgcctgccatgacgctggcattgaagtgaaaatgatcaccggcgaccacatcagcaccgctcaggcgatcgccaaacggatgggtattgccgctgaaggggatggcattgcttttgaaggacgacagttggcaaccatgggtccggcagaattggcccaagccgctgaagatagttgcgtgtttgccagggtagctccagcacaaaaattacaactggtggaagctctacaggagaagggtcacattgtcgccatgacgggggatggggtgaacgatgccccagctttaaaacgggctgacattggcattgccatgggtaaagggggcacagaggtggctagggaatcctccgatatgttgctcacggacgataattttgcctccattgaagcggcggtggaagaaggacgcaccgtttaccaaaatctccgtaaggcgatcgcctttttgctgccggttaatggcggggagtccatgaccattttgatcagcgttttactggcgttgaatttgcccattctttccctgcaggtgttgtggttaaacatgatcaactccatcaccatgactgtgcccctagcctttgaagccaaatcaccgggcattatgcaacaggctccccgcaatcccaacgaacccctaattaccaaaaagttactgcaccgcattttactggtatccctgttcaattggattctaatttttggcatgttcgagtgggttaatcgcacctatgacgacttagccctagctcgtactatggccatccaagccctggtggccgctagggtgatttatctactcagcattagccagttagggcgtagttttctgggctatgtgacgggtaaacgtcaaaccattaccaaagcctccatactgttactgggcattgcggtggcgatcgccttacaaattggtttcagtcaactgccatttatgaatgtattgttcaaaactgctcccatggactggcaacagtgggcaatctgtttactacctatgattcccatggtgcccgtggccattctggctaaccgccttgatccttaa

SEQ ID NO: 107738 - protein, 905 aa, Synechocystis sp
MDFPTLSSYLHHHRPGEDILADLHTDPGLGLTAEAVAQRYEQYGRNELKFKPGKPAWLRFLLQFHQPLLYILLIAGTVKAFLGSWTNAWVIWGVTLVNAIIGYIQEAKAEGAIASLAKAVTTEATVLRDGQNLRIPSQDLVIGDIVSLASGDKVPADLRLLKVRNLQVDESALTGEAVPVEKAVELLPEETPLAERLNMAYAGSFVTFGQGTGVVVATANATEMGQISQSMEKQVSLMTPLTRKFAKFSHTLLYVIVTLAAFTFAVGWGRGGSPLEMFEAAVALAVSAIPEGLPAVVTVTLAIGVNRMAKRNAIIRKLPAVEALGSATVVCSDKTGTLTENQMTVQAVYAGGKHYEVSGGGYSPKGEFWQVMGEEVDNVLLDGLPPVLEECLLTGMLCNDSQLEHRGDDWAVVGDPTEGALLASAAKAGFSQAGLASQKPRLDSIPFESDYQYMATLHDGDGRTIYVKGSVESLLQRCESMLLDDGQMVSIDRGEIEENVEDMAQQGLRVLAFAKKTVEPHHHAIDHGDIETGLIFLGLQGMIDPPRPEAIAAVHACHDAGIEVKMITGDHISTAQAIAKRMGIAAEGDGIAFEGRQLATMGPAELAQAAEDSCVFARVAPAQKLQLVEALQEKGHIVAMTGDGVNDAPALKRADIGIAMGKGGTEVARESSDMLLTDDNFASIEAAVEEGRTVYQNLRKAIAFLLPVNGGESMTILISVLLALNLPILSLQVLWLNMINSITMTVPLAFEAKSPGIMQQAPRNPNEPLITKKLLHRILLVSLFNWILIFGMFEWVNRTYDDLALARTMAIQALVAARVIYLLSISQLGRSFLGYVTGKRQTITKASILLLGIAVAIALQIGFSQLPFMNVLFKTAPMDWQQWAICLLPMIPMVPVAILANRLDP

SEQ ID NO: 107739 - DNA, 2862 bp, Synechocystis sp
  CDS (1)..(2862)
atgtctgaccctgatgtgtccgtctccccagttaaggccgaggcttggtatagctatggcatcgataaaaccctgcatcggttgaccactgctccccaccgggggttggcagaaaaaactgtgatggaacgaagacgcacctatggactaaatgaaattaccacgatcgccggtcgtaataattggcaaattttgctggatcagttcaccaatgtcatgctcttgatgttgatcggggtggcaattatttctggagcattagatctgatcagcttaaggttgggggaagaaaccatggagggttttcccttcaaggacacgatcgccatttttgccattgttatcctgaacggtttattaggctatttccaggaaagtcgggcggaaaaagctttagctgctttgaagaaaatggcgtcccccaaagtccaggtactgcgggatggcgatcgccaggaaattaaggcggccagcttggtgccgggggacattattttgctggaggcgggcagtcaactctgtgccgatggccaactgatcgaagcggctaaccttctcattcgagaatcggccctaaccggggaagcccagccagtggaaaaaaatgccagtaatactggtttacctttagatactccccttggcgatcgccaaaatatggtcttttctggcaccgaagtcgtccaaggccggggcaaagtggtgattaccaacactggcatggccaccgaattgggcaaaatcgccgagatgttacagagggtggccccggaacccacccctttgcaaaaaaggatggaaaacttagccggagtgctagtgtcaggctctctcctgctggtaaccctggttattattctgggggtgtggcagagtggctggggcgaactgcggcagttggtggaaacgtccctcagcatggcggtggcggtggtgccagaaggtttaccggcggtgattacggttaccctggccctgggcacccagaggatgattaaacgccatgccctaattcgcaaattaccagcggtggaaaccctcggttccgttaacgtcatttgttccgataaaaccggcaccctcacccaaaataaaatggtggtgcgggaagtgctgacccatggcgatcgcctcagcattggcggagaaggctaccaaccccagggcaacatcatccacctctcggatggagaacagagggcgacctccggaccatggcccccggccttgcaattactgtgtctcaacgccatcctctgtaacgattctgaactgaactacaatccaggggaaatggagtggcaagtgattggggaccccaccgaaggagcattgctagtgctggccaagaaatttggctttgaccaggcacagttaagacctagttttatgcggcggggggaatttcccttttcttcggagcgcaaacgcatgggggtgattgtggaagtgccagccgaaggagagtcccccttagcaaatttattgggcattttagaaaatttggccttaacgccagggccctacctaattttttccaaaggatcgccggagttactcctcccccactgcggacaaattcataccgctgaccattgtgtacccctcaatttccagcatcaagaacaaattttgagtgataacaatctcatggccagtcggggattacgggtgttgggttttgcctgtaaatccctggcccagattcccagcacccctgacctcatagctgccgaagataatctggtgtggttgggtatggttggcatgttggatgcgccccggccagaggtacggttagcagtggaaaaatccctcgccgctggcatccgcaccgttatgattaccggtgatcatcccctaacggccctggcgatcgccaaggatttgggcatcaatcaagctggcgatcgttttttgactgggcaaaccttagaacaactacaacaaagcgatctggaagcccaggtggaagaagtgagcgtttttgccagggtttccccggaacataaactacgcattgtcaaagccttccaagctcggaatcgttttgtggccatgaccggagatggggtcaatgatgccccagccctcaagcaagcagacattggcattgccatgggtatcactggcaccgatgtgagcaaagaagccagcgacatggttttgttggacgacaactttgccaccattgtggccgccgccgaggaagggcgggtggtgtataacaacattcgtaatttcatcaaatatattctgggtagtaacgtgggggaagtgatcaccattgcgtctgctccccttttagggctatctgccgtgccccttactcccctgcaaattctctggatgaatttggtcaccgatggcttgccagccttagctttggccatggagccgggggaaccaaatattatgaagcgtcgcccctttagtccccaggaaagtattttttctcggggattgggggcctacattatccgcatcggtctggtttttgcggtggttaccatcacccttatggtctgggcctatcacagtgctgacctagctggtgcgcccgacagttggaaaaccatggtttttaccaccctctgtattgcccagatgggccacgccattgccgtacgctccaaccatcgtttaaccatagaaatgaaccctttgaccaatccctacctgtggggggccgtaattgtcaccactatcctgcagttatgcttggtgtattttgaacccctgagaaatttctttggcaccgattggctcagtccccagcaactactggtttgttttggctttagcagtttaatgttcgtctgggtggagttggaaaagttattggcccggttcatcaaataa

SEQ ID NO: 107740 - protein, 953 aa, Synechocystis sp
MSDPDVSVSPVKAEAWYSYGIDKTLHRLTTAPHRGLAEKTVMERRRTYGLNEITTIAGRNNWQILLDQFTNVMLLMLIGVAIISGALDLISLRLGEETMEGFPFKDTIAIFAIVILNGLLGYFQESRAEKALAALKKMASPKVQVLRDGDRQEIKAASLVPGDIILLEAGSQLCADGQLIEAANLLIRESALTGEAQPVEKNASNTGLPLDTPLGDRQNMVFSGTEVVQGRGKVVITNTGMATELGKIAEMLQRVAPEPTPLQKRMENLAGVLVSGSLLLVTLVIILGVWQSGWGELRQLVETSLSMAVAVVPEGLPAVITVTLALGTQRMIKRHALIRKLPAVETLGSVNVICSDKTGTLTQNKMVVREVLTHGDRLSIGGEGYQPQGNIIHLSDGEQRATSGPWPPALQLLCLNAILCNDSELNYNPGEMEWQVIGDPTEGALLVLAKKFGFDQAQLRPSFMRRGEFPFSSERKRMGVIVEVPAEGESPLANLLGILENLALTPGPYLIFSKGSPELLLPHCGQIHTADHCVPLNFQHQEQILSDNNLMASRGLRVLGFACKSLAQIPSTPDLIAAEDNLVWLGMVGMLDAPRPEVRLAVEKSLAAGIRTVMITGDHPLTALAIAKDLGINQAGDRFLTGQTLEQLQQSDLEAQVEEVSVFARVSPEHKLRIVKAFQARNRFVAMTGDGVNDAPALKQADIGIAMGITGTDVSKEASDMVLLDDNFATIVAAAEEGRVVYNNIRNFIKYILGSNVGEVITIASAPLLGLSAVPLTPLQILWMNLVTDGLPALALAMEPGEPNIMKRRPFSPQESIFSRGLGAYIIRIGLVFAVVTITLMVWAYHSADLAGAPDSWKTMVFTTLCIAQMGHAIAVRSNHRLTIEMNPLTNPYLWGAVIVTTILQLCLVYFEPLRNFFGTDWLSPQQLLVCFGFSSLMFVWVELEKLLARFIK

SEQ ID NO: 107741 - DNA, 2838 bp, Synechocystis sp
  CDS (1)..(2838)
atgaaagcttgttgctattttttcatctctatgcctccatctgcttcttttcagggccaacctttgattacctggcatactctttctgcagatcaagtcgtcagtgacttacatggcgatcgccaacaaggattaagccagcaacaggtggctgaaaatttgcaagtttatggaaaaaacgagttgatagaaacgggggggagaacttcctggaacattttagttgatcagtttacaaacattatgttgttgttgctgatcgctgttgcagtgatttcggccgcaattgatatttatcaagcccaacaattgggtaaatttatttttcctaaagatgcagttgctatttttaccgttgtattactgaatggtattttggggtatgtgcaggaacggggagcggaaaaggccctagcagccctcaaagacctatctacgtccagggtgcgagtcattcgagagggcaaaaccaccgaagtggaatccacggagttagtaccgggagacctgattctgctagaagcaggggttaaagttcccgctgacggtcgtattttagaaggggccaatctccaaattcgtgaagccgctttaacgggggaagcagaagcggtaatgaaacagggagatgtgctgttacccgccgatagtgccttgggcgatcgcctaaatttagtttactccggcacagaagttgtccagggccggggcacagtgatcgtgaccgcaacgggcatgaagacagaattaggaaaaattgcctcagccctgcaatctgtagaaccggaacccactcccctccaaaagcgcatgacccaattgggcaatgtgttagtcagtggttctttgatcttggtggcgatcgtcgttgtggggggaacgctcttcaaaccggatttgtttatgcagttggttgaagtatcccttagtatggctgttgctgtggttcccgaaggactacccgctgtaattaccgtcaccttagccttggggacccaacgcatggccaaacgcaatgcgctgattcgtcaactgagtgcggtggaaaccctcggttccgtaacgaccatctgctctgataaaacgggcactttgacccaaaataagatggtggtgcagtctattattagcgatcgccatcgtttagtggttacaggggaaggctataatcccgtcggtgagtttcaagcaggggagggagaagatttaaagattgaaaatatccccgaaattgaaaaattattaatggcatgtattctctgcaacgatgccattttacaaaaggaaaatggacaatgggcgattttaggcgatcccacggaaggggctttattggccttagcgggtaaagcaaatatttttaaacacgaacaggaacaatattttccccggataacagaatttcccttttcctcagaacgcaagcgcatgagtgtcattgtccaagatgggcagggaaaaattaacacccccgacagttatgtgatgtttgtcaaaggttcccctgagttaatcctagaacgctgtacccacattcaagtcggaagcgaaatcttacccattagtaaagaaaagcgtagttatattctcgaaaaaaataatgatttagccggccgtggcctacgggtattgggctttgccagcaaagtttggacaacgttacctgccaacaccactgatgacattgccgaacaagaattaacttggttggggctagtgggaatgttagatgctccccgtccagaagtgcgagatgccgtggctaaatgtcgggccgccgggattcgacccgtgatgattactggagaccaccccctcaccgcccaggcgatcgcccttgatttgggcattgcggaaccaggggcaagggtcgttaccagtcgggatttagacaattgcagtgaaaaagaactagcggaaattgttcatacagtcagtgtttatgccagggtttcccccgaacataaattaaaaatcgtccaaaccctccgcaaacaacatgaagtcgtagccatgaccggggatggagtcaatgatgccccggcgttaaaacaagctgatattggggtcgccatgggcatcacgggaactgatgtcagtaaggaagccagtgacatgattttattggacgataactttgccaccatcgtctcagcggtggaagaaggtcgtgttgtctacactaatatccgccgttttatccgctatatcctgggcagtaatattggcgaagttttaacaattgcggcggctcctttaatggggttgggaggcgttcccctctctcccttgcaaattctttggatgaacctggtcaccgatggagttcccgctttagccctggccgtggaaccaggcaaagcaaccgttatgcaacagtcccccaaagacccccaggaaagcatatttgcccggggtttgggttcttatatggttcgtcaaggtttgatattggccattgtgaccattgtgctgatggtgtgggcctacaactatacccccaaccatttagagggcggactttcccccaatcgctggaaaactatggtatttaccaccctctgcttagcccagatgggtcatgccctcgccattcgttctttgaccagtttgaccgttgaaatgaaccttttttccaatccttttttgctggtggctgtggtcgttacctctttattacaactgttattgatttatgttgaaccgctgcgggcattttttggaacccattatttacctgccaacgaactgtgggtttgtgttggcttcagtgccctaatttttatctggatcgaattagaaaaagtctctgttcgactgtatagtagtttcaaataa

SEQ ID NO: 107742 - protein, 945 aa, Synechocystis sp
MKACCYFFISMPPSASFQGQPLITWHTLSADQVVSDLHGDRQQGLSQQQVAENLQVYGKNELIETGGRTSWNILVDQFTNIMLLLLIAVAVISAAIDIYQAQQLGKFIFPKDAVAIFTVVLLNGILGYVQERGAEKALAALKDLSTSRVRVIREGKTTEVESTELVPGDLILLEAGVKVPADGRILEGANLQIREAALTGEAEAVMKQGDVLLPADSALGDRLNLVYSGTEVVQGRGTVIVTATGMKTELGKIASALQSVEPEPTPLQKRMTQLGNVLVSGSLILVAIVVVGGTLFKPDLFMQLVEVSLSMAVAVVPEGLPAVITVTLALGTQRMAKRNALIRQLSAVETLGSVTTICSDKTGTLTQNKMVVQSIISDRHRLVVTGEGYNPVGEFQAGEGEDLKIENIPEIEKLLMACILCNDAILQKENGQWAILGDPTEGALLALAGKANIFKHEQEQYFPRITEFPFSSERKRMSVIVQDGQGKINTPDSYVMFVKGSPELILERCTHIQVGSEILPISKEKRSYILEKNNDLAGRGLRVLGFASKVWTTLPANTTDDIAEQELTWLGLVGMLDAPRPEVRDAVAKCRAAGIRPVMITGDHPLTAQAIALDLGIAEPGARVVTSRDLDNCSEKELAEIVHTVSVYARVSPEHKLKIVQTLRKQHEVVAMTGDGVNDAPALKQADIGVAMGITGTDVSKEASDMILLDDNFATIVSAVEEGRVVYTNIRRFIRYILGSNIGEVLTIAAAPLMGLGGVPLSPLQILWMNLVTDGVPALALAVEPGKATVMQQSPKDPQESIFARGLGSYMVRQGLILAIVTIVLMVWAYNYTPNHLEGGLSPNRWKTMVFTTLCLAQMGHALAIRSLTSLTVEMNLFSNPFLLVAVVVTSLLQLLLIYVEPLRAFFGTHYLPANELWVCVGFSALIFIWIELEKVSVRLYSSFK

SEQ ID NO: 107743 - DNA, 2919 bp, Synechocystis sp
  CDS (1)..(2919)
atgggatggaaaaccatctttgttgcaccgatgaattcctccaccacggtttggtctattgccccagaagcggtttacgaaaggttggagacgagtccccaaggtttatccggcgaggaagcggcccgaagattgcaacgctatggactgaacgagctggcggaaccggtacaacgacctttatggttgcgttttgttgatcagatgacccatttcatggcgttattgctctgggtggcgggcattctggcttttgtttccggtacgccgcagttgggctgggccatttgggcggtgatttggattaatggtttatttagttttagtcaggaatttcgggccgaaaaagccctggcgaccctcaagaaagttctcccagcccaggtaaaagtttatcgggacggcactttacagtctgttctggctagggaattagtgcggggggatgtggtgcaattggaagaaggcgatcgggtatcggcggatttgcgcttagtttcagcggatagtttatacgttgatgtgtcggtgatgacgggggaatccttacccgtagctcgttttgccgaatcggcccaaattcgagaagttgtgcctaaacggggcggtcaagttttagtccatgggggggaaagggcactgcaagacccggttaaagcccaggaaattcgcaatttagtcctagccggttccaccattgccacggggcggggagtaggggttgtctatgccaccggagcggaaacggaatttggccatatggcccatctcaccaccaatgttaagcgggaacccagcaccctggaagtccaaattagccagattgtgcgggtaattaccctgattgccgttggcatgggagttttggtgtttgtgttggcgtccctggtgacccatctggaattaaaggaaagtttcatttttgccattggcattattgttgccctagtgccagaaggtttgttgcccacggtgactttatccctggccatgggggtacaacggatggccaaacgtaatgctttggtgcggcgattatcggcggtggaaaccctcagtgccactacagttatttgtacagataaaacgggaactttaactaaaaatgaaatgaccgttcgttctctttggattccggcaacgaaccatggccaaaccttaacggtgccaggggaaggctatgatcccagcacgggcaaaattacctttcccccaggtaaagatgaaaagcaacaggttaaattactgctcattggttccgctctttgttccaatgcccatttgattcatccttccggttccagccgttggcaagaaatgggagaccccacggaagcggcattattggtggccgctctgaaggcagattttgatttagaacaactccagcaagattatccccggcgcagggaagtgccctttgattcccgacgacggatgatgacggtggttttggattggcaaaaggctggggaaaatttgcctttccttacttccggcagaaatgatttgccatgggaaaatttggcttttaccaaaggtgctcccctggaggtgttgcgctgttgtcaatccattttaaaagccggacaggtgaccgaactaacctccggcgatcgccaaataattacggaggccaatgatcactacgccaaggaaggttttcgagtattgggcttggcggttcgggccgaccatgaaaatttactagaagcatcaccccaaaccctagagcaacaattaattttcgtgggtttagtggccatgtttgatcctcctcggccagaagtgcctgaggcgatcgcccgttgtcatggggccggtattgctatcaccatggtcactggggactatggcctcaccgcagaggcgatcgccagaagtattggtctagtcaaggaaaaagtacgggtagtgactggggatgggctaacccatttgtccgatgcccaactgcgacagattttaaaatatcgttctggtcttatctttgcccgcatggccccggaacaaaaactacgcttagtgcaagcttatcagggcttggggcagattgtggcggtaacgggggatggggtcaatgatgctccggcattgcgggcggccaacattggcattgccatgggcttaaacgggaccgatgtggccagggaagcggcggatattgtgcttaccgacgataattttgccaccattgtcagcgcagtggaagaaggccgcacagtttatcaaaacatccgcaagtttataacttacattttggcttccaatgtagcggagttagtaccatttttagcaatgattttcctcaacattccccccgcattactaattatgcaaattctagccattgacttaggaacggacatggttccggccttagccttgggtatagaaaaagctgaagtcggaacgatgaaattgcctccccgccaaaaaaatcaagccctattagatcgtgctttattgttaagagcttactgctttctaggcataattgaagcgggtttgggcatggccggatttttcttagtttggggaagttacggttacggattagctgagttacaagccgttacgacaagtattctccatcacacagcagatccaattttaatggctatctatgcccaggccaccaccatgaccctagcagtgattgtggcctgtcaagatggaaatgtttttgcttgccgctcagaacgcacttctgccttcaagttaggctggtttagtaatcccttaatttggattggcattgccacggaatggatgttaattttgtctttaatgtattttccttctctccaagctattttcactaccactccactgacaaattggcagtttgctctgcttctttcctgtcctcctttattgttaggagcggaggagttacggaaatttaaattcctatga

SEQ ID NO: 107744 - protein, 972 aa, Synechocystis sp
MGWKTIFVAPMNSSTTVWSIAPEAVYERLETSPQGLSGEEAARRLQRYGLNELAEPVQRPLWLRFVDQMTHFMALLLWVAGILAFVSGTPQLGWAIWAVIWINGLFSFSQEFRAEKALATLKKVLPAQVKVYRDGTLQSVLARELVRGDVVQLEEGDRVSADLRLVSADSLYVDVSVMTGESLPVARFAESAQIREVVPKRGGQVLVHGGERALQDPVKAQEIRNLVLAGSTIATGRGVGVVYATGAETEFGHMAHLTTNVKREPSTLEVQISQIVRVITLIAVGMGVLVFVLASLVTHLELKESFIFAIGIIVALVPEGLLPTVTLSLAMGVQRMAKRNALVRRLSAVETLSATTVICTDKTGTLTKNEMTVRSLWIPATNHGQTLTVPGEGYDPSTGKITFPPGKDEKQQVKLLLIGSALCSNAHLIHPSGSSRWQEMGDPTEAALLVAALKADFDLEQLQQDYPRRREVPFDSRRRMMTVVLDWQKAGENLPFLTSGRNDLPWENLAFTKGAPLEVLRCCQSILKAGQVTELTSGDRQIITEANDHYAKEGFRVLGLAVRADHENLLEASPQTLEQQLIFVGLVAMFDPPRPEVPEAIARCHGAGIAITMVTGDYGLTAEAIARSIGLVKEKVRVVTGDGLTHLSDAQLRQILKYRSGLIFARMAPEQKLRLVQAYQGLGQIVAVTGDGVNDAPALRAANIGIAMGLNGTDVAREAADIVLTDDNFATIVSAVEEGRTVYQNIRKFITYILASNVAELVPFLAMIFLNIPPALLIMQILAIDLGTDMVPALALGIEKAEVGTMKLPPRQKNQALLDRALLLRAYCFLGIIEAGLGMAGFFLVWGSYGYGLAELQAVTTSILHHTADPILMAIYAQATTMTLAVIVACQDGNVFACRSERTSAFKLGWFSNPLIWIGIATEWMLILSLMYFPSLQAIFTTTPLTNWQFALLLSCPPLLLGAEELRKFKFL

SEQ ID NO: 107745 - DNA, 2850 bp, Zea mays (maize)
  CDS (1)..(2850)
atgggaacgacggaggacaaggcgtccaacctggacgccgtgctcaaggaggccgtcgatctggaaaacatagcgatccaggaggtgttcgagagcctccgatgcagcccgcagggtctctccacggagcaggccgagcagcgcctcgccatcttcgggcccaacaagctggaagagaagcaggagagcaaattcctcaaatttttgggcttcatgtggaacccgctgtcctgggtcatggaggcggccgccatcatggccatcgcgctcgccaatgggggaaacaagccgcccgactggcaggacttcgtggggattatcactctactcatcatcaactccactattagcttcattgaggagaacaatgccggcaatgccgcggccgccctcatggcgcgcctcgcccccaaggccaaggttctcaggaacggccggtgggccgaggaggaatcggctatccttgtgccaggagacataatcagtgtgaagcttggggacatcattccagctgacgctcgtctgcttgaaggggatccactgaaaattgaccagtctgcactcaccggcgagtcgcttccggtcaccaaaggccctggtgatggagtgtactctggctccacttgcaaacagggcgagatcgaggccgttgtcattgccaccggtgtgcacacattcttcggcaaggcagcacatcttgtcgattcaacaaaccaagttggtcatttccagaaggttctcaccgccataggaaacttttgcatctgttcaattgctgtgggaatgctcgtggagatcattgtcatgtaccctatccaacacagggcttaccgatcagggattgacaatctgttggtgcttctgatcggaggaattccgatcgccatgcccactgtcctttctgtgactatggcaatcggggctcatcgcctggctcaacagggagcaattactaagagaatgacagcaatcgaagaaatggctggtatggacattctttgcagcgacaagactgggacattaaccttgaaccagttgactgttgacaaaagtcttgtagaggttttccaaagaggggttgaccaagatacagtaattctgatggctgctagagcttctcgtacggaaaatcaggatgccatagacgccacgatagttggtatgctggctgatccaacggaggctcgtgctggtgtccaagagatccattttctgccatttaatccaaccgacaaaagaactgctttaacctaccttgatggcgagggaagaatgcatcgtgttagtaagggagcaccagagcagatccttcatcttgcccacaacaagaaggatattgaaacaagggtcagagctgtgattgacaattttgctgaacgtggtctgcgagcacttggtgtagcttaccaggaagtgccagatggtaggaaagagagtcctggaggaccatgggagttcatgggcctcttgccactttttgatccccctcgcaaagatagcgcagacactatcagtaaggcactcgatcttggtgtcaatgtcaagatgattacaggcgatcagcttgctattgggaaggaaactgcacgtcgtttgggaatgggtactaatatgtacccttcatctgctttactcgaacagaataaggatgagtcaattgcttctttgccaattgatgaattgattgagactgctgatggctttgctggagtctttccagaacacaagtatgagatcgtgaagcgcttgcaagcaagaaaacatataagcggtatgaccggggatggtgtaaacgacgctccagctctgaagaaggccgatattggtattgcagtggcagactccaccgacgcagctcgtagtgcttctgacatcgtcctaaccgaagtaggccttagtgtgattatcagtgccgtgctgacgagccgtgcgatttttcaaagaatgaagaactacacgatctacgctgtatcaatcaccatccgtatcgtgcttggtttcatgcttcttgcgctgatttggaagtttgacttcccaccatttatggtcctgatcatcgccatcctcaatgatggtaccattatgactatctccaaggacagagtgaaaccatctccgcaacctgacagttggaagctagctgagatttttgcgactggagtagttcttggtacttacttggccatgatgactgtcatcttcttctgggctgcgtacaagaccgacttcttcccgcgactgttccatgtcgaaagccttgcccacgacgatttccagatgcttgcctctgcggtataccttcaagtcagcacgatcagccaggcccttatcttcgtgacgcgatctcgcagctggtcctttgtggagcgtcctgggttcttgctggtgtctgctttcttggtggcgcagctgatcgctactctgattgctgtgtatgccaactgggcgtttgctgcgatcaagggcatcggatggggctgggccggcgtcatctggctgtacaacatcgtctgctacctcccgctggacatcatcaagttcctcatccggtacgcattgagcgggagagcgtggaacctcgtccttgagcagaggatcgcattcacaagcaagaagaacttcggtgccgaggaacgagaacgcagatgggcgcatgctcagaggtctctccacgggctggagctccagccgccggaggcagcgtccatgttcgagaacaagacgagcttcagtgaagtgaaccagctcgctgaagaggccagaaggagagcggagatggcgaggtccgactgttgtttgtcgagcatctccactgaacgcggcgaccagactttgcactgccctgtctga

SEQ ID NO: 107746 - protein, 949 aa, Zea mays (maize)
MGTTEDKASNLDAVLKEAVDLENIAIQEVFESLRCSPQGLSTEQAEQRLAIFGPNKLEEKQESKFLKFLGFMWNPLSWVMEAAAIMAIALANGGNKPPDWQDFVGIITLLIINSTISFIEENNAGNAAAALMARLAPKAKVLRNGRWAEEESAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMLVEIIVMYPIQHRAYRSGIDNLLVLLIGGIPIAMPTVLSVTMAIGAHRLAQQGAITKRMTAIEEMAGMDILCSDKTGTLTLNQLTVDKSLVEVFQRGVDQDTVILMAARASRTENQDAIDATIVGMLADPTEARAGVQEIHFLPFNPTDKRTALTYLDGEGRMHRVSKGAPEQILHLAHNKKDIETRVRAVIDNFAERGLRALGVAYQEVPDGRKESPGGPWEFMGLLPLFDPPRKDSADTISKALDLGVNVKMITGDQLAIGKETARRLGMGTNMYPSSALLEQNKDESIASLPIDELIETADGFAGVFPEHKYEIVKRLQARKHISGMTGDGVNDAPALKKADIGIAVADSTDAARSASDIVLTEVGLSVIISAVLTSRAIFQRMKNYTIYAVSITIRIVLGFMLLALIWKFDFPPFMVLIIAILNDGTIMTISKDRVKPSPQPDSWKLAEIFATGVVLGTYLAMMTVIFFWAAYKTDFFPRLFHVESLAHDDFQMLASAVYLQVSTISQALIFVTRSRSWSFVERPGFLLVSAFLVAQLIATLIAVYANWAFAAIKGIGWGWAGVIWLYNIVCYLPLDIIKFLIRYALSGRAWNLVLEQRIAFTSKKNFGAEERERRWAHAQRSLHGLELQPPEAASMFENKTSFSEVNQLAEEARRRAEMARSDCCLSSISTERGDQTLHCPV

SEQ ID NO: 107747 - DNA, 3426 bp, Mesembryanthemum crystallinum (common ice plant)
  CDS (227)..(3088)
aaattctctgaggagagagagaaacgcaaagaaaagaaagaaagaaagaatcgtattctgctcatcttcttctttttctcatgatcttgataatggtttccgatcacttgtagggttttttgcgttttttcaggtgtttgatttttagttcttttttgctaaattgagttgagtttgagtcgccggaagtagccgagttgactcagtgagtccggttccggtgacaatggtcggcggtaacagttcgatgagtctccaggagatcaaagacgagaaagttgatctggagaaaattcctatagaggaagtgtttgattcgctgaaatgttcaagagaaggtctatcgtcagctgaaggagccaaccgtcttcagatttttggccctaacaaactagaagagaaaaaggacagcaaatttctgaagtttttgggctttatgtggaatcccttatcatgggttatggaagcagctgctttaatggctattgtcttggcaaatggtgatcataagcctccagactggcaggactttgtgggtatcattattctgctagtgataaactctacaatcagtttcatagaagaaaataatgctggtaatgcagcagctgcgcttatggctaaccttgctcctaaaaccaaggttcttcgagatgggcgatggggagagcaggaggcatcaatactagtcccaggggacataatcagcatcaagttaggggacattgtgcctgctgatgctcgtcttcttgagggtgatgctttgaagattgatcaatctgctctcacaggtgaatctatgcctgtcactaagaatcctggagaggaggtcttttctggttcaacatgtaaacaaggtgaactagaagcagttgttattgctactggtgtgcacaccttctttggtaaggctgcacacctggttgacagcacaaaccaggttggacacttccaaaaggtgctcacttcaattggtaacttctgcatctgctccattgcgattggaatgctgattgaaattatagtcatgtacccaattcagcgccgcaagtacagggatggtattgataatttactggtcctcttgatcggtgggatcccaattgctatgcccactgtcttgtctgttactatggctattggttcccacaggttgtctcagcagggtgccatcacgaagagaatgacagccattgaagaaatggcaggcatggacgtactttgcagtgacaagacagggacattaaccttaaacaagttgacggttgatagaaatctggttgaagtctttgcaaaaggagtggaaaaggagtatgtgatattgcttgcagctagggcttcaaggactgaaaatcaggacgctattgatgcggctattgtaggaatgcttgcagacccaaaggaggcacgcgctgggataagagaggttcactttcttccttttaatcctgtggataaaaggactgctttgacttatattgatgctgatggaaattggcatcgcgcgagcaaaggtgctcctgagcagattcttacactatgtcgctgcaaggaggatgttaagaagaaggctcatggagtaattgagaagtttgcagatcgtgggcttagatctttagctgttgcaagacaggaagtaccagagaaaacaaaagagagtcctggcggtccatggcagtttgtaggtttattgcctttgtttgatcctcccaggcacgacagtgctgaaacaattaagagagctctgaaccttggggtgaatgtaaaaatgataactggggatcagcttgccatcggaaaggagactggacgaagacttggaatggggaccaacatgtacccatcatcatccttgcttggacaagataaggactcaaatgtagcaggtctccctgtagatgaattaattgagaaggctgatggatttgcaggagtatttcctgagcacaagtatgaaatagtgaagaggttgcaagataggaagcatatttgtggtatgacgggtgatggtgtgaatgatgcccctgctttgaagagggcagatattggaattgctgttgctgatgctaccgatgcagctagaagtgcttcggacattgtcctaacagaacctggacttagtgtcattatcagtgctgtgctgaccagcagagcaattttccagaggatgaaaaactacaccatctatgctgtatctattaccatccgtgttgtgtttggcttcatgttcattgctttgatttggaagtttgactttgctccattcatggttcttatcatagcaatcctaaatgatggaacaattatgacaatttctaaggatagggtaaagccatctcccctgcccgacagttggaagttgaaagagatttttgctactggtattgttctaggaggttatcaggcaataatgacagtagttttcttctggctcgtgagagatactactttctttgtggacaagtttcatgtaaagccattgactgatggtcagatgatggcagcattatacttgcaagtcagtgctatcagccaggcccttatctttgttacgagatcccgtagctggtcctttgctgaacgcccagggcttatgctgcttggtgctttcgtggttgctcagctgatagcaactctcatagctgtctatgccaattggagctttgcaaagatagaaggaatggggtggggatgggctctagccgtatggatctacactctggtcacctacattccgcttgacatcctgaaattcactatacgttatgctttgagtgggagggcttggaataatctactggataacaagactgcttttaccacaaagaaggattacggaaaagaagagagagaagcacagtgggcagctgcacagagaaccatgcatggacttcagcctcctgaaaccactaacctcttccctgagaagagcaattacagggaactctcagagattgcagagcaagcgaagcggagggctgaggttgcaaggctaagggagctccatactttgaaaggccatgtagaatcagttgtgaaactgaaaggattagacatcgacaccatccagcaacattacaccgtttagagaagtgccacgaaaagaggcctgggagagaggcatcagttggtcgaaacttagtgctgacgatgcacaaagatgattttatgtagaacttatatccttgcaaatcaagggcatgttttttctgtttcctaaatcttaaatgttgtttaacgaccgccctctccccaaacaaaacaaacttagtctttgaggcaaaagtgacattaccaatcagcagcacagtttctgctacttttgtgctgtctttgtgcctctcttggaattttgtaaagaagcacaaataaacaattttgttatctttcatgatgatgatgatgatgatgatgatcagctaggcc

SEQ ID NO: 107748 - protein, 953 aa, Mesembryanthemum crystallinum (common ice plant)
MVGGNSSMSLQEIKDEKVDLEKIPIEEVFDSLKCSREGLSSAEGANRLQIFGPNKLEEKKDSKFLKFLGFMWNPLSWVMEAAALMAIVLANGDHKPPDWQDFVGIIILLVINSTISFIEENNAGNAAAALMANLAPKTKVLRDGRWGEQEASILVPGDIISIKLGDIVPADARLLEGDALKIDQSALTGESMPVTKNPGEEVFSGSTCKQGELEAVVIATGVHTFFGKAAHLVDSTNQVGHFQKVLTSIGNFCICSIAIGMLIEIIVMYPIQRRKYRDGIDNLLVLLIGGIPIAMPTVLSVTMAIGSHRLSQQGAITKRMTAIEEMAGMDVLCSDKTGTLTLNKLTVDRNLVEVFAKGVEKEYVILLAARASRTENQDAIDAAIVGMLADPKEARAGIREVHFLPFNPVDKRTALTYIDADGNWHRASKGAPEQILTLCRCKEDVKKKAHGVIEKFADRGLRSLAVARQEVPEKTKESPGGPWQFVGLLPLFDPPRHDSAETIKRALNLGVNVKMITGDQLAIGKETGRRLGMGTNMYPSSSLLGQDKDSNVAGLPVDELIEKADGFAGVFPEHKYEIVKRLQDRKHICGMTGDGVNDAPALKRADIGIAVADATDAARSASDIVLTEPGLSVIISAVLTSRAIFQRMKNYTIYAVSITIRVVFGFMFIALIWKFDFAPFMVLIIAILNDGTIMTISKDRVKPSPLPDSWKLKEIFATGIVLGGYQAIMTVVFFWLVRDTTFFVDKFHVKPLTDGQMMAALYLQVSAISQALIFVTRSRSWSFAERPGLMLLGAFVVAQLIATLIAVYANWSFAKIEGMGWGWALAVWIYTLVTYIPLDILKFTIRYALSGRAWNNLLDNKTAFTTKKDYGKEEREAQWAAAQRTMHGLQPPETTNLFPEKSNYRELSEIAEQAKRRAEVARLRELHTLKGHVESVVKLKGLDIDTIQQHYTV

SEQ ID NO: 107749 - DNA, 3451 bp, Cyanidium caldarium
  CDS (340)..(3207)
atcgataagcttgatatcgaattcctgcacccccccccccccccctggtggcgacgactcctggagcccgtcagtatcggcggaattcgtcgacccacgcgtccgaaaccgtctttctttggccagtgtctgcgagtgcgctttcatcgctatccgtgtcagcgcacgagccagttttgtattggaggctttttctgcggcactgggacgacgtttgaacgtacaacgatagctgtacttgggcagcgctggaacgtttcgcggtaaactcgagacgtacgcgtcgcttctttctatcttagcaaggcacggaaacgaagtgccgaacagcaaatcattatggcggacgtcgagtctggaaactcgcaggtgaatggagggaatgaggtggacggcacgaacggttcatctagtttgagggcggagtctaaaccgttacccgccgacttggataagcgttcgttgtctatgagcatgctggaaacggtagaccttgagaaggatgacatggactatgtgatggcgtgtttgaagacgtcgcccgaggggttgaagccggatgttgcagcgcgtcgtttagcaaagtttggtccgaatgcgctacccgagaagaaggttaacccgattctggagttcttgatgtttatgtggaatcctctgagttgggtgatggaggcagctgctttggttgccatctttttgacaattcctggtgggaaagctcctgattgggaagattttcttggcattctcttgctgcttttgatcaactccacgatcggtttcattgaggaacgcaatgctggcaatgctgtgaaagcacttatggatgcactggcgccccgggccaaggtgcaaaggggtggtgaatggctcgatatcgatgcgaaagatctcgtcatcggtgatattgttgcgttgaaactgggcgatgtgatccctgctgatgcgcggatcatgaacggcaaggatatcaagattgaccaagcagcgctcaccggtgaatcgcttcctgttggaaaagaaaaaggtgatatgatctattcaggatctgtggtgaaacagggagagttcctggcgcttgtgattgccaccggcatgaacacgttctttggcaaagctgctcacctggtgaatcagacagagagcacttcacatttgcaggcgattgtctctgcgatcggcctctactgtatggcctggatcagcacctttgttcttctcttgattgtaacgcagtggccaatacatttggagaactatcgtcatggaatcaacaacatcctggtgctcttgatcggtggtgtccccatcgcgatgcctgttgtgctctcggtcacactggctatcggtgcgcacgaacttgccgaacaaaaagcgatcgtcacccggatgactgccgtcgaagaactcgcaggtatgaccatcctctgctcggataagactggtacgctgaccctcaacaaactttcgattgaccaagaaagcttctttaccatgggcggctacaccgtcgataccgtcgaccagtgcatggtcttcgctgctcgtgcgtctcgcacagagaaccaagatgccatcgactttgcggtggtcaactctctaccagatcccaagatggcccgcgaaggcattgaagagctggactttcatccgttcaacccggttgataagcgcacagaaatcacctaccgcgacaacaaagatggcaaagtctacaaagcaaccaaaggggcaccccagatcatccttggcatggcccacaacaagaaggaaattgaaaaagaagttcatgaacagattgaagatttcgcgaaacgcggcttccgtgcacttggcattgcagtcgcggaggtgccgtccggagaggcgcacggcgaacccggcccctggtctatggtcggtttgatgcctattttcgacccgccgcgtcacgacacgaaggagacgatcgagcaagccatcgccatgggtgtcgaagtgaagatgatcaccggtgaccagctggcgatcgccaaggaaaccgctcgtcgtcttggaatgggcacgaatatcttcaacacggatgtgctgaatttgagcgaccagcgggcctccatcgagtacggtggcagtgtcggtgagttggtggaaagtgcggatggtttcgctggcgtctttccggagcacaaatatcgcatcgtggaggtgcttcaacggcgtggccatatggtcggcatgacgggtgacggtgtgaacgatgcgcccgcgctgaagagagcatctgtgggcattgcggtggctggcgccaccgacgcagcccgtggagcctcagacattgttttaacagaaccaggtctgagcgtcatcattcatgcgatggtcatgagccgtcagattttccagcgtatgaagaactattccatgtacgcttgctcagtgacggtccgtattgtggtgactttttcgattctggtctgggcgttccgcttcaacatgccaccttttctggtgctgattcttgcgtatctgaatgacggcacaatcatgacaattagcaaggatcgagtgaaaccgagtccactgccgcagcgatgggatctgaaggaggtctttattgtggcctcctcattgggtatctacctgacggcaagcacggtgatcttctacgtgaccctcttcaagacacagttctggcatgatacgttcaagctagggatgccatggctgaaccctcgagatccaaactacttccagctgcattctatcatctacctacaggctagcatcatcggccaagcgctgattttcgtcacccgtgcacactggttcttctttatggatcgtcctggtatcctgctcatgagcgccttcgtcgttgcccagcttgtcgctacatttatctgcgtctatgcgaactggggtttcactcagattcagggaactggttggggctgggctggagtcgtctgggtctggaacgtcatctggtacgcacctttggacattattaagatcgctgtgcgaagcattatcactggcgacaagaccccaatccataagctcttcgcagcacggcgcatgtttacattcgactactcgaagcatggtcgcgaaggtcgcatgccgcgcagcagcctccaggcagctcaagcgcgcgcgtctgtgcatcgctcaatggagacatatcgagcctcgctgcagaagaatgtgaattccctggactagcacaagcggatgcgagcaaagtagtgattccagactgggaaagggccgtgcaacggacacggcaacacgccgcggtggaaaaacatagcgaacaaaaggtggttcatggcgtcgtccgacagatggcgagtgtactactggctcagaggaacggtttctgaatgtgtaaaacagcgcagcatcgtgctcaaaaaaaaaaaaaaaaaaaaaaaaaaaaaaaaaaaaaaaaaaaaagggcggccgc

SEQ ID NO: 107750 - protein, 955 aa, Cyanidium caldarium
MADVESGNSQVNGGNEVDGTNGSSSLRAESKPLPADLDKRSLSMSMLETVDLEKDDMDYVMACLKTSPEGLKPDVAARRLAKFGPNALPEKKVNPILEFLMFMWNPLSWVMEAAALVAIFLTIPGGKAPDWEDFLGILLLLLINSTIGFIEERNAGNAVKALMDALAPRAKVQRGGEWLDIDAKDLVIGDIVALKLGDVIPADARIMNGKDIKIDQAALTGESLPVGKEKGDMIYSGSVVKQGEFLALVIATGMNTFFGKAAHLVNQTESTSHLQAIVSAIGLYCMAWISTFVLLLIVTQWPIHLENYRHGINNILVLLIGGVPIAMPVVLSVTLAIGAHELAEQKAIVTRMTAVEELAGMTILCSDKTGTLTLNKLSIDQESFFTMGGYTVDTVDQCMVFAARASRTENQDAIDFAVVNSLPDPKMAREGIEELDFHPFNPVDKRTEITYRDNKDGKVYKATKGAPQIILGMAHNKKEIEKEVHEQIEDFAKRGFRALGIAVAEVPSGEAHGEPGPWSMVGLMPIFDPPRHDTKETIEQAIAMGVEVKMITGDQLAIAKETARRLGMGTNIFNTDVLNLSDQRASIEYGGSVGELVESADGFAGVFPEHKYRIVEVLQRRGHMVGMTGDGVNDAPALKRASVGIAVAGATDAARGASDIVLTEPGLSVIIHAMVMSRQIFQRMKNYSMYACSVTVRIVVTFSILVWAFRFNMPPFLVLILAYLNDGTIMTISKDRVKPSPLPQRWDLKEVFIVASSLGIYLTASTVIFYVTLFKTQFWHDTFKLGMPWLNPRDPNYFQLHSIIYLQASIIGQALIFVTRAHWFFFMDRPGILLMSAFVVAQLVATFICVYANWGFTQIQGTGWGWAGVVWVWNVIWYAPLDIIKIAVRSIITGDKTPIHKLFAARRMFTFDYSKHGREGRMPRSSLQAAQARASVHRSMETYRASLQKNVNSLD

SEQ ID NO: 107751 - DNA, 3453 bp, Dictyostelium discoideum
  CDS (40)..(3216)
tttaaataatctttaaaaaaaaaaaaaaaaaaaaacaaaatggataataatcaaattccaaaaaattcaccagagtcatctgcaatcaattcagcagagtcctcaccaaaatcaaatgttagtagtgatgttttacatgaaaatcatcacaaagaacaacaacaactccaacaacaacttcaacaagaacaacaacaacaacaacttccaacaacacctcaatcagaaccaactcaacgtgttaataacaatgaagaaggtattgagatggatagaattgccgaaaattcaaatattaatgttccatcagatgttggagaatcatccttgaaaaccatttcaggttacccaagcagtaaaaatactgaagctggtagcagtagtagtggtaaaaaggaagaagattataactatagatcaacttgggtaccaaaacttcatcaagaattatttgaaaatccagaagttttggagtcaagaagaactaaacaaagagcttccaattatagaaaaactcttgaaagagaaaaagaaggtatcaaaccattagataatattttagaagaattaaaagcaaatgcaaatggtttaacaaaagctgaagctcaaaaaagattagaagaagttggaccaaatgcaattccagatgttaaaagatatccaattttagaatttttatattttatgtggaatccattatcatggactatggaagttgcagctattgtatcaattgcattattagattgggttgattttatattgatttgtgcattattacttttgaatgcaaccattggtttcattgaagagaatacagcaggtaatgcagtagaggctttaaagaattcattggttagtcaaatccgttgtatgagagatggtgaatgggttatgttaccatcaccagatcttgtaccaggtgatgttgtaatgttaaagattggtgccattattccagccgattgtagagttatcgaagctgaacaagttaaaatcgatcaatcttcattgacaggtgaatctttaccagtcactaaaaagattggtgatgaagtttactctggttcagcaatgaaacaaggtgaagcaaaatgtgttgtcactgcaactggtgtaaacactttctttggtcgtgctgcaaatttagtacaagaaaccgaaggacatggtcatcttcaagttattcttagaaatattggtctcttttgtattagtttcatcgccatttgggtactcgttgaattattagttgatttcttgggttacgatggttattgtcatggtgttggtggtggtcgttgtttaccattgaacaatgctttggttttattggttggtggtattccaattgctatgccaactgtactttcagtaaccatggctattggtgcaactcaactctctaaaaagaaagccatcgtctctcgtttagcatccattgaagaattggctgctatggatatcttatgttccgataaaactggtactctcactttaaatattttaaccgttgatgaaccattaccagttggcgatacaccaaaagaagatattgttttccatgcattcttggcttgttccgaagcgaagaccaagatgcaatcgataaggcaatctcaaactattgtcgtgatacctatccaaatgttgactactctggtaatgaaatcgttaaacattacccattcaacccagaagataaaaaagcaatgggtctttgtaaatgcaaatggtaaacaatttaaaactgccaaaggtgctccacaaatcattttaagagaagctgataattacaaacaagttggtgaagccgttgaaaaagaaattgaaaatcttgctgatcgtggttatcgtgctttgggtgtttcagtctcttatgatgcaccagactttaaggtatggcatttcgaaggtttaattccactctttgatccaccaagacatgatactgaggataccatcaaacgtgcactcgaaatgggtgtatcagttaaaatgatcactggtgatcaattggctattgctaaagaaaccgcaagacgtttaggtatgggtggtaatctctttactattccatatcttgaaaacaatgatttaggtatctctgaaggtgaagtcattgaaatggctgacggtttcgcagaaatgtggccagaacacaagtacaaagtcgtagatcaactccaaaagagaaaacatgtagttggtatgactggtgatggtgttaatgatgcaccagccttaaagaaagctcaaattggtattgctgtagcaggtgctaccgatgctgctcgttccgtctctgatattgtcttaacatcatctggtctctctgttattatcgatgcaattatctcatctcgtaagattttccaacgtatgagaaattacgttatctactctgttgctgcaaccgttcgtatttgtacaacctttggtattctcacagtcgcttggaactttaaattcccaaccattgcaaccgttatcatcgccattttgaatgatggtaccatgttaacaatctctaaagatcgtgtaagagctagaaatgaaccagatcaatggaatcttttcgaagtattcactatggcactttgttatggtttctatttagtaggttcaaccattgtattctttgcaatcattcatgatggtacttggttccatgatgctatcaatcttcgtatcttaaccgataatgaacttcgtggtctcatctatcttcaagtctctatctctggtcttgcaactattttcgtatcacgtagtcaaggtttctcttactttgaacgtccaggtaatcttgtaatctttgctttcgttatgtctcaaattgttgctacctttattggtgtctatggtttccgtggttatccacatgattccttttccgataatccagattatccagtacatggtacaaatttccaaggttgtggttggggttgggctgtttgtgcttggatttggtgtttcctttggtacattccaatggatttcattaaattaggtgtcacctatattctccgtggtaagattgaaccaatcaataaagatgcactccgtaaaatctatggttggtttggtaaagaaatcccaaaggaagcaactcaagtctctcataaagttgctgaacaacaagctaaaagagatgctttacatgcacaagaaacccatcataaatctgttgttaccgataataaagtttaaaataacaataatatttaaataatgtataataattagttttaataattttatgcaacatagaaaaaatatttattatttattatgttggggttccattaatttcaacaattgttatgttggcaaaaaatacagtacaatttgttggtaattggtgttggattggtgtaagtttcactggatatagatttgggttattctatggtccattcttatttatttgggcaatttcagcagatt

SEQ ID NO: 107752 - protein, 1058 aa, Dictyostelium discoideum
MDNNQIPKNSPESSAINSAESSPKSNVSSDVLHENHHKEQQQLQQQLQQEQQQQQLPTTPQSEPTQRVNNNEEGIEMDRIAENSNINVPSDVGESSLKTISGYPSSKNTEAGSSSSGKKEEDYNYRSTWVPKLHQELFENPEVLESRRTKQRASNYRKTLEREKEGIKPLDNILEELKANANGLTKAEAQKRLEEVGPNAIPDVKRYPILEFLYFMWNPLSWTMEVAAIVSIALLDWVDFILICALLLLNATIGFIEENTAGNAVEALKNSLVSQIRCMRDGEWVMLPSPDLVPGDVVMLKIGAIIPADCRVIEAEQVKIDQSSLTGESLPVTKKIGDEVYSGSAMKQGEAKCVVTATGVNTFFGRAANLVQETEGHGHLQVILRNIGLFCISFIAIWVLVELLVDFLGYDGYCHGVGGGRCLPLNNALVLLVGGIPIAMPTVLSVTMAIGATQLSKKKAIVSRLASIEELAAMDILCSDKTGTLTLNILTVDEPLPVGDTPKEDIVFHAFLACSEAKTKMQSIRQSQTIVVIPIQMLTTLVMKSLNITHSTQKIKKQWVFVNANGKQFKTAKGAPQIILREADNYKQVGEAVEKEIENLADRGYRALGVSVSYDAPDFKVWHFEGLIPLFDPPRHDTEDTIKRALEMGVSVKMITGDQLAIAKETARRLGMGGNLFTIPYLENNDLGISEGEVIEMADGFAEMWPEHKYKVVDQLQKRKHVVGMTGDGVNDAPALKKAQIGIAVAGATDAARSVSDIVLTSSGLSVIIDAIISSRKIFQRMRNYVIYSVAATVRICTTFGILTVAWNFKFPTIATVIIAILNDGTMLTISKDRVRARNEPDQWNLFEVFTMALCYGFYLVGSTIVFFAIIHDGTWFHDAINLRILTDNELRGLIYLQVSISGLATIFVSRSQGFSYFERPGNLVIFAFVMSQIVATFIGVYGFRGYPHDSFSDNPDYPVHGTNFQGCGWGWAVCAWIWCFLWYIPMDFIKLGVTYILRGKIEPINKDALRKIYGWFGKEIPKEATQVSHKVAEQQAKRDALHAQETHHKSVVTDNKV

SEQ ID NO: 107753 - DNA, 3249 bp, Schwanniomyces occidentalis
  CDS (1)..(3249)
atgtcgtcaattaatactaatgtggcggagaaacatagctataaagaaagagtaaatacagatgcgtcttcattaagtgcagatggatcggtggaagctcataggttgactattgagcaagttgcaaaaatttttaatacagacataatcaatggattaagcaccagtcaagccaatcaaacgttaaaagactttggagcaaataccttaggagatggagataagatatcattgactaaaatcatagcacaccaggtttgcaatgcaatgattttagttttgattatttctatggttatcgcgttagcgattaaagactggatctcaggtggtgttatcggatttgttgtcttaattaatatatccgttgggtttgttcaagaatacaaggctgagaagacaatgggatctttaagatctcttagttcgcctacagctagagttactagaaatggggatgatacaacgattccagctgaagaagttgttccaggtgatattgtccatattaaagttggagatactgttccagctgatttgagattaattgacttgatgaacttggaaacagatgaagctttgttgacaggggagtctttaccaattactaaaaatcacttagacgtttacgatgattattctgtgcctattccagtcggtgatagattgaacttggcttattcttcgtcggtagtttcaaaaggaagaggaactggtattgtcattgcaacagcattagacacccagattggtcaaattgcaaaatctttaaggaacaataattccgttattagaaaagtcgataaatcaaatggtaaacctaagaaaagagaatattctaaagctttttgtggtaccataaaggatatcttttataatattttgggtattaatgtcggtactccattacaaaggaaattatcttggttagcaatctttttattttggggttgccgttatttttgcaattattgtaatgggatcccaaagaatagagttaataaggaagtagcaatttatgctatttgtgttgccttgtcaatgatcccatctgcattgattgtagttttgaccattacaatggctgttggtgcccaagttatggtgatgaaacatgtgattgttaggaagttagattccttagaagccttaggtggtataaatgacatttgttccgacaaaactggtactttaactcaaggaaaaatgatagctagaaagacctggattccaaatgttggtacatttaatgttggcaactcaaatgatccatttaacccaaaagccggtgaagtttcatttgtaaacttaagtcctaaattcattgaagaaacagacgaagaaattgattttaaacagaagttaccatctccatttccagaaaattttaataactggttactaactgctacattagcaaatattgctactcttaatcaatccagagatgaagaaactggtgaattagtttggaaagcccatggggatgccactgaaattgctattcaagttttcacttcaaggttaaattacggtagagattccttaattgaaaattatgaacatttagctgagtttccatttgattcatcgattaaaagaatgtcagcagtttatcaaagtttacaaactaatcaaattaaagtttatactaaaggagcagttgagagggttttaaattgttgtactcattggtatggtcatgaagaaaatgatgaattatatgataatcaacaacttaaagaattaactgatgatgataaacatttaattgagtcaaatatgaatgctttatctacccaaggtttaagagttttagcctttgctactaaagatattactaattcttctattgatttatccaatagagaaagcattgagtcaaatttgatctttcaaggtttaatcggtatttatgatccaccaaggccagaaactgctggatcagttaaatcatgtcataatgcagggattaatgtccatatgttaaccggtgatcatcctggtactgctaaagcaattgctcaagaagttggaattttaccacataatttatatcattacagtgaagaagttgttaaggcgatgtgtatgaccgctaacgaatttgattctttaagtgatgatgaaattgataaactacctgtattaccgttagttattgctagatgtgcaccacaaacaaaggttagaatgattgaagctttacaccgtagaggaaagttcgttgcaatgaccggtgacggtgttaatgattcgccatctttgaaaaaagctgatgtcggcattgcaatgggtcttaatggttctgatgttgcgaaagacgcttcagatattgttctaactgatgataattttgcttctattttgaatgctattgaagaagggagaagaatgtcatcaaatatacaaaaatttgttttgcagttattagcggaaaatgttgctcaagctttgtacttaatggtcggattggcatttattgacgattctggtctttctgtttttccattatcgccagttgaagttttatggattttggtggttacttcttgtttcccagcaatggatttaggtcaagaaagggccagtgatgatatcttagaggaatcaccaaatagtacaatttttacctgggaagtcataattgatatgattgtttatggattttggatggctgtttgttgtttagtttgctttgtgattattgtctatggagaaggtgatccttatttaggtgttaattgtaataaatcctccagctcaaattcagatgtctgtgaattagtgtttagaggtagatcagcatcatttgcaactatgacatggtgtgccttaatcttagcttgggaatgtattcatccttataattcattattttatatgagacaagatacagaccacccatggtggaaacaaactgttattgatttatgggataatcaattcttattctggtcagttgctattggatttataagtgtgttcccagttgtttatattccagttatcaatactaaagttttcctacacggtccaatcggctatgaatggggtcttgcagttggatttagtatattgtttttggctggttcagagttatggaaatggattaaaaggatacacaagcgtaaagcaaacaaaaaagctaagaatcctgaatatgaattagaaagaagtgatccattcaaaaaatatgcttcattttcaagatccaacacgatggatagacctgaacttatggtttaa

SEQ ID NO: 107754 - protein, 1082 aa, Schwanniomyces occidentalis
MSSINTNVAEKHSYKERVNTDASSLSADGSVEAHRLTIEQVAKIFNTDIINGLSTSQANQTLKDFGANTLGDGDKISLTKIIAHQVCNAMILVLIISMVIALAIKDWISGGVIGFVVLINISVGFVQEYKAEKTMGSLRSLSSPTARVTRNGDDTTIPAEEVVPGDIVHIKVGDTVPADLRLIDLMNLETDEALLTGESLPITKNHLDVYDDYSVPIPVGDRLNLAYSSSVVSKGRGTGIVIATALDTQIGQIAKSLRNNNSVIRKVDKSNGKPKKREYSKAFCGTIKDIFYNILGINVGTPLQRKLSWLAIFLFWGCRYFCNYCNGIPKNRVNKEVAIYAICVALSMIPSALIVVLTITMAVGAQVMVMKHVIVRKLDSLEALGGINDICSDKTGTLTQGKMIARKTWIPNVGTFNVGNSNDPFNPKAGEVSFVNLSPKFIEETDEEIDFKQKLPSPFPENFNNWLLTATLANIATLNQSRDEETGELVWKAHGDATEIAIQVFTSRLNYGRDSLIENYEHLAEFPFDSSIKRMSAVYQSLQTNQIKVYTKGAVERVLNCCTHWYGHEENDELYDNQQLKELTDDDKHLIESNMNALSTQGLRVLAFATKDITNSSIDLSNRESIESNLIFQGLIGIYDPPRPETAGSVKSCHNAGINVHMLTGDHPGTAKAIAQEVGILPHNLYHYSEEVVKAMCMTANEFDSLSDDEIDKLPVLPLVIARCAPQTKVRMIEALHRRGKFVAMTGDGVNDSPSLKKADVGIAMGLNGSDVAKDASDIVLTDDNFASILNAIEEGRRMSSNIQKFVLQLLAENVAQALYLMVGLAFIDDSGLSVFPLSPVEVLWILVVTSCFPAMDLGQERASDDILEESPNSTIFTWEVIIDMIVYGFWMAVCCLVCFVIIVYGEGDPYLGVNCNKSSSSNSDVCELVFRGRSASFATMTWCALILAWECIHPYNSLFYMRQDTDHPWWKQTVIDLWDNQFLFWSVAIGFISVFPVVYIPVINTKVFLHGPIGYEWGLAVGFSILFLAGSELWKWIKRIHKRKANKKAKNPEYELERSDPFKKYASFSRSNTMDRPELMV

SEQ ID NO: 107755 - DNA, 2700 bp, Schizosaccharomyces pombe
  CDS (1)..(2700)
atgagtgttcaatatgatgcattcagtgttgagcaaacttgtgcggatttagaaactgacatgtataatggcctctctagtctccaggagatcacgcgacgtaacaaggttcatggagataatgatttgaaggtagaagatgaagaaaacatggtggttcaatttcttaagcaatttgttaaagatcccctaattcttttgctttttgcaagttctgcaatttcggtgacattgggtaatatagatgatgctattagcatcgctttagctatagttattgtcgtgactgttggatttgttcaagagtatcgatctgagcaatctttaaaggcgctgaataaccttgtacctcattattgcaatgttatccggtccggaaaaacggagcatattgttgctagtaaattggttcctggagatttagttatcttacaaattggtgatcgtgttcctgctgatctgcgaatcgttgaagctaccgagttggaaattgatgaatcaaatctaacaggggaaaactcgccacgaaagaagagtagcgaagctatatcttcaaacatatctcttactgaaagaaataacatagcttttatgggtaccctcgttcgtcatggtcatgggagaggaatagttgtcgctactggatctgatacggaattcggtcgtgttttccttactatgcagcaaactgaaaaaccaaagacgccattgcagaacagtatggatgacttaggcaagcaactctctttaatctctttaattggtattgccgtcattgtgcttgttggttttttccaaggtaaaaattggttagaaatgcttacaattggagttagtttggctgtcgccgctattcctgaaggtcttccaattatcgtaacagtcacccttgctttaggcgtgttacgcatgtctaagaagagggctattatccgtcggttacccagtgttgaaactttgggaagtgttaacgttatttgttcggacaagactggtactctaacaatgaaccatatgacagttactaaaatttatacatgtggaatgttagcagctttctccttaccagaaagtgaacatatagagctaagtgttaggcgcactgttggtatcgaaaaggcacttctagctgctgctttatgcaacaatagtaaagttcataacaaagctgattctattttggacactacttgtccctgggctggatttccagttgatgtcgctttaatcgaatgttctgagcgattcgggttgaaggatcctcgtgaaacgtacagtcgtatatctgaggtttcatttagcagtgagcgcaaatacatgtctgttgctgtccaatacaactctagcaaaatgaatttcatgaagggagccactgaacaagtgctgtcaagttgtgcatattttagcgatcaggatggtgttcaacacgagcttactgcggaaatgaaggagaacattcaacgtaacgagtttgaaatggctgcttcgggactcagaattatagctgttgccagtggtataaataccaataaacttgtatttcatggtctttttggcatcaacgatccccctcgaccccaagtccgcgaaagtgtacaatatctaatgactggaggggttcgagttattatgattacaggtgatagcgttgttactgcaataagcatcgctagaagtttgggtatggctattcctagtaatgacgaagaagcaattcgtaactatgcgctgactggagctcagttagatgatcttgattcttcctctttacgtgatgccgtttcccgtgtagtagtctttgcaagaactacacctcaacataaaatgaaaattgttgaagcccttcaaagccttggtgatgttgtggctatgactggtgatggcgtaaacgatgcacctgccctcaaacttgcagacattggtatagcaatgggtcgacaaggtacggatgttgccaaagaagcggctgatatgattcttaccgatgattcttttgcgactattttgagtgctgttgaggaaggtaagggaatattcaataacattaaaaatttcattactttccaattgtctacgagtgtggctgctctttcattaatcgccatttcgtctgttttcggcttccaaaatcccctcaatgccatgcaaattctttggatcaatattctaatggatggaccccctgcacaaagtctcggagtagagtcagttgatgaagacgtgatgatgaaacctcctcgtccaaggaatgctcctattatatcagttcagcttttacaacgtgttttactcagtgcatttataatagttactgtcactattgtggtatttagagtacaaatgcaagacggcaatgtaacagctagagatactactatgacttttacttgttttgttttcttcgatatgtttaatgctttagcatgtcgttccgaaacaaaatcggttttcaagcttggtattttctctaatagaatgttcaatatcgcagtcggaggctcattaattggtcaagccttggtagtttatgcttccccctttcagcgtatttttcaaactgaagctattggacttaaagatgttctaatattgttagcttgtaccagttctgttctctgggttgacgaaattcgcaaatggtatcgtcgccgtaaaggtcttgttagaacaaagagcaattatctgctaaggaatgtataa

SEQ ID NO: 107756 - protein, 899 aa, Schizosaccharomyces pombe
MSVQYDAFSVEQTCADLETDMYNGLSSLQEITRRNKVHGDNDLKVEDEENMVVQFLKQFVKDPLILLLFASSAISVTLGNIDDAISIALAIVIVVTVGFVQEYRSEQSLKALNNLVPHYCNVIRSGKTEHIVASKLVPGDLVILQIGDRVPADLRIVEATELEIDESNLTGENSPRKKSSEAISSNISLTERNNIAFMGTLVRHGHGRGIVVATGSDTEFGRVFLTMQQTEKPKTPLQNSMDDLGKQLSLISLIGIAVIVLVGFFQGKNWLEMLTIGVSLAVAAIPEGLPIIVTVTLALGVLRMSKKRAIIRRLPSVETLGSVNVICSDKTGTLTMNHMTVTKIYTCGMLAAFSLPESEHIELSVRRTVGIEKALLAAALCNNSKVHNKADSILDTTCPWAGFPVDVALIECSERFGLKDPRETYSRISEVSFSSERKYMSVAVQYNSSKMNFMKGATEQVLSSCAYFSDQDGVQHELTAEMKENIQRNEFEMAASGLRIIAVASGINTNKLVFHGLFGINDPPRPQVRESVQYLMTGGVRVIMITGDSVVTAISIARSLGMAIPSNDEEAIRNYALTGAQLDDLDSSSLRDAVSRVVVFARTTPQHKMKIVEALQSLGDVVAMTGDGVNDAPALKLADIGIAMGRQGTDVAKEAADMILTDDSFATILSAVEEGKGIFNNIKNFITFQLSTSVAALSLIAISSVFGFQNPLNAMQILWINILMDGPPAQSLGVESVDEDVMMKPPRPRNAPIISVQLLQRVLLSAFIIVTVTIVVFRVQMQDGNVTARDTTMTFTCFVFFDMFNALACRSETKSVFKLGIFSNRMFNIAVGGSLIGQALVVYASPFQRIFQTEAIGLKDVLILLACTSSVLWVDEIRKWYRRRKGLVRTKSNYLLRNV

SEQ ID NO: 107757 - DNA, 2886 bp, Arabidopsis thaliana (mouse-ear cress)
  CDS (1)..(2886)
atgacggacatagaagctctcaaggctatcaccacggagagcattgatctggaaaatgttcccgttgaagaggtttttcaacatctcaaatgcacgaaagaaggattgacctccaatgaagtgcaggagcgacttaccttgtttggttacaacaaacttgaggagaaaaaggagagtaagatactcaagttcttgggattcatgtggaatccactttcatgggtcatggaagctgcagccctcatggccattggtcttgcacatggaggaggaaagccagcggattatcacgatttcgtgggtattgtggtcttacttttgataaactcgacaatcagttttgtagaagaaaacaatgctggaaatgcagctgctgctctcatggctcagttagcccctaaagcgaaggccgtccgcgatggcaaatggaatgagatagatgcagctgagttggttccaggagatatagttagtatcaaacttggagatatcattcctgctgatgctcgtcttcttgaaggagaccctttaaagattgaccaggcaacacttacaggtgaatctcttccggtaaccaaaaatcctggtgcttcagtgtactctggttcaacttgcaagcaaggtgaaattgaagcagttgttatagcgactggtgtccacactttctttggaaaggcggctcatcttgtggatagtactacgcatgtcggtcacttccagaaggttttgacagcaataggaaatttctgtatctgctcgattgcagtaggaatggcaattgaaatcgttgttatatacggtcttcaaaagagagggtaccgtgttggtattgataaccttcttgttttattgattggtgggatccccattgcaatgcctactgttctctctgttacaatggcaattggtgctcatcgcttggctcaacagggtgccataacaaagagaatgacagccattgaagaaatggcaggaatggatgttctgtgcagtgataaaacaggtactctcacgctcaacaagctttctgtggataagaatctgatcgaggtttttaagaggggcatcgacagagatatggctgtgcttatggctgcaagagctgcacgtttagagaaccaagatgctattgatactgcaattgtttcgatgttgtcagacccgaaagaggcacgtgccgggattaaagaactccattttcttccattcagtccagctaatagaagaactgcactaacgtacctagacggagaaggcaaaatgcaccgagtgagcaaaggcgcgcctgaagagattttggatatggcccacaacaaattagaaatcaaggagaaagtacatgctacaatcgacaaatttgcagaacgtggcctaagatcgcttgggttggcatatcaggaagtaccagatggtgatgttaaaggtgaaggtggtccatgggactttgtagctcttcttcctctgtttgatcctcctcgtcatgacagtgcacagacaattgagcgagcacttcatcttggagtcagtgttaaaatgatcacaggtgaccagcttgcaattgccaaagaaacaggaagaaggcttggaatgggcacaaacatgtacccatcttcatctttgctttctgataacaacactgaaggagtttctgtcgatgaacttatcgagaacgcagatggttttgcaggagtctttcctgagcataagtatgagattgtgaagagattacaatcccgaaaacacatatgtggtatgactggtgatggagtgaatgacgcacctgccttgaagaaagctgatattggaattgctgtggatgatgccactgatgctgctcggggtgcttctgatattgtcttaacagaacctggacttagtgttatcatcagtgctgtcttgactagccgtgcaattttccagagaatgaaaaattacacgatatatgctgtttctatcactatacgtattgtcatgggtttcatgcttctatgtgtcttctgggagtttgacttccctccattcatggttcttgtaattgcaatccttaacgatggtactataatgaccatatccaaggacagagtcaagccttctccaactccagattgttggaaactcaaagaaatttttgctactggtgttgtgcttggagcttacttggcgatcatgactgttgtgtttttctgggcagcatacgaaaccaacttcttccataacattttccatgtgagaaacttcaaccagcaccatttcaaaatgaaagacaagaaagtggctgcacatttgaatgaacagatggcttccgcggtctaccttcaagtcagcacgatcagccaagcgttgatcttcgtgacccgttccaggagctggtcatttgttgagcgtcccggttttcttcttgtaattgctttcctaatagctcagctggttgcatcggtgatatcggcaatggcaaattggccttttgctggaatcagaagcattggatggggttggactggagttatctggatattcaacatagtaacttacatgttacttgatcctatcaaattcctagtccgttatgctctaagtggcaaatcatgggaccgaatggtcgaggggaggactgcactcacaggaaagaagaattttggccaagaagaaagaatggctgcgtgggccaccgagaagcgtacacagcacggtttagagacgggtcaaaagccagtttatgagagaaatagcgcaacggaacttaacaatatggctgaggaagctaaaaggcgtgcagaaattgcaagaatgagagagcttcagacattgaaggggaaggttgaatcagctgcaaagctgaaaggctatgatcttgaggatcctaacagcaacaactacacaatctga

SEQ ID NO: 107758 - protein, 961 aa, Arabidopsis thaliana (mouse-ear cress)
MTDIEALKAITTESIDLENVPVEEVFQHLKCTKEGLTSNEVQERLTLFGYNKLEEKKESKILKFLGFMWNPLSWVMEAAALMAIGLAHGGGKPADYHDFVGIVVLLLINSTISFVEENNAGNAAAALMAQLAPKAKAVRDGKWNEIDAAELVPGDIVSIKLGDIIPADARLLEGDPLKIDQATLTGESLPVTKNPGASVYSGSTCKQGEIEAVVIATGVHTFFGKAAHLVDSTTHVGHFQKVLTAIGNFCICSIAVGMAIEIVVIYGLQKRGYRVGIDNLLVLLIGGIPIAMPTVLSVTMAIGAHRLAQQGAITKRMTAIEEMAGMDVLCSDKTGTLTLNKLSVDKNLIEVFKRGIDRDMAVLMAARAARLENQDAIDTAIVSMLSDPKEARAGIKELHFLPFSPANRRTALTYLDGEGKMHRVSKGAPEEILDMAHNKLEIKEKVHATIDKFAERGLRSLGLAYQEVPDGDVKGEGGPWDFVALLPLFDPPRHDSAQTIERALHLGVSVKMITGDQLAIAKETGRRLGMGTNMYPSSSLLSDNNTEGVSVDELIENADGFAGVFPEHKYEIVKRLQSRKHICGMTGDGVNDAPALKKADIGIAVDDATDAARGASDIVLTEPGLSVIISAVLTSRAIFQRMKNYTIYAVSITIRIVMGFMLLCVFWEFDFPPFMVLVIAILNDGTIMTISKDRVKPSPTPDCWKLKEIFATGVVLGAYLAIMTVVFFWAAYETNFFHNIFHVRNFNQHHFKMKDKKVAAHLNEQMASAVYLQVSTISQALIFVTRSRSWSFVERPGFLLVIAFLIAQLVASVISAMANWPFAGIRSIGWGWTGVIWIFNIVTYMLLDPIKFLVRYALSGKSWDRMVEGRTALTGKKNFGQEERMAAWATEKRTQHGLETGQKPVYERNSATELNNMAEEAKRRAEIARMRELQTLKGKVESAAKLKGYDLEDPNSNNYTI

SEQ ID NO: 107759 - DNA, 3244 bp, Lycopersicon esculentum (tomato)
  CDS (94)..(2964)
actctgttttggatttggtgggcgatttaccaatcttatttctggacccgagaaaaatcctatctttctttggaagagaggaaattgagcaagatgggggagaaacctgaggtgttagatgctgtattaaaggagactgtggatttggagaatatacccattgaagaagtttttgaaaatttgagatgtaccaaagagggtcttactggtacagctgcccaagaaaggttggcaatttttgggtacaacaaactagaggagaagaaggagagcaaattcttgaaatttctggggtttatgtggaaccccctctcatgggttatggaagctgctgctattatggcaattgctcttgcaaatggaggaggaaagcctccggattggcaagattttgtgggtattattaccttgctagtgattaactcaacaattagttttattgaggagaataatgctggcaatgcagcagctgctctcatggctcgtctcgctcctaaagccaaggttcttcgagatggaaaatggaatgaagaagatgctgctgttcttgttcctggggacattatcagtattaaactgggagatattattcctgcagatgctcgtcttcttgaaggtgatcccctgaaaattgaccagtctgctttgactggtgaatctcttcctgtaactaaaggtcctggagatggtgtctactctggttctacctgtaagcagggagagatagaagctgtcgtcatcgccactggggttcataccttttttgggaaggctgcacaccttgttgacagtacaaatcaagtgggacacttccaaaaggttttgactgctattggaaacttctgcatctgttctattgcagtggggatgataatagagatcattgtgatgtaccctatccaacaccgcaaatatcgccctgggattgacaatcttcttgtccttctcattggtggaattccaattgccatgccaacggttctttcagtcacgatggcaattggatctcatcggctcgctcaacagggtgctattacgaaaagaatgacagctattgaggagatggctggtatggacgtgctttgtagtgacaagacagggacccttacactaaacaagcttactgttgacaaaaaccttgttgaggtttttgccaaaggtgttgacgcagatactgtcgttctgatggcagctcgagcgtctcgtacagagaaccaggatgccattgacactgctattgttgggatgttgtctgacccgaaggaggctcgtgctggcattcgtgaaatacactttcttcctttcaatccaactgacaagcgtacagcgcttacttatcttgatggtgaaggaaaaatgcacagggtcagcaaaggggcaccagagcagatcctaaatcttgcacacaacaagtcagacatagaacgtagagttcatgcggtgattgataagtttgctgagaggggtttgcgctcacttggtgtggcctaccaggaagttccagagggaaggaaggagagttccggaggaccatggcaattcattggtctcctgcctttgtttgatcctccaagacacgacagtgctgagactataaggagggctttgaatcttggagtgaatgttaaaatgatcacaggggatcaactggctataggaaaagaaacagggcgtcgtctgggaatgggaaccaacatgtatccttcatctgctctgttggggcagactaaggatgaatcaattgcttctttaccaattgatgaactgatagaaaaggctgatggttttgctggagtattccctgagcacaaatatgagattgtaaaacgcttgcaagctaggaagcatatctgtggaatgactggagatggagtcaatgacgctcctgctttaaagaaggctgatattgggatagctgttgatgatgccactgatgctgctcgtagtgcttctgacattgttcttactgaacctggtctcagtgtcatcattagtgctgttctgactagtcgagcaatctttcaaaggatgaaaaactatacgatatatgctgtttccatcacaatccgtattgtgcttggttttatgcttctggcccttatctggaagtttgactttccacctttcatggtgcttatcattgcaatcctcaatgacggtaccattatgacaatatcaaaggatagggtcaaaccatctcctctgcctgatagttggaagctggctgagattttcactactggggttgttcttggtggctacttggcaatgatgacagtcattttcttttgggcagcatatgagacagatttcttcccgcgtgtatttggggtatcaacacttcagaggacagcaactgatgacttcaggaaacttgcatcagcaatttaccttcaagtgagcactatcagtcaggccctgatatttgtcacaagatctcgaagttggtcgtttgttgagcgtcctggtttgttgcttgtggttgcttttctgattgctcaactggttgccaccttgattgctgtttatgcaagttggagctttgctgcaatcgaaggaattggctggggttgggcaggagtgatctggctctacaatttagtattctacttcccgcttgatatcatcaagttcttaatcagatatgctctcagtggaagggcctgggatcttgttcttgagcaaaggattgctttcaccaggaagaaggatttcggaaaagaacaacgtgagcttcaatgggcccacgcacagaggacccttcatgggctgcaagttcctgacaccaaattgtttagtgaagctaccaatttcaatgagcttaatcagttagctgaggaagcaaagaggagagctgaaatcgctaggcaacgtgagctgcacacacttaaaggtcacgtggaatcagtggtgaagttgaagggtcttgacatagagacaattcagcagtcatacactgtttgatgtgggagcaagtatgactagtgctacttaactggtgagtgggtgatagaatgaagacataatgagtgtgtgagttacctctggagcgacaagttcatagtagtaacatcttcagcgtttaaaagtgccttatatattttatacatttttttgctttgaattcttggttcatcttttcctgctttcatgtcttgactacattatatatattacaattgaccaagaatgaatattaagctataacagcattcattatctatattctcaagagtttttattt

SEQ ID NO: 107760 - protein, 956 aa, Lycopersicon esculentum (tomato)
MGEKPEVLDAVLKETVDLENIPIEEVFENLRCTKEGLTGTAAQERLAIFGYNKLEEKKESKFLKFLGFMWNPLSWVMEAAAIMAIALANGGGKPPDWQDFVGIITLLVINSTISFIEENNAGNAAAALMARLAPKAKVLRDGKWNEEDAAVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKNLVEVFAKGVDADTVVLMAARASRTENQDAIDTAIVGMLSDPKEARAGIREIHFLPFNPTDKRTALTYLDGEGKMHRVSKGAPEQILNLAHNKSDIERRVHAVIDKFAERGLRSLGVAYQEVPEGRKESSGGPWQFIGLLPLFDPPRHDSAETIRRALNLGVNVKMITGDQLAIGKETGRRLGMGTNMYPSSALLGQTKDESIASLPIDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYETDFFPRVFGVSTLQRTATDDFRKLASAIYLQVSTISQALIFVTRSRSWSFVERPGLLLVVAFLIAQLVATLIAVYASWSFAAIEGIGWGWAGVIWLYNLVFYFPLDIIKFLIRYALSGRAWDLVLEQRIAFTRKKDFGKEQRELQWAHAQRTLHGLQVPDTKLFSEATNFNELNQLAEEAKRRAEIARQRELHTLKGHVESVVKLKGLDIETIQQSYTV

SEQ ID NO: 107761 - DNA, 3344 bp, Prunus persica
  CDS (253)..(3123)
gaaaaataattttcagggctctttaagaatttgacattaaaaaagagagagtagaaaaggttgtgactgttactgactgccactcctatactctctttagcggttcatcttcttggttcctgcttgcgtgtttggtggccgacgagggtccttctcatttgggtttccctaccataattgctatcaaagtcgagtttttgcaactggagatatagcgaaaaaagtgaggccgtattagagaggaagagagatatggcggagaagcctgaagtattggacgctgtgttgaaggaaactgtggatttggaaaatatacccattgaagaggtctttgagaatctgagatgtagcaaagagggcctcagcagtgaggctgctgaggaaagactgaccatttttgggcacaacaagcttgaagaaaagcaggagagcaaatttttgaagtttttgggttttatgtggaaccctctctcgtgggttatggaagctgctgctataatggccattgctcttgcaaatggaggaggtaagcctcccgactggcaagattttgtgggtattattactctccttgtcatcaattccactattagtttcatcgaggaaaacaatgccggtaatgcagcagcagcactcatggctcgtcttgctccaaaagccaaggtccttcgagatggaaggtggaatgagcaagaggctggggttctagtacctggtgacataatcagtattaagcttggtgatattgttccagctgatgctcgtctacttgaaggggatcctctgaaaattgaccagtctgcacttacaggcgagtctcttccggtgacaaaaagcccaggggatggtgtgtactccggttcgacttgcaaacaaggagagattgaagcagtggtcattgccactggtgttcatacctttttcgggaaagctgctcaccttgttgatagcactaatcaagtgggccacttccaaaaggtcttgactgcaattgggaatttctgcatatgttccattgctgtggggatggtaatagagattattgtcatgtacccgatacaagaccgagactatcgtcctggaattgacaacttgctcgtgcttctcattggtggaattccaattgcaatgcccacagttctgtcagtgacaatggctattgggtctcatagattatcacagcagggagctattacaaagagaatgacagcaattgaagagatggcaggaatggatgtcctttgcagtgacaagactggaactctaacattaaataagcttactgttgacaaaaatcttattgaggtctttgcaaagggaatggatccagatactgttgtgctgatggcagctcgagcctccagagtggagaatcaagatgcaatagatactgctatagttgggatgctcgctgatcctaaggaggcacgtgctggtgttcaagaattacacttccttcctttcaaccctactgataaacgaactgcattaacgtatcttgaccgtgatggtaaaatgcatagagtaagcaaaggtgcaccagagcagattctaaaccttgcccacaataagtcagacattgagcgtagagttcatgctgttattgataagtttgctgagcgaggtttacgatctcttgcagtagcataccaggaagttccagaaggaaggaaagagagtgctggaggcccatggcagtttgttggcctaatgccactctttgacccacctaggcacgacagtgcagagacaataaggagggctttagatcttggtgtaaatgtgaagatgattacaggggatcaactggccataggaaaggaaactggacgtcgcttggggatgggaaccaacatgtatccttcatctgctttgctaggacaggacaaggatgagtcgattgttgctttaccgattgacgagctgatagaaaaagctgatggctttgctggtgttttcccagagcacaaatacgagattgtgaaacgcttgcaagctaggaaacatatctgcggaatgactggtgatggagttaatgatgctcctgccctaaaaaaagctgatattggtatagctgttgctgatgcaacagatgcagctcgcagtgcttctgatattgtgctaactgaacctggccttagtgtcatcattagtgctgttttgaccagtcgggcaatcttccagaggatgaaaaattacacaatatatgctgtttccatcacaattcgtattgtgcttggtttcatgttgctcgccctcatatggaagtttgattttccacctttcatggtgcttattattgccatcctcaatgatggcactatcatgacgatatcaaaggatagggttaaaccatctcctctgccagatagctggaagctggccgagatttttacaactggagttgtgcttggtagttacttggcaattatgactgtgatattcttttgggcagcatacaaaacagacttcttcccaagagtatttggggtgtcaacccttgagaaaacagctaatgatgacttccggaagcttgcctctgctatatatctacaagtgagcattatcagtcaggctctcatatttgttactcggtctcgaagttggtcgtttgttgagcgtcctggattgttgcttgtggtggcttttgtgatagctcagctgattgccaccttgattgcagtctatgcaaattggagttttgctgccattgaagggattggatggggttgggctggggtgatctggctttataacctcgtcttctatttccctctggatatcataaaattcatgatacgctatgcgctgagcgggaaggcttgggatcttctcattgagcaaaggattgctttcacaaggcaaaaggatttcggaaaggaacagcgtgagcttcaatgggcacatgcacaaagaacattgcatgggctgcaaccacctgataccaagatgtttacagaacgcacacatttcacagaactcaatcagatggctgaagaagccaaaagaagagctgagattgcaaggttgagggagctccacacactgaaaggtcacgtagaatcggtggtgagattgaagggacttgacatcgacacaattcagcaagcatacacagtttaagggagacataatttatttaccttgctatactgtataagatgatgatgatgattccccctagtgtgctgagagtaaagacgtgtactcagcatgttgtgagtaaccttcagtagacagtcattttaaatttgctactggtgctttcagtttttggcatgtaaaatgagtgctgcaatcagctgttttctagaaaaaaaaaaaaaaaaaaaaaaaaaaaaaaa

SEQ ID NO: 107762 - protein, 956 aa, Prunus persica
MAEKPEVLDAVLKETVDLENIPIEEVFENLRCSKEGLSSEAAEERLTIFGHNKLEEKQESKFLKFLGFMWNPLSWVMEAAAIMAIALANGGGKPPDWQDFVGIITLLVINSTISFIEENNAGNAAAALMARLAPKAKVLRDGRWNEQEAGVLVPGDIISIKLGDIVPADARLLEGDPLKIDQSALTGESLPVTKSPGDGVYSGSTCKQGEIEAVVIATGVHTFFGKAAHLVDSTNQVGHFQKVLTAIGNFCICSIAVGMVIEIIVMYPIQDRDYRPGIDNLLVLLIGGIPIAMPTVLSVTMAIGSHRLSQQGAITKRMTAIEEMAGMDVLCSDKTGTLTLNKLTVDKNLIEVFAKGMDPDTVVLMAARASRVENQDAIDTAIVGMLADPKEARAGVQELHFLPFNPTDKRTALTYLDRDGKMHRVSKGAPEQILNLAHNKSDIERRVHAVIDKFAERGLRSLAVAYQEVPEGRKESAGGPWQFVGLMPLFDPPRHDSAETIRRALDLGVNVKMITGDQLAIGKETGRRLGMGTNMYPSSALLGQDKDESIVALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGSYLAIMTVIFFWAAYKTDFFPRVFGVSTLEKTANDDFRKLASAIYLQVSIISQALIFVTRSRSWSFVERPGLLLVVAFVIAQLIATLIAVYANWSFAAIEGIGWGWAGVIWLYNLVFYFPLDIIKFMIRYALSGKAWDLLIEQRIAFTRQKDFGKEQRELQWAHAQRTLHGLQPPDTKMFTERTHFTELNQMAEEAKRRAEIARLRELHTLKGHVESVVRLKGLDIDTIQQAYTV

SEQ ID NO: 107763 - DNA, 3570 bp, Homo sapiens
  CDS (185)..(3169)
ggccggctgctcaagtgggacgggggtcagagctttgtggagggaagaaaaacctggagggggcaggagagtaaaaagaagaaacccaggcagacaggcagttggacacactgaggaagaccccccacgagtgggaaccccctggaaggaacacaccggccccggcccccaggaagggagcacaatggaggccgctcatgctaaaaccacggaggaatgtttggcctattttggggtgagtgagaccacgggcctcaccccggaccaagttaagcggaatctggagaaatacggcctcaatgagctccctgctgaggaagggaagaccctgtgggagctggtgatagagcagtttgaagacctcctggtgcggattctcctcctggccgcatgcatttccttcgtgctggcctggtttgaggaaggtgaagagaccatcactgcctttgttgaaccctttgtcatcctcttgatcctcattgccaatgccatcgtgggggtttggcaggagcggaacgcagagaacgccatcgaggccctgaaggagtatgagccagagatggggaaggtctaccgggctgaccgcaagtcagtgcaaaggatcaaggctcgggacatcgtccctggggacatcgtggaggtggctgtgggggacaaagtccctgcagacatccgaatcctcgccatcaaatccaccacgctgcgggttgaccagtccatcctgacaggcgagtctgtatctgtcatcaaacacacggagcccgttcctgacccccgagctgtcaaccaggacaagaagaacatgcttttctcgggcaccaacattgcagccggcaaggccttgggcatcgtggccaccaccggtgtgggcaccgagattgggaagatccgagaccaaatggctgccacagaacaggacaagacccccttgcagcagaagctggatgagtttggggagcagctctccaaggtcatctccctcatctgtgtggctgtctggcttatcaacattggccacttcaacgaccccgtccatgggggctcctggttccgcggggccatctactactttaagattgccgtggccttggctgtggctgccatccccgaaggtcttcctgcagtcatcaccacctgcctggccctgggtacccgtcggatggcaaagaagaatgccattgtaagaagcttgccctccgtagagaccctgggctgcacctctgtcatctgttccgacaagacaggcaccctcaccaccaaccagatgtctgtctgcaagatgtttatcattgacaaggtggatggggacatctgcctcctgaatgagttctccatcaccggctccacttacgctccagagggagaggtcttgaagaatgataagccagtccggccagggcagtatgacgggctggtggagctggccaccatctgtgccctctgcaatgactcctccttggacttcaacgaggccaaaggtgtctatgagaaggtcggcgaggccaccgagacagcactcaccaccctggtggagaagatgaatgtgttcaacacggatgtgagaagcctctcgaaggtggagagagccaacgcctgcaactcggtgatccgccagctaatgaagaaggaattcaccctggagttctcccgagacagaaagtccatgtctgtctattgctccccagccaaatcttcccgggctgctgtgggcaacaagatgtttgtcaagggtgcccctgagggcgtcatcgaccgctgtaactatgtgcgagttggcaccacccgggtgccactgacggggccggtgaaggaaaagatcatggcggtgatcaaggagtggggcactggccgggacaccctgcgctgcttggccctggccacccgggacacccccccgaagcgagaggaaatggtcctggatgactctgccaggttcctggagtatgagacggacctgacattcgtgggtgtagtgggcatgctggaccctccgcgcaaggaggtcacgggctccatccagctgtgccgtgacgccgggatccgggtgatcatgatcactggggacaacaagggcacagccattgccatctgccggcgaattggcatctttggggagaacgaggaggtggccgatcgcgcctacacgggccgagagttcgacgacctgcccctggctgaacagcgggaagcctgccgacgtgcctgctgcttcgcccgtgtggagccctcgcacaagtccaagattgtggagtacctgcagtcctacgatgagatcacagccatgacaggtgatggcgtcaatgacgcccctgccctgaagaaggctgagattggcattgccatgggatctggcactgccgtggccaagactgcctctgagatggtgctggctgacgacaacttctccaccatcgtagctgctgtggaggagggccgcgccatctacaacaacatgaagcagttcatccgctacctcatttcctccaacgtgggcgaggtggtctgtatcttcctgaccgctgccctggggctgcctgaggccctgatcccggtgcagctgctatgggtgaacttggtgaccgacgggctcccagccacagccctgggcttcaacccaccagacctggacatcatggaccgccccccccggagccccaaggagcccctcatcagtggctggctcttcttccgctacatggcaatcgggggctatgtgggtgcagccaccgtgggagcagctgcctggtggttcctgtacgctgaggatgggcctcatgtcaactacagccagctgactcacttcatgcagtgcaccgaggacaacacccactttgagggcatagactgtgaggtcttcgaggcccccgagcccatgaccatggccctgtccgtgctggtgaccatcgagatgtgcaatgcactgaacagcctgtccgagaaccagtccctgctgcggatgccaccctgggtgaacatctggctgctgggctccatctgcctctccatgtccctgcacttcctcatcctctatgttgaccccctgccgatgatcttcaagctccgggccctggacctcacccagtggctcatggtcctcaagatctcactgccagtcattgggctcgacgaaatcctcaagttcgttgctcggaactacctagagggataactgttccccctcctccatctctgagcccgtgtcacagatccagaagatgaaagaaggaagtgagcatccttttgctctgtcctccccaccccgatagtgacacatcttcaggcagagctgtggcacagacccccgtcctgtcccccacacccgtgtcatgtgtctgtttataaacatgtccccttccctttccttccccctcggccacccgcctccctctcaaccttgtaaattccccttcccaaccccgaggggcttgcagggacaaggcgaccgactgcgctgagctgcttatttattgaaaataaacgacggaaaagtctggccttgcctctgtgcaagcttggaggcctgggtcgccgctgtgaaaaaaaaaaaaaaaaaaaaaaaaaaaaaaaaaa

SEQ ID NO: 107764 - protein, 994 aa, Homo sapiens
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEG

SEQ ID NO: 107765 - DNA, 2889 bp, Uromyces fabae
  CDS (1)..(2889)
atgtctctcaaagaaggctctgatcctgtccacaagaaaaattttgacaaaacttttgaggatgaaattaaaggcactagtgcactcgtcgacattggaaccattcagcttaccgccgaggatttgtatgacaaagacaaagtcgacttggagcaggttcatttggaagatgtatggaaactactccaaacaactgaagaagggttaactgctgaagaggttcagaggcgtcttgaaatattcggacccaacaaactcgagagcaaggaagtcaacccactgttactatttttgagtttcatgtggaatcctctatcatgggtcatggaaggagctgccattgttgctatcggtctctccaatggtcaaggtcgtcccccggactggcaagatttccttggtattatgttactcttgttcattaacgccggaatcggtttctacgaggagcgctctgctggtaacgcagtcaaggcattgatggactccttggcacccaaagccaaggttcgccgtgctggagtatggtctgaaatcgactcggccgacctcgtccctggtgatattgttgctttcaaaattggagacgttgtaccctctgactgtcggctgtatgacgctatcaacgtctcaattgatcaagccgcattaacaggagaatccttgccgtcaaccaagcatgttggagatcaatgtttttcaggatctacctgcaaacaaggagaagctgagggagtcgttatcgccactggaccaaacactttctttggacgtgctgccacattggtaggagcagacaatgactctaccgggcacatgcaagccgtgcttgccaaaattggtactttctgtcttgtttcgattggaattttcgtcgtgttggaaataatcattttatacggtggcttccgctaccaataccgtcgtggaatcgacaatatcttggtgctactgattggtggtatccccattgctatgcccactgtcctatctgttacactcgctgtcggtgctcaacaactcgccaaatacaaagccattgtcacccgtatcactgctattgaagagttggccggtgtcactattctttgttccgataaaaccggaactcttaccactaacaagcttaccatcgacaaatccaccgtcaaaacctacgccgacttcagcgctgatgaggtttgcgtgctcgccgcgtacgcttctcgtactgaaaatcaggatgctattgatacttgtgtcgttggcaacgttggagctgatgtcgcccgtcgcggaatacaactccttgacttcaaacctttcaaccctgttgacaaacgtactgaaatcacctacattgatacagagtctggtcaaatgcgacgtgtgacaaagggaatgactggtgttatcatcgaactgtgtacccacaacaagacggaagcacttgaacaacgacttgaatctgatgttgaagaatttgctcgtcgtggtctccgtgccctggcagttgcttatgaagatgtacccaatgcccaagttgatgctcccggtagtggatttgaattgatcggtctactttctatcttcgacccacctcgtgatgacaccaagcaaaccattgatgacgctcaagcactcggagttaaagtaaagatggtaacaggtgatcaacttgccatcgcgaaggaaactggacgtcgattaggaatgggtgatcacatgtacccttccaaagttttgaaggatggacccgaacccggaggcaaattctcttcccttgatgaaatgatccttgatgccgatggttttgctggtgtatttcctgagcacaaatacgagatcgttaaaagactgcaaggacttggtcatttgtgtgcaatgactggtgatggtgccaacgatgctcccgctctcgcccgtgcaaacgttggtatcgccgtcgagggagccactgatgccgctcgaggtgctgccgatattgtcttaactgaacctggtctttcaaccattgtccacgctatccgtcaatctcgaatcgttttccaacgtatgcgcaattactcgatttatgcatgtgcagtcaccatccgtatcgtcgtagggttcgcggttatggcatttgctttcaagtttgatttcccccccttcatggtattggtcattgcccttctcaatgatggtaccatcatgacgctctcacttgaccgcgtcttacccagtagcaaccctgaccattgggatttgactgagattttcacatacgccatcggttacggactttgcctcgctctttcaaccattgttttacttgccgtcatcatccacacccaattctttgaggatcgctttggtgtacaaccgcttaaggatgccaatgatccccacgttcacatgatcatctacttgcaagtcgctatcatctcacaagcactcatcttcgttaccagatctcacggatggttcttcatggagcgcccctcggttgcgctgtttggtgcttttgtgattgcccaactcatttcctctttgattgctgcctatggtgattgggcgtttaccgatgtaagaggtatctctgccacctggattgcaattgtctggatttggaacgtcatctggttcttgcccctcgatcttgttaaattcgggatgcgagctgtcattcgcatgttcaagccacctgtcgcacttaacaagcctattcccgctaaccaactcactcgtaccacctctcgccccgcttcaatcaatgagtctttgtattccaaccgtgccagtttcattcaacgtgccagccgcaggtcggtgcttggcgggcgtgtacatgctgatgaccgtgaactgcgaagattctcctctgctcaagctgtttcgtctggtgctgcccttagtcgtgcccaataa

SEQ ID NO: 107766 - protein, 962 aa, Uromyces fabae
MSLKEGSDPVHKKNFDKTFEDEIKGTSALVDIGTIQLTAEDLYDKDKVDLEQVHLEDVWKLLQTTEEGLTAEEVQRRLEIFGPNKLESKEVNPLLLFLSFMWNPLSWVMEGAAIVAIGLSNGQGRPPDWQDFLGIMLLLFINAGIGFYEERSAGNAVKALMDSLAPKAKVRRAGVWSEIDSADLVPGDIVAFKIGDVVPSDCRLYDAINVSIDQAALTGESLPSTKHVGDQCFSGSTCKQGEAEGVVIATGPNTFFGRAATLVGADNDSTGHMQAVLAKIGTFCLVSIGIFVVLEIIILYGGFRYQYRRGIDNILVLLIGGIPIAMPTVLSVTLAVGAQQLAKYKAIVTRITAIEELAGVTILCSDKTGTLTTNKLTIDKSTVKTYADFSADEVCVLAAYASRTENQDAIDTCVVGNVGADVARRGIQLLDFKPFNPVDKRTEITYIDTESGQMRRVTKGMTGVIIELCTHNKTEALEQRLESDVEEFARRGLRALAVAYEDVPNAQVDAPGSGFELIGLLSIFDPPRDDTKQTIDDAQALGVKVKMVTGDQLAIAKETGRRLGMGDHMYPSKVLKDGPEPGGKFSSLDEMILDADGFAGVFPEHKYEIVKRLQGLGHLCAMTGDGANDAPALARANVGIAVEGATDAARGAADIVLTEPGLSTIVHAIRQSRIVFQRMRNYSIYACAVTIRIVVGFAVMAFAFKFDFPPFMVLVIALLNDGTIMTLSLDRVLPSSNPDHWDLTEIFTYAIGYGLCLALSTIVLLAVIIHTQFFEDRFGVQPLKDANDPHVHMIIYLQVAIISQALIFVTRSHGWFFMERPSVALFGAFVIAQLISSLIAAYGDWAFTDVRGISATWIAIVWIWNVIWFLPLDLVKFGMRAVIRMFKPPVALNKPIPANQLTRTTSRPASINESLYSNRASFIQRASRRSVLGGRVHADDRELRRFSSAQAVSSGAALSRAQ

SEQ ID NO: 107767 - DNA, 4741 bp, Trypanosoma cruzi
  CDS (1178)..(3955)
ctcgagggcatatggcgggaaagttgttgaacagtatgaggacgaaacacctaattcagggaataaaaatgaatcaaaggaacccacggtgtaattttgtttgtgattaaattaacttttgtgtggcgagaggaatggttccaccaaatgtgtttttatttcctcccctttttcattgccctgggccagtggaggtactgaagaatggcattgagccgtatttggcgactgcggtgcgtgcttttgtttattgcgccgaagaggcgtgcgaagtgaggattcaccacactgttgagggttatatttgcagtctgtggtgttttttaatggtaatttttttttttcctttcattggacgctttgtttttgttgttttaattaagctgaaggaaaaaaagtgaaatgagatgatgttttgatacatgtgaatgaacgaggggacaaaagccgcaatatgcttttaactgaatgaataaattttatttttgtaatcttcattttaagggcaaaatttgtggaacgtggcgtttcagccaaaatatgcggaatggatggatgaagcaagaagaaagggagtgggggaataagcagtggcggaaagaagcgaaagggacactggtgaattactgcacgcatttaaaaacaaaacaaacaagcaaacaaaaaaaaaaggtgcgcagaacccaaaggttgttttctgtgctctgccctcacgtgcagcagcatcagcaaagggaacccaacgaggatagggaaaactgcctttgcacacgctgaattttatgtttttcttttgtcttgtttatctacattgtacctttaatttttcttgtcattgcgattgactcactgcacccattcggcgaatggaggtactgcagacggctttagcacacgccaaaataacaagaatttgggtattcttttccccattggtcgtaagaaaagaaaaggagaacgatggtgaagggtatggaatgaaagagggcggtgctgaataaagcgttgtggggaaggggaatgagtattgacgaatttgggtaaatgttggcacacaatgcgcagtctgtgcataaaaaccactaaaagcgaataaattttgggcttctttctttttaatccattcctcactgatagtagtaagcctttttagcgcaaccgaaataggaaagcagccatgaaccagaagaacgataagtccgtgctgaacaacagcaataatggtaacttcaacgaacaacatcccccacaaaagccgcaaaagcgtcagtccgttctctccaaggccattagtgagcacaaggaggacggcgtcgatgaagtgccaatgctaccgccgtccaagggactgacgacggccgaagcggaagagctccttgccaaatacggacgcaacgagctcccggagaagaaaacgcccagttggctgatatttgtgcgtaacctatggggtcctatgccttttgcgctgtgggtcgccatcatcattgagtttgcgctggagaactggcctgacggtgccattcttcttgctattcagcttgccaatgccacaattgggtggtatgagacaatcaaggcaggcgatgctgtggctgcgctgaagaactcactgaagcccgtggcgaccgtccaccgtgacggagcatggaagcagctggatgccgcgctgctggtgcccggtgatcttgtgaagctcgcatccggctccgcggtgcctgccgattgcagcatcaacgagggtgtgattgacgtggacgaggcggcgctgacgggtgagtcgcttcccgtgacgatgggaacggaccacatgcccaaaatgggctcaaacgttgtgcgcggtgaggtggatggaacggtgcagtacactggacaaaacaccttttttggcaaaactgcggtgttgctgcagtcagtggaatccgaccttggaaatattcatgtgattctctcacgagtgatggtggtgctgacaagtttctcatttactttgtgccttatctgctttatctacttgatggtaaagttcaaagaatcatttcgtcgttcgttacagttttccgtcgtggtgcttgtggtgtccattccgattgcccttgagattgtcgtgacgacgacgcttgctgtgggctcaaagaagctgtcgaggcacaagatcattgtgacgaagctgaccgcaattgagatgatgtcaggtgtgaacatgctgtgctccgacaagacggggacgctgacgctgaacaaaatggagattcaggatcagtgctttacgtttgagaagggccacgacctgcgctccgtgcttgtgctggccgcacttgctgcgaagtggcgtgagccccctcgtgacgccctggacacaatggtgctgggggctgcggatttggacgagtgtgacaactacacacagactgaatttgtgccgtttgatccgacaacgaagcgcacggccgccacccttgtggacaagcgaacgaacgagaagttcagcgtgacgaagggcgcgccacacgtgattatccagctggtgtacaaccaggacgagatcaatgaccaggtggttgaaatcatcgacagtcttgccgcgcgtggtgtccgttgcctctctgtggcgaagacggactcgcagggccgctggcacctgtgcggcattctgacgtttcttgaccccccacgccccgacacgaaggaaacgatccgccggagcaagcagtacggtgtggacgtgaagatgattaccggcgaccatgtgctgattgcgaaggagatgtgccgcatgcttaaccttgacccgaacatcctaacggccgacaagctgcccaaggtggacgtgaatgatctgccggatgacctgggcgaaaagtacggggagatgatgcttggtgtgggtgggtttgcgcaggtgtttcctgagcacaagtttatgattgttgaggctcttcgtcagtatgggtttacatgcgcaatgacgggtgacggcgtgaatgacgcgcccgccctgaagcgtgcggatgtgggtattgccgtgcagggtgcgacggacgctgcgcgagccgcggctgacatggtgctgactggtcctggtctgagcgttgtggttgaggcgatgcttgtgtcccgacaggtgttccagtgcatgctttctttcttgacgtaccgtatatccgccactttgcagctggtgtgctttttctttattgcctgcttctccttgacgcctcgtaactatggcagcgccgatgcggatttccagttcttccaccttcccgtgctgatgttcatgctgatcacgcttctcaatgacggttgcctgatgacgatcggctatgaccgcgtggtgccgtcgaagctgccgcagcggtggaaccttcctgttgtgttcacgattgccatcattctggccgcggttgcctgtggttcttcgctgatgctgttgtggattgcccttgagggctggagcgacgagacgtatccaaactcttggttcaaggctcttggccttgcgcagctgaagcaaggaaaggttgtgacgctgctttatcttaagatttccatctctgatttcttgacgctcttttcttctcgtactggcggacgctggttcttcacgatggcaccgggacttgtgttgcttattggtgcgattatctcgctttttgtgtcgtcgatggttgcctccttttggcatacgtctcgtccggatggtctgctaacggagggtcttgcgtggggagacacgaacagcgagaggctgttgccgctgtgggtgtggatctactgcattgtatggtggcttattcaggacgctgtgaaggtggggacgcacaagctcatggagtggatggacctgtttggctgcgtctcgagggcatatggcgggaaagttgttgaacagtatgaggacgaaacacctaattcagggaataaaaatgaatcaaaggaacccacggtgtaattttgtttgtgattaaattaacttttgtgtggcgagaggaatggttccaccaaatgtgtttttatttcctcccctttttcattgccctgggccagtggaggtactgaagaatggcattgagccgtatttggcgactgcggtgcgtgcttttgtttattgcgccgaagaggcgtgcgaagtgaggattcaccacactgttgagggttatatttgcagtctgtggtgttttttaatggtaatttttttttttcctttcattggacgctttgtttttgttgttttaattaagctgaaggaaaaaaagtgaaatgagatgatgttttgatacatgctaatgaacgaggggacaaaagccgcaatatgcttttaactgaatgaataaattttatttttgtaatcttcattttaagggcaaaatttgtggaacgtggcgtttcagccaaaatatgcggaatggatggatgaagcaagaagaaagggagtgggagaataagcagtggcggaaagaagcgaaagggacactggtgaattactgcacgcatttaaaaacaaaacaaacaagcaaacaaaaaaaaaggtgcgcagaacccaaaggttgttttctgtgctctgccctcacgtgcagcagcatcagcaaagggaacccaacgaggatagggaaaactgcctttgcacacgctgaattttatgtttttcttttgtcttgtttatctacattgtacctttaatttttcttgtcattgcgattgactcactgcacccattcggcgaatggaggtactgcag

SEQ ID NO: 107768 - protein, 925 aa, Trypanosoma cruzi
MNQKNDKSVLNNSNNGNFNEQHPPQKPQKRQSVLSKAISEHKEDGVDEVPMLPPSKGLTTAEAEELLAKYGRNELPEKKTPSWLIFVRNLWGPMPFALWVAIIIEFALENWPDGAILLAIQLANATIGWYETIKAGDAVAALKNSLKPVATVHRDGAWKQLDAALLVPGDLVKLASGSAVPADCSINEGVIDVDEAALTGESLPVTMGTDHMPKMGSNVVRGEVDGTVQYTGQNTFFGKTAVLLQSVESDLGNIHVILSRVMVVLTSFSFTLCLICFIYLMVKFKESFRRSLQFSVVVLVVSIPIALEIVVTTTLAVGSKKLSRHKIIVTKLTAIEMMSGVNMLCSDKTGTLTLNKMEIQDQCFTFEKGHDLRSVLVLAALAAKWREPPRDALDTMVLGAADLDECDNYTQTEFVPFDPTTKRTAATLVDKRTNEKFSVTKGAPHVIIQLVYNQDEINDQVVEIIDSLAARGVRCLSVAKTDSQGRWHLCGILTFLDPPRPDTKETIRRSKQYGVDVKMITGDHVLIAKEMCRMLNLDPNILTADKLPKVDVNDLPDDLGEKYGEMMLGVGGFAQVFPEHKFMIVEALRQYGFTCAMTGDGVNDAPALKRADVGIAVQGATDAARAAADMVLTGPGLSVVVEAMLVSRQVFQCMLSFLTYRISATLQLVCFFFIACFSLTPRNYGSADADFQFFHLPVLMFMLITLLNDGCLMTIGYDRVVPSKLPQRWNLPVVFTIAIILAAVACGSSLMLLWIALEGWSDETYPNSWFKALGLAQLKQGKVVTLLYLKISISDFLTLFSSRTGGRWFFTMAPGLVLLIGAIISLFVSSMVASFWHTSRPDGLLTEGLAWGDTNSERLLPLWVWIYCIVWWLIQDAVKVGTHKLMEWMDLFGCVSRAYGGKVVEQYEDETPNSGNKNESKEPTV

SEQ ID NO: 107769 - DNA, 3868 bp, Procambarus clarkii
  CDS (146)..(3154)
ggacagggcaaggcgggcgttccttttcctttctgtgtctctttcctgggagccagtcattttggcccaggctcgtgtccttagagtagcagaagtggacggagcaagagagagagaatagatcgcccgccatcaccgagccaccatggatgatgcacattgctttcccgtcgaggacgtcgtcgcgaaatttggcgtgaacattgagaatggcctctccgcgtctcaagtgaaggattatcaggccaaatatggccccaacgagctacccgccgaggaaggcaagtctctcctccagctcatcctggagcagttcgacgacttgcttgttaaaatcctgcttctcgcagccattatttcattcgtcctggcgtgtttcgaggagggtgaagagaccgtcaccgccttcgtggagcccttcgtcatcctgcttatcctgatcgctaacgccatcgtgggcgtgtggcaggaacgcaatgccgaatcggccatcgaggcgctgaaggagtacgagcccgagatgggcaaggtagtgcgctccaagaagcatggtgtgcagaaggtccgtgccagggagatagtcccggtggacatcgttgaggtctctgttggtgacaagattcctgctgacattcgccttgtcaagatcttttccacgaccctacgtattgaccagtctatcctgactggtgagtctgtttcggtcatcaagcacactgatgccattcccgaccccaaggctgtcaaccaggacaagaagaacatcctcttctcaggaaccaatgtttctgccggcaaggcacgtggtgtcgtcattggtacaggtctcgcaactgccattggtaagatccgcacccaaatggctgagactgaagaaatcaagactccactacaacagaaacttgatgaatttggtgaacaattatccaaggttatctccattatttgtgttgctgtctgggctatcaacattggacatttcaatgaccctgctcatggtggttcctggatcaagggtgctatttattatttcaaaattgctgttgccttggctgtggctgctattcccgaaggccttcccgctgttattactacttgtttggctctgggtactcgtcgtatggctaagaagaatgccattgttaggtctcttccctctgttgaaactctgggctgcacttctgtcatctgctctgataaaaccggcacgctcaccaccaaccagatgtctgtctctcgtatgttcatcatggacaaggttgagggtaacgattcctctcttcttgaatttgaagttactggctccacctatgaacctattggtgatgtatacctgaaaaatactaaagttaagggatctgactttgagggactacaagaactctctaccatttcttttatgtgtaatgactcttccattgactttaatgaattcaagaatgtgtttgagaaggttggtgaggacactgagacagctcttattgtccttggtgagaagatcaacccatacaacatgtctaaatctggcttggatcgtcgctctgctgccattattgctaggcacgacatggagacaaaatggaagaaagaattcaccctcgagttctcacgtgatcgcaaatccatgtcttcatactgtgttccactcaaacctacccgcttgggaactggaccaaagatgttctgcaaaggagcccctgagggtgtacttgatcgctgcactcacgtgcgtgttggcactcaaaaggtccctcttactgctggtgtgaaagagaagattctgtccgtcacccgtgattatggctgtggtcgtgacactcttcgctgcttgggtcttgctaccatcgataatccaatgaaacctgaagatatggatctgggagaagcttctaagttctatacatatgaagttaatatgacatttgttggcgtagttggtatgcttgacccaccacgtaaggaagttaaagattcaatccagagatgtcgtgatgctggtatccgtgttattgtcattactggagacaataaggcaactgctgaggctatctgccgtcgtattggagtttttaaagaagatgaagatacaactggtatgtcatattctggccgtgagtttgacgagctaagtcctgaagaacagaggcaggcatgtattcgttcccgcctcttctctcgtgtagagcccttccataagtcaaagattgttgaatatcttcaaggagagaacgagatctcagccatgacaggtgatggtgtgaatgatgcacctgccctgaagaaagctgaaattggcattgctatgggatctggtactgctgtggccaagtctgcctctgaaatggtgctggctgatgacaacttctcctctattgtggctgctgttgaagaaggtcgtgctatttacaacaacatgaagcagttcatccgttacctcatttcttccaatgttggtgaggttgtttccatctttttgactgctgctctaggtcttccagaagctcttatcccagtccagctcctgtgggtcaaccttgtaactgatggcttgcctgctactgccttgggcttcaaccctccagatcttgatattacggacaaacctccccgcagagctgacgagtccctcatctctggctggctattcttccgttacatggccattggtggctatgttggtgcagccaccgtttttgctgcatcatggtggttcatgtatgatcctactggccctcacctaaactactatcaactccctcaccatctgcaatgtcttggagatcctgaaaactttgaaggactggactgcaacattttcagtcaccctgctccaatgacaatggctctgtctgtgctggtcaccattgaaatgctcaatgctctaaacagcttgtctgagaaccagtcgctgctgataatgcctccctgggtcaacttctggctgctggcggctatggccctgtccatgaccctccacttcatcatcctctacattgacatcctcagtactgtgttccaggtgatgccactgtctgttgcccagtgggttgctgtcttgaagatttccttccctgtattgctgctggacgagactcttaagttcatcgcacgtaattacaccgacgtacccgaacagattaagcaacagtggtaaagattgcaagttaacatctgctccagcttttacaatttcctcacagccagtagcaatagctgtactaacctgctaactgtcagtgcaacgcctgtgatgagctgaacaccaccccaccatggcctccacagcaagagaacgtctgtcaatacatcagggggtttcctatccctagagatgatgatgcccatggctctcgagaagcagtggccatgggtcataggagaggggcagcagcatatggcagtggtgtgcggggtccttcacctccaccagagatctacgcctccccttgcaatgcctcgggccctcttcatgcctgatgcaacacttggatttggcacacttgcaaggggaggattcaccattggcccatcaccgtgccaacattctccatccaatggatgcagtagagaatgaatatgtacatttacttgtgttgtaatttgatttagagtaactagactattttgattcccttgttaaaataaactgttagccaagctactcttgggcaaacattaccagaagtcgcacaaagtctgttgtgtcctgtgttcgtgctcgtgtcaattcgcccttcagagagcaatgaacgaccatacaaacatccacttgttcaagtacaaagatgtggtgcaattttgtacctcattttgtacatgccacttttattgttgatagaataaataatcaaaagtaaaaaaaaaaaaa

SEQ ID NO: 107770 - protein, 1002 aa, Procambarus clarkii
MDDAHCFPVEDVVAKFGVNIENGLSASQVKDYQAKYGPNELPAEEGKSLLQLILEQFDDLLVKILLLAAIISFVLACFEEGEETVTAFVEPFVILLILIANAIVGVWQERNAESAIEALKEYEPEMGKVVRSKKHGVQKVRAREIVPVDIVEVSVGDKIPADIRLVKIFSTTLRIDQSILTGESVSVIKHTDAIPDPKAVNQDKKNILFSGTNVSAGKARGVVIGTGLATAIGKIRTQMAETEEIKTPLQQKLDEFGEQLSKVISIICVAVWAINIGHFNDPAHGGSWIKGAIYYFKIAVALAVAAIPEGLPAVITTCLALGTRRMAKKNAIVRSLPSVETLGCTSVICSDKTGTLTTNQMSVSRMFIMDKVEGNDSSLLEFEVTGSTYEPIGDVYLKNTKVKGSDFEGLQELSTISFMCNDSSIDFNEFKNVFEKVGEDTETALIVLGEKINPYNMSKSGLDRRSAAIIARHDMETKWKKEFTLEFSRDRKSMSSYCVPLKPTRLGTGPKMFCKGAPEGVLDRCTHVRVGTQKVPLTAGVKEKILSVTRDYGCGRDTLRCLGLATIDNPMKPEDMDLGEASKFYTYEVNMTFVGVVGMLDPPRKEVKDSIQRCRDAGIRVIVITGDNKATAEAICRRIGVFKEDEDTTGMSYSGREFDELSPEEQRQACIRSRLFSRVEPFHKSKIVEYLQGENEISAMTGDGVNDAPALKKAEIGIAMGSGTAVAKSASEMVLADDNFSSIVAAVEEGRAIYNNMKQFIRYLISSNVGEVVSIFLTAALGLPEALIPVQLLWVNLVTDGLPATALGFNPPDLDITDKPPRRADESLISGWLFFRYMAIGGYVGAATVFAASWWFMYDPTGPHLNYYQLPHHLQCLGDPENFEGLDCNIFSHPAPMTMALSVLVTIEMLNALNSLSENQSLLIMPPWVNFWLLAAMALSMTLHFIILYIDILSTVFQVMPLSVAQWVAVLKISFPVLLLDETLKFIARNYTDVPEQIKQQW

SEQ ID NO: 107771 - DNA, 3175 bp, Kosteletzkya virginica
  CDS (23)..(2887)
aaagcaccgtggaaactgaattatggccagcagtaaaggtatcagccttgaggagatcaggaacgagactgttgatctggaaaaaatcccgatcgaggaagtttttgagcagctgaaatgtaccaaagaaggactgagttcggaagagggagccaacaggcttcagatttttggacccaacaagctagaggagaaaaaggagagcaagatcctcaagtttttggggttcatgtggaatcctctgtcatgggttatggaagctgctgcaatcatggccattgctttggctaatggagagggcaagccacccgattggcaagacttcgtcggtatcgtatgtttgctagtcattaactctaccatcagtttcattgaagaaaacaatgctgggaatgcagctgctgctcttatggctggccttgctcccaaaactaaggtgctaagggatggcaaatggagtgagcaagaagcagcaattctggttcctggagacatcattagcgttaaattgggagatatcatcccggctgatgcccgtcttcttgaaggtgatccgttaaaggttgatcaatctgccttgactggagaatcacttcccgtgacgaagcatccagggcaagaagtcttctcaggttcaacctgcaaacagggtgagatcgaagctgttgttattgctaccggtgtgcatactttctttgggaaggctgcacatcttgtggacagcaccaaccaagtaggtcacttccaaaaggtgcttactgctattggaaacttctgtatttgttcaattgccgtcggtatgttggtggagatcatagtcatgtatccaattcaacaccgcaagtacagggatggaatcgacaatctcttggttcttttgattggtggtattcccattgctatgccgactgttttgtctgtgaccatggctattggatcccatagactgtctcaacagggtgctatcaccaagcgtatgactgctattgaagaaatggctggtatggatgtcctttgtagtgataagacagggacattgacactcaacaagcttactgtcgataagaacttgatcgaggtgtttgtaaaggatggcgataaggatcacgtcttgttgcttgctgcaagggcttctagagttgaaaatcaagatgccattgatgctgccattgttggaacacttgccgaccctagggaggcaagagctagtattacagaggtgcatttcttgcctttcaatcctgtggataaaagaactgctataacttacattgattctaatggcaactggcatcgagctagcaaaggtgctcctgagcagatcttggctctttgcaatgcaaaagaagattttaagaagaaggttcattctattatcgacaagtttgctgagcgtgggcttcgttctttagctgtttccagacagcaagtgcctgaaaaatcaaaagaaagtgctggtgctccctggcaatttgttggtttgttgtctctgttcgatcctccaaggcatgacagtgcggaaaccattcgccaaactcttcatcttggtgtgaatgtcaagatgatcactggtgatcaacttgcaatcgcaaaggagactggccgcagactcggaatgggaaccaacatgtatccatctgcttctttgctagggcaagacaaggatgctaacattgctgcccttcctgtggaagagttgattgagaaggctgatggatttgctggcgtatttccagagcacaaatacgagattgtgaaaaaattgcaggagaggaagcacatttgtggaatgactggagatggtgttaacgatgctcctgctttaaagaaggcggatattggtatagcagtggcggatgctacagatgctgctcgaagtgcttctgacattgttctcacagaaccggggctgagtgttattatcagtgcagtgttaactagcagagctattttccagaggatgaagaactatactatctatgcagtctcgatcacaatccgtattgtgtttggattcctgtttattgctctcatctggaagttcgatttttcaccattcatggtgttgatcattgccattctaaacgatggaactatcatgacaatatcgaaggaccgagtcaagccatctcccttgcctgatagctggaaactgaaagaaatttttgctaccggaattgtgctcggaggctacttggcactgatgactgttatattcttctgggccatgcatgataccgacttcttctcggagaaattcagtgttaggtctttaaggggctcagagaatgagatgatgggcgcattgtacttacaagtaagcattgtgagccaggccttgatcttcgtgaccagatcacgcagctggtcgtacgccgagcgtcctggattgctattgctctctgccttcatcattgcacagcttgttgcgactctgattgctgtatatgctaactggggatttgcgaggattaaaggaattggctggggatgggctggtgtcatttggctttacagtatagttttctacgttccattggatttcatcaagtttgcgattcgttacatcttaagcggaaaagcttggctcacacttttcgaaaacaagacggcattcaccaccaagaaagactatggaaaagaggagagggaggctcaatgggcgcttgctcaaagaacattgcacggtcttcaaccgccggaaacttcgaatctcttccacgagaagaacagctaccgtgagctatcggagattgcggagcaggccaagagacgagccgaggttgcaaggcttcgagagcttcatacgctcaaaggtcacgtcgagtctgtcgtaaagctgaaggggctggacatcgatacgatccagcagcattacacggtgtaataaaccagaaaccgataccggaaagatggcggcgattcgatgacatttacagagtgaaacggataaagtaatgtggtttttgaaacattctaacatgtctgtgatgtgaatttcctgccatgtaatgttccttacacagtttcttgcttggtgttttaaatattagggatcaaggatttggatatttgtactttttaaaatatgaattcgaatatgttctgttttaaattctgataaatttcacttataatcaaaaaaaaaaaaaaaaaaaaaaaaaaaaaaaaaaaa

SEQ ID NO: 107772 - protein, 954 aa, Kosteletzkya virginica
MASSKGISLEEIRNETVDLEKIPIEEVFEQLKCTKEGLSSEEGANRLQIFGPNKLEEKKESKILKFLGFMWNPLSWVMEAAAIMAIALANGEGKPPDWQDFVGIVCLLVINSTISFIEENNAGNAAAALMAGLAPKTKVLRDGKWSEQEAAILVPGDIISVKLGDIIPADARLLEGDPLKVDQSALTGESLPVTKHPGQEVFSGSTCKQGEIEAVVIATGVHTFFGKAAHLVDSTNQVGHFQKVLTAIGNFCICSIAVGMLVEIIVMYPIQHRKYRDGIDNLLVLLIGGIPIAMPTVLSVTMAIGSHRLSQQGAITKRMTAIEEMAGMDVLCSDKTGTLTLNKLTVDKNLIEVFVKDGDKDHVLLLAARASRVENQDAIDAAIVGTLADPREARASITEVHFLPFNPVDKRTAITYIDSNGNWHRASKGAPEQILALCNAKEDFKKKVHSIIDKFAERGLRSLAVSRQQVPEKSKESAGAPWQFVGLLSLFDPPRHDSAETIRQTLHLGVNVKMITGDQLAIAKETGRRLGMGTNMYPSASLLGQDKDANIAALPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFLFIALIWKFDFSPFMVLIIAILNDGTIMTISKDRVKPSPLPDSWKLKEIFATGIVLGGYLALMTVIFFWAMHDTDFFSEKFSVRSLRGSENEMMGALYLQVSIVSQALIFVTRSRSWSYAERPGLLLLSAFIIAQLVATLIAVYANWGFARIKGIGWGWAGVIWLYSIVFYVPLDFIKFAIRYILSGKAWLTLFENKTAFTTKKDYGKEEREAQWALAQRTLHGLQPPETSNLFHEKNSYRELSEIAEQAKRRAEVARLRELHTLKGHVESVVKLKGLDIDTIQQHYTV

SEQ ID NO: 107773 - DNA, 2831 bp, Kluyveromyces lactis
  CDS (11)..(2821)
tgcagtatatatgagtgacaatccgtttgagtcttatctcgcacgagaccagcaaccgccacagcccgctgtcgatgtgctttcgcagcctaatgcctcactagaatattgcacggtgtcagtggaagatacgatagcacaattaggaactgatttcgataatggtttatccaatccatcagaaattgcttataggaaatcaatttggggatcaaacgaagtcctacctgatgaggaagtatctctttggaaaaaattcttgtctacattcattgaagaccctttaattcttttgttgatcggatctgcagttatatctttcttaatgggaaacatcgatgattccatcagtattgctctggccatcatcattgttgttaccgtcgggtttgtacaagaatataagtcagagaagtcattagaagcattaaacaagttagtcccagcggaatgtcatttgacaagatcagggcagttatcccatgttcttgcgtcaaacttagttccaggtgatttggtcagatttaaggtcggtgatagaattcctgctgatttaagaattgtagaatctatcgatttgtgcgtagatgaaagtaatttgacaggtgaaaatgaaccagtacacaagagttctggtgcagtggaccctaagaacctactctcatatcctggatccattattccagttggcgatagaaactgtatcggatttatgggtactttggtcagagaaggccatggtaagggaatagtcattgccacaggcaagcatacagtttttggtgtctttgaaatgatgagtggtatagataagccaaagactccattgcagacagcaatggacaaattgggttcaggatttgtcctacatgagttcgttttgattggtattatttgtttgattggtattatccagggtagatcatggttggaaatgttccagatcgctgtttctctagcggtggctgctcctgaaggtttaccaattattgttactgttactttggccctaggggtcttaagaatggctaaacgtaaggctatcgtcaggaggcttccaagtgttgaaactttgggttctgtaaacgttatttgtcttgataagactggtactttgaccgcaaatcatatgactgtttcaaagatttggtgtttgggcagtatggaaaataaaactaattgtttggcattatctaaggtgaaagaaagaccgattaaaatggagcaagatgttgctaccactttgagaatcggtaacatttgcaataatgggacctactcccaggaacatcttaaataccttggtaatccaacagatattgccatcttagagtcattacaacattttggtataaatgattgcagaaactccgtcaacaagattaacgaaatccctttcaattcgaagagaaaatttatggctgtcaaaactatcgatgccaatgataaagtggtagtatacgtgaaaggtgctttcgaaaagattgttgagaaatccatcaactacattggcagagacgggaaggtgcataagctgaaaccaaatgataaagccatcattaacgatgcagctgttgcactggcttctgaaggacttcgtacacttgcttttgcggagctggaggtgagcgccacccatggtgacaaagaattcaatgaagacatggttgaaggcttaacatttactggtctaattgctatgaatgatccacctaggccgacagtccgcagtgccattgaagaactactccaaggtagcgtacatgttattatgatcacaggtgatgctgaaaacactgctgttagtattgctagacaaattggaattcctgtcatcaaccctgaatacgggcttcaggtgataagctggaaccaaatgactgatgaccaattggctagtgttattgatcatgttaacgtgtttgctcgtgctacccctgaacataagttgaacattgttcgcgccttgcaaaagcgtggtcatattgtagcaatgactggcgatggtgttaatgatgcacctgccttgaagttggcagatataggtgtgtctatgggtaaaatgggaactgatgttgccaaagaagcctctgatatggttttaaccgacgatgacttcagtacaattttaactgccattgaagaaggtaaaggtattttcaataatatcaaaattttcttgacctttcaattgtctacctcagttgctgctctttcgttggtcgctatttcgacttctttgaaactaccaaatcctttaaatgccatgcagattctttggattaatatattaatggatggacctccagctcagtccttaggtgttgagcctgtcgatcatgaagttatgagaaaacccccaagaaaaaggactgacaagatcctaactgacgctgtcctcaaaagagtgttgattagtgcatgttttataattgttggaacaatatatgtctttgtcaaggaaatggcagaagatggccaagttacatcaagagacacaactatgacatttacctgttttgtcttttttgatatgtttaatgccttgtcttgtagacatgcaacgaaatccatcttcgagataggattctttgcaaacaagatgttcaactatgctgtgagcttatctcttttaggacaattatgcgccatttatataccattctttcagggtatttttaagacagaaagtcttagcctgggagatttactgttcctcttaacgttaagcagcagcgttttcattggtgatgaaatcaggaaatactatgtcaagaaaaatagatactttcaggactcatatagctcctcaattgtttaattggtctgat

SEQ ID NO: 107774 - protein, 936 aa, Kluyveromyces lactis
MSDNPFESYLARDQQPPQPAVDVLSQPNASLEYCTVSVEDTIAQLGTDFDNGLSNPSEIAYRKSIWGSNEVLPDEEVSLWKKFLSTFIEDPLILLLIGSAVISFLMGNIDDSISIALAIIIVVTVGFVQEYKSEKSLEALNKLVPAECHLTRSGQLSHVLASNLVPGDLVRFKVGDRIPADLRIVESIDLCVDESNLTGENEPVHKSSGAVDPKNLLSYPGSIIPVGDRNCIGFMGTLVREGHGKGIVIATGKHTVFGVFEMMSGIDKPKTPLQTAMDKLGSGFVLHEFVLIGIICLIGIIQGRSWLEMFQIAVSLAVAAPEGLPIIVTVTLALGVLRMAKRKAIVRRLPSVETLGSVNVICLDKTGTLTANHMTVSKIWCLGSMENKTNCLALSKVKERPIKMEQDVATTLRIGNICNNGTYSQEHLKYLGNPTDIAILESLQHFGINDCRNSVNKINEIPFNSKRKFMAVKTIDANDKVVVYVKGAFEKIVEKSINYIGRDGKVHKLKPNDKAIINDAAVALASEGLRTLAFAELEVSATHGDKEFNEDMVEGLTFTGLIAMNDPPRPTVRSAIEELLQGSVHVIMITGDAENTAVSIARQIGIPVINPEYGLQVISWNQMTDDQLASVIDHVNVFARATPEHKLNIVRALQKRGHIVAMTGDGVNDAPALKLADIGVSMGKMGTDVAKEASDMVLTDDDFSTILTAIEEGKGIFNNIKIFLTFQLSTSVAALSLVAISTSLKLPNPLNAMQILWINILMDGPPAQSLGVEPVDHEVMRKPPRKRTDKILTDAVLKRVLISACFIIVGTIYVFVKEMAEDGQVTSRDTTMTFTCFVFFDMFNALSCRHATKSIFEIGFFANKMFNYAVSLSLLGQLCAIYIPFFQGIFKTESLSLGDLLFLLTLSSSVFIGDEIRKYYVKKNRYFQDSYSSSIV

SEQ ID NO: 107775 - DNA, 3510 bp, Pichia angusta
  CDS (394)..(3150)
agatctgccagatcgaggagatgaagtcatacatttcgcacctggaaaaccagctaaggcggcagatgagcggttcgaagtctggcaccagcgttgtgggcagcactagcgacaaggacgaagagattgcggatctcaaacggcagctcaagagcaaggattccataatcagcgcgttgcggcagtctacaagggtgcgcgagaccatcaacggcggagtcgagcgacgcgaaaagctgttcctacggccgatcgaaaataccgttgcggtgcaaaaagagcatctcaaaggacagcactaactaaatacttttcatgtatttttcagcctcgggctttttcctccataagtaaaatcggcacgaaaaattatttatctgtttaggttcttctatggcttcggataatccctacgccagcaaactgaccgattctactacggacatcgagctgtcccggatggaccagttcgaggacggcctatccaccagatacgccggcaagaccgtggaggaaaccgttcaagaactagacacagatgcgagcaagggactgtgcaatcagaacgatattgtgtacaggcgatctgttcatggagtcaatgagatggttaatgaggaggaggagtctctgtttattaaattcgtgtcgacgttctacggcgatccgatgatcttgctgttgatcgggtctgctggcatcagtttttacatgggcaatctggacgacgccatcagtatcacggcggctgtgttgattgttgtgactgtcggatttgtccaggaataccgctcggagaagagcttggaggccctgaacaagctcgttccagaattggcgcatctaacgagaaacggcaccacagagacggtgatggcctcaacgctggttccgggcgacctggtgcatttccaggtcggcgaccggataccggccgacgtgaggctcacagaggctgtccacctgaccatagacgaaagcaatctcaccggcgaaacgaacccgatctccaaaaatctggacgtggtcaccaaacctatgcctagcattggagagagaaccaacattgcattcatgggaacgctggtcagagacggccacgggtcgggaatcgtcattgccacgagccacaagactgctcttggcggggtgcactcaatgctatcttctatcgagaaacctaagacgccgctgcagaacgctatgggcaagctgggtcaacagctttcatttttcagttttgcggtgattggcatcatcggcatcattggcgtgatcgagggccgttcgtggctcgacatgttccagatcagcgtctgtttggctgttgctgccattccagaaggtttgcccatcatcgttgccgtgactcttgcgttgggtgtgctcagaatggccaagcaacgtgcaatcgtcaagaaattacctagcgtcgagactctgggctcggtcaacgtcatctgctcggacaagacgggaacgctgacacagaaccacatgaccatcagcaaggtctggaccgtcgacatgaaaaattcgcatttgaacctagaaaaaaaagacgacgtgtctgctagcctgaccaaagatgtgaaatacatgcttgagacaggaaacctgtgcaacaacgccaagtattcggtcgagaaggaaaaataccttggaaaccctaccgacatcgccattatcgagtctctatccaagtttggcatggaagatctgcgaaacaccagagtccgctcgagtgagttgccattcaactctagccgcaaatacatggcgatctcgtcgcactttggtgacaaggccaagagcgagacgtttgcaaagggtgccatcgaaaaaatcgtgggcatgtccaaaatgtactacgccaaggacggcgagatcaaaccgctcacagaggaagtgacaaaattaattttcaagatggctgacgagctggccagcgacgggctgcgtgtgcttggatttgccagaaactcaaaggccttcgacaaggagccatccgaccttgttttctgcggcctcatgggaatgaacgacccgccccgtccacaggtgagccagtcgattgcttcgctcatcagaggaggcgtccacgtgatcatgatcacgggcgacagcgaggtcacggcgaccaacatcgcgcgcaagatcggcatgccactgagcgacccggaacgcagcgttcttaatggagacaaaatcgactcgatgtctgaggaggacctggctgacgcgatccagtccgtgtctgtgtttgccagaacgactccagagcacaaggtgtctattgtccgtgcgttgcaaatgcgtggcgacattgtggccatgactggagatggcgtgaacgacgcccctgcactcaagctggccgatattggcattgccatgggcaagaacggcacagacgttgccaaggaggccgcagacatggttttgaccgacgacgacttcagcaccattttgcacgccataagagaaggaaagggcattttcaacaacatccagaacttcctcacattccagctgtcgacgtctgtggctgctctttctctgattgccgtttcgacgcttttcaacctgcctaatcccctcaacgccatgcagattctatggatcaacattttgatggatggcccccctgcacagtcgcttggtgtcgagcctgtggatcaggaggtcatgaacaagccacctagaccaaggtccgagaggatcctgaccgctgctgtgttgaagagagtcttggtcgctgctttctgcatcatcgttggaaccatgtacgtctacgtccgcgaaatgaaggattctgtcacgagacgcgacaccacgatgacattcacgtgctttgtcctctttgacatgttcaacgctctctcgtgccgttcgtacacaaagtctgttttccaactcggcctcaagaactccatgttcaactacgccgttggcggctcgctgctcggccagctgtgtgctatctacgtgccgttcttccagtcgattttccagaccgagtcgcttagcttcggcgaccttgtgtacctcgtgatgatcaccagctctgtctggatcgtggacgaggtccgcaagtacctcagacgcaaaaatgcgggttactcatacggttactcgacgtctgtctagatctgcctccaagtcgggctcactctcgctgtaatcttgctccagctccattttctccagctcttttcttctgatttttttctctctccgttttctcttcactatatccttgtcctccacgtcggcagcctccattgcctttttctcctcgttcacaaactcctccttcaacttctcggctggaccttccttatggaactcctcctcgtcctccagctcgtagatcggatgcgcttttccctcgtcgtcaaacaccagctttgtgcccgatccacgagccttggcagccagcttcttcgacaatgcctttttcatggcccttttcgacgtgttcgcctccaaagtaggcagatcctgcag

SEQ ID NO: 107776 - protein, 918 aa, Pichia angusta
MASDNPYASKLTDSTTDIELSRMDQFEDGLSTRYAGKTVEETVQELDTDASKGLCNQNDIVYRRSVHGVNEMVNEEEESLFIKFVSTFYGDPMILLLIGSAGISFYMGNLDDAISITAAVLIVVTVGFVQEYRSEKSLEALNKLVPELAHLTRNGTTETVMASTLVPGDLVHFQVGDRIPADVRLTEAVHLTIDESNLTGETNPISKNLDVVTKPMPSIGERTNIAFMGTLVRDGHGSGIVIATSHKTALGGVHSMLSSIEKPKTPLQNAMGKLGQQLSFFSFAVIGIIGIIGVIEGRSWLDMFQISVCLAVAAIPEGLPIIVAVTLALGVLRMAKQRAIVKKLPSVETLGSVNVICSDKTGTLTQNHMTISKVWTVDMKNSHLNLEKKDDVSASLTKDVKYMLETGNLCNNAKYSVEKEKYLGNPTDIAIIESLSKFGMEDLRNTRVRSSELPFNSSRKYMAISSHFGDKAKSETFAKGAIEKIVGMSKMYYAKDGEIKPLTEEVTKLIFKMADELASDGLRVLGFARNSKAFDKEPSDLVFCGLMGMNDPPRPQVSQSIASLIRGGVHVIMITGDSEVTATNIARKIGMPLSDPERSVLNGDKIDSMSEEDLADAIQSVSVFARTTPEHKVSIVRALQMRGDIVAMTGDGVNDAPALKLADIGIAMGKNGTDVAKEAADMVLTDDDFSTILHAIREGKGIFNNIQNFLTFQLSTSVAALSLIAVSTLFNLPNPLNAMQILWINILMDGPPAQSLGVEPVDQEVMNKPPRPRSERILTAAVLKRVLVAAFCIIVGTMYVYVREMKDSVTRRDTTMTFTCFVLFDMFNALSCRSYTKSVFQLGLKNSMFNYAVGGSLLGQLCAIYVPFFQSIFQTESLSFGDLVYLVMITSSVWIVDEVRKYLRRKNAGYSYGYSTSV

SEQ ID NO: 107777 - DNA, 4329 bp, Pichia angusta
  CDS (1501)..(4197)
cctctaggtgcactttccctgctgcggaaggtgctagtcttggagccgtttcgtcgacgcatcgaagagattaagcagcatccttgggtggccaagaaaaacaagtttgcggaccaaaatgatatgtgcaaagacccaatgcgtctcaccacgagcctgctggtgaacctttacatcaacctttcggacgcagagttcaacaagatcagccagatgtccacccagatcagcaagccggcagcaggaacgcaacccccaaaatacgtgatggacgatacgcagccggcagagatcctgtcgagcgacagcacgaggagtggacggagtaaaccagcggcgagtttgggttataagttttcggttataggaggataaatggaactgtatgaatagtgaggatcgttatctgtaattaaaaatgcagaattattagctggcctcggtgcagtgcagtcaggagtagtaatcaccaaatttacctaattagtgctatgaaacaggaccaccctggatacacgcaaggcaagtctccgagagggtctatgtcacatggggcatcaaaaggtacagtactgagggccatgacaacaagactgtcgtgatccggggtatcttatttgggtaagcaagtttcccaatagggaacaatgcggtctaaaaacagaacacaggcatttttaggcggtggatgcggaatgaataaatggctggaaagatcggctcggttttggcaagttgagtgaaaaaaaacctggccgaaaaaacctcaaaagttatgatttcgcatataaccggtcttggtccgaaaccggtgcagaaaatatgctcttggccgtagttgtagaagctggggatgagttgcaaagaggccatttggcgttgacgggtgagggcggatctccaggaacagtacatggacagaagccagttctagattcgcattttcccgagtttgagctgtccctgtctgggtcctgcgacttttcccctggattgctaaaaaggtaaacaatagcgtacagaaagaaacgatagcgtagaaaaggcgggtaagatacacttaataaaacgtctccgcgaaagcagcatccagataaccgggtcagatggaggagctcacggctagattgagtgcagcggtttgctcggcacggtcgagccagtatcggcaatgtcccggtgtccaattttcacgcaaattacgtcttcccggatattccgttgctggaaaacaatagaaatcggttttgttaacgatatcgaccagtgaaaatacagctaaataactcgttggtcggaaacttaattgtggtttgtgtttcttttttacccttttggtaccgattgttgtttactgaatttggacaaacaaagtcgctcgttgcaaggtgcataatttgcatccacctcttaaaaatgcagtatctttccttcgtttttctccatccaactttatattctttttttctttcagttcaattgctagaatagagactcatcatgtctgcaactgaaccaaccaaggagaaagtccctcttcaggaagatgatgaagaggaagaggacatcgaccaattggtgatggaattgcaatccaaccacggtgccgacgacggcgatgaggaggacgaggtgcaggaccactcttccttcaaagtcgttcccgaggagctgctgagaaccgacccaaaggttggtttgacctccgaggaggttgccaaaagaagaaagaagtttggtcctaaccagatggccgaggaaaaggagaacctcgtgctcaagttctgtatgttctttatcggtcctatccagttcgtcatggaggctgctgccattctggctgccggtctcgaggactgggtcgatttcggtgttatctgtggtttgctgatgttgaacgcctgtgtcggtttcatccaggagtaccaggccggttctattgtcgacgagttgaagaagacgctggcaaacactgccaccgtcatcagagatggccacccggttgaaattgctgcttctgaggttgttccaggtgacattttgcagctggaagacggtgttgtcattcctgccgacggtaagcttgtttcggatgagtgtttcttgcaagttgaccagtccgcccttaccggtgagtctctggccgtcgacaagagatctggagacccaaccttctcttcttccactgtcaagagaggtgaggctttgatgattgttactgccaccggtgattccaccttcgttggtagagctgctgctctggtcaacaaggcctctggtggtcaaggtcacttcaccgaggtgctgaacggtatcggtaccgccttgctcgtcttggtcattgtcactctgttggttgtctggacttctgccttcacagaaccgcaaaagatcgtcagaatcctcagatacacccttgccatcaccattgttggtgtgccagtcggtcttccagccgtcgtcaccactaccatggccgtcggggctgcttacttggcaaagaagcaggccattgtccaaaaactgtctgctatcgagtctcttgccggtgtcgagatcctgtgttccgacgagaccggtaccttgaccaagaacaagctttctctgcacgagccttacaccgtcgagggcgttgagccagatgacttgatgcttactgcctgtcttgctgcttccagaaagaagaagggtcttgatgccatcgacaaggccttcctcaaatccctgatcaactacccaagagccagagccgctttgaccaagtacaagatgctcgagttccagccattcgacccagtttccaagaaagtcactgcatacgtcgagtccccagaaggtgagagaatcatctgtgtcaaaggtgctccattgttcgttctgaagaccgtccaggaagaccaccctatcccagaggacattctcgagaagtacgaaaacaaggttgccgagtttgcttccagaggtttcagatctctgggtgttgccagaaagagaggtgagggccactgggagattctcggtatcatgccatgtatggaccctcctagagatgacactgctaagactgttaacgaggctaaggagctcggtttgagagtcaagatgcttactggtgacgctgttggtattgccaaggagacctgcagacagttgggtcttggtaccaacattttcgatgccgacagattgggactttccggaggaggagacttgtctggatccgagctgtttgactttgttgagaacgctgacggtttcgctgaggtcttccctcaacacaagaacaatgtcgttgagattctgcaaaagagaggttacttggttaccatgactggtggcggtgtcaacgacgccccatctcttaagaaggccgacactggtattgccgtcgaaggtgcctcggactctgccagatctgctgccgatatcgttttccttgctccaggtctttctgccatcattgacgccttgaagacttccagacagattttccacagaatgtacgcctacgttgtctaccgcattgttctgtctttgcacttggagatcttccttggtctgtggattgccattctgaacgagtctttgaacatcgacttggttgtcttcattgccatctttgccgacgttgctactcttgccattgcttacgataacgctccattcgaccagaagccagtcaagtggaacctgccaagattatggggtatgtccatcgtcatgggtgtcatccttgccgtcggtacatggatcaccttgactaccatgttcctgccaaagggaggtatcattcagaacttcggttccatcgtcgacggtgtcctgttcttgcaaatctccctgactgagaactggctgattttcgttaccagagccaccggtccattctggtcctccattccatcgtggcaactgtctggtgccgtcttgattgtcgatatcattgccaccatgttcaccctgttcggatggtggtctcagaactggaacgacatcgtcactgttgtcagagtgtggatctggtcgttcggtgtcttctgtgtccttggtggtgcctacgttatcatgtctgaatctgagaagttcgacagattcatgaacggcaagccactgaaggagagacctcctcaaagaacccttgaggacttcatggttgccatgaacagagtctctactcagcacgagaagtccaactgagccagcacttgaatgggttaatagaggactgctccccattattgatatcttgcttccttcgtgcccacgacagcctaataactaatattttgttctatttaggatgttcagttttgtgatcccccgggtacc

SEQ ID NO: 107778 - protein, 898 aa, Pichia angusta
MSATEPTKEKVPLQEDDEEEEDIDQLVMELQSNHGADDGDEEDEVQDHSSFKVVPEELLRTDPKVGLTSEEVAKRRKKFGPNQMAEEKENLVLKFCMFFIGPIQFVMEAAAILAAGLEDWVDFGVICGLLMLNACVGFIQEYQAGSIVDELKKTLANTATVIRDGHPVEIAASEVVPGDILQLEDGVVIPADGKLVSDECFLQVDQSALTGESLAVDKRSGDPTFSSSTVKRGEALMIVTATGDSTFVGRAAALVNKASGGQGHFTEVLNGIGTALLVLVIVTLLVVWTSAFTEPQKIVRILRYTLAITIVGVPVGLPAVVTTTMAVGAAYLAKKQAIVQKLSAIESLAGVEILCSDETGTLTKNKLSLHEPYTVEGVEPDDLMLTACLAASRKKKGLDAIDKAFLKSLINYPRARAALTKYKMLEFQPFDPVSKKVTAYVESPEGERIICVKGAPLFVLKTVQEDHPIPEDILEKYENKVAEFASRGFRSLGVARKRGEGHWEILGIMPCMDPPRDDTAKTVNEAKELGLRVKMLTGDAVGIAKETCRQLGLGTNIFDADRLGLSGGGDLSGSELFDFVENADGFAEVFPQHKNNVVEILQKRGYLVTMTGGGVNDAPSLKKADTGIAVEGASDSARSAADIVFLAPGLSAIIDALKTSRQIFHRMYAYVVYRIVLSLHLEIFLGLWIAILNESLNIDLVVFIAIFADVATLAIAYDNAPFDQKPVKWNLPRLWGMSIVMGVILAVGTWITLTTMFLPKGGIIQNFGSIVDGVLFLQISLTENWLIFVTRATGPFWSSIPSWQLSGAVLIVDIIATMFTLFGWWSQNWNDIVTVVRVWIWSFGVFCVLGGAYVIMSESEKFDRFMNGKPLKERPPQRTLEDFMVAMNRVSTQHEKSN

SEQ ID NO: 107779 - DNA, 3003 bp, Heliothis virescens
  CDS (1)..(3003)
atggaggacgctcactcgaaatccgtggatgaagtcttagggtacttcggtacagacccagacaaaggccttagtgcagaccaagtaaaaaggaaccaagataaatatgggccaaatgaactgcctgcggaggagggcaaaagtatatggcagttagtcctggaacaattcgatgacctcttagtaaagattttgctgttagccgctattatttcattcgttttagctttatttgaagaacacgaagacgcattctccgccttcgtagagccttttgttattttacttattcttattgctaacgctgtagtaggagtatggcaggaaagaaatgccgaatccgccatcgaagctttaaaagaatacgaacccgaaatgggtaaagtaatcagaggagacaaatccggtgtacagaaaatccgagccaaagaaatcgtacccggtgatgtcgtggaggtgtcagtcggtgacaaaatccccgctgacatccgtcttattaagatttactccaccaccatccgtattgatcagtccatcttgaccggagagtcagtctccgtcatcaagcacacagaccccattcccgacccccgcgccgtcaaccaggacaaaaagaacattctcttctccggtaccaatgtcgccgccggcaaggcccgtggtattgtcatcggaactggtctcaacactgccattggtaaaatccgtactgaaatgtccgagactgaggagatcaagacacctctgcagcaaaaactggacgaattcggtgagcagttgtctaaggtcatctcagttatttgcgttgccgtatgggccatcaacatcggacacttcaacgaccccgcccacggtggaagctggatcaagggtgccgtctactacttcaaaatcgctgtcgccctggccgtcgctgccatccccgaaggtctccccgctgtcatcaccacttgtctcgctctcggtaccaggcgtatggctaagaagaacgctatcgtgaggtcgctgccctctgtagagaccctcggttgcacttctgtcatctgctccgacaagaccggtactctgaccaccaaccagatgtctgtttcccgtatgttcatctttgagaagatcgaaggtggcgacagcagcttccttgaatttgaaattactggttccacctacgagcctattggtgatgtctacctgaagggacagaagatcaaggctgctgaattcgatgctctgcacgaacttggtaccatttgcgttatgtgcaatgactccgctattgatttcaacgaattcaaacaggcgttcgaaaaggtcggtgaagccactgaaacggctcttatcgtactcgctgagaaaatgaaccccttcaacgttcccaagactggacttgaccgtcgctcctgcgctatcgttgtccgccaagagattgaaaccaaatggaagaaagagttcactcttgagttctcccgtgacaggaaatccatgtccacctactgcacaccccttaagccttcccgtcttggcaatggacccaaactgttcgtcaagggtgcacctgaaggtgtgcttgaacgttgcacgcacgctcgtgtcggaactgccaaagtacctttgaactcgaccctcaagaaccgcatcctggacctcacccgccaatacggtaccggtcgtgacacccttcgttgcttggccctcgctaccgctgacagcccactcaaacctgacgaaatggacctcggagactcgaccaagttctacacctatgaagtcaaccttacattcgtcggtgtcgtcggcatgttggaccctccccgtaaagaagtattcgactctatcgtccgttgccgcgctgctggtatccgtgtaattgtcatcactggtgacaacaaggccaccgctgaagctatctgcaggcgtattggcgtgttcactgaagaagaagacaccaccggcaaatcgttctctggtcgcgagttcgacgacctgcccgtgtcggaacagcgcgccgcttgcgctaaggctcgcctgttctcccgcgtggaacccgcccacaagtccaagattgttgagttcctgcaaagcatgaacgagatctctgctatgactggtgacggtgtaaatgacgcccccgctctgaagaaggccgaaatcggtattgctatgggctctggtaccgctgtcgctaagtctgccgccgagatggtgttggctgatgacaacttctcatccattgtcgccgctgttgaggaaggtcgtgccatctacaacaacatgaagcagttcatccgttacctgatctcctccaacattggtgaagtcgtgtccatcttcttgactgccgctctgggtctccccgaagctctgatccccgtccaactgttgtgggtcaacttggtcactgacggtctgcccgccaccgccctcggcttcaacccccctgatctcgacatcatggacaagcccccccgtaaggctgatgagggtctcatctctggatggctgttcttcaggtacatggctatcggtggttacgtcggtgccgctaccgtcggagccgcgtcgtggtggttcatgtactctcctttcggaccccagatgtcttactggcagctcacccaccacttacagtgcctcagcggaggtgatgaattcaagggcatcgactgcaagatcttcactgaccctcaccctatgacaatggccctgtccgtattagtaacaattgaaatgttgaacgccatgaacagtttgtctgagaaccagtcgctggtgaccatgccgccctggtccaacatgtggctcgtcggctccatggccctctccttcactctccacttcgtcatcctctacgttgaggtcctgtcggccgtgttccaagtgacgccgctgtccatcgacgagtgggtgacggtgatgaagttctcgatacccgtggtgttgctggacgaggtgctgaagttcgtcgcgcgcaagatctcggacgcccagccgacgtggaagctgtaa

SEQ ID NO: 107780 - protein, 1000 aa, Heliothis virescens
MEDAHSKSVDEVLGYFGTDPDKGLSADQVKRNQDKYGPNELPAEEGKSIWQLVLEQFDDLLVKILLLAAIISFVLALFEEHEDAFSAFVEPFVILLILIANAVVGVWQERNAESAIEALKEYEPEMGKVIRGDKSGVQKIRAKEIVPGDVVEVSVGDKIPADIRLIKIYSTTIRIDQSILTGESVSVIKHTDPIPDPRAVNQDKKNILFSGTNVAAGKARGIVIGTGLNTAIGKIRTEMSETEEIKTPLQQKLDEFGEQLSKVISVICVAVWAINIGHFNDPAHGGSWIKGAVYYFKIAVALAVAAIPEGLPAVITTCLALGTRRMAKKNAIVRSLPSVETLGCTSVICSDKTGTLTTNQMSVSRMFIFEKIEGGDSSFLEFEITGSTYEPIGDVYLKGQKIKAAEFDALHELGTICVMCNDSAIDFNEFKQAFEKVGEATETALIVLAEKMNPFNVPKTGLDRRSCAIVVRQEIETKWKKEFTLEFSRDRKSMSTYCTPLKPSRLGNGPKLFVKGAPEGVLERCTHARVGTAKVPLNSTLKNRILDLTRQYGTGRDTLRCLALATADSPLKPDEMDLGDSTKFYTYEVNLTFVGVVGMLDPPRKEVFDSIVRCRAAGIRVIVITGDNKATAEAICRRIGVFTEEEDTTGKSFSGREFDDLPVSEQRAACAKARLFSRVEPAHKSKIVEFLQSMNEISAMTGDGVNDAPALKKAEIGIAMGSGTAVAKSAAEMVLADDNFSSIVAAVEEGRAIYNNMKQFIRYLISSNIGEVVSIFLTAALGLPEALIPVQLLWVNLVTDGLPATALGFNPPDLDIMDKPPRKADEGLISGWLFFRYMAIGGYVGAATVGAASWWFMYSPFGPQMSYWQLTHHLQCLSGGDEFKGIDCKIFTDPHPMTMALSVLVTIEMLNAMNSLSENQSLVTMPPWSNMWLVGSMALSFTLHFVILYVEVLSAVFQVTPLSIDEWVTVMKFSIPVVLLDEVLKFVARKISDAQPTWKL

SEQ ID NO: 107781 - DNA, 2991 bp, Caenorhabditis elegans
  CDS (1)..(2991)
atgggtaaaaaagacaagaaacaggagttacatgacctcaagcaggaggtcaaaatggacgagcatatcgttccgattgaggagcttgttgccagactcggaaccaatctcgaaacgggattgacccgccagaaggctcaagaagttctcgccaagaacggaccaaatgctttgtcaccccctgaaactaccccagaatggatcaagttctgtaagaacttgttcggaggatttgccatgcttctttgggttggagctatcctttgttacatcgcctactctgtggattatttcaccatggagtacccatctaaggataacttgtacctcggaattgtacttatgactgtcgtcgtcatcaccggagttttccaatactatcaggaaagcaagtcgtcgaagattatggattcctttaagaacatggttccaacctttgctcttgttcaccgtgatggccaaaagcaacaagtgaagactgaagaacttgtcgtcggagacattgttgaagtcaaaggaggagatcgtgttccagctgatcttcgtgttgtctctgctttcggattcaaggttgacaactcttctctcaccggagagtctgagccacaatcccgttccccagactgcaccaacgaaaatccactcgagacccgtaacatcgctttcttctctaccaacgctgttgaaggaaccgctaaaggaatcgtcatttacactggagataacaccgtcatgggaagaattgcccatttggcttcaggacttgacaccggaatgaccccaattgctcgtgaaattgagcatttcatccatcttattactggagtcgccgtcttccttggaatctccttcttcatcatcgccttcatcctcggataccattggcttaccgctgttgttttcctcatcggtatcatcgtcgccaacgtcccagaaggattgatcgctaccgtcactgtgtgccttactcttaccgccaagagaatggctagcaagaactgccttgtcaagaatcttgaagctgtcgagacccttggatctacatctaccatttgctctgataagacaggaactctcacccaaaacagaatgactgtcgctcacatgtggtacgatgaaaccatccatgagtgtgataccaccgaaactcaaaccagccaggaaaagagaactggagccagcttcgaagctctcgtccgtattgcttctctctgtaaccgtgccgagttcaaggctggacaacaagacactccaattcttcgtcgtgactgcacaggagatgcttctgagattgctcttcttaagttcactgagcttactcaaggaaatgtcatcgctgtccgtgaaaagaacaagaagattgctgaaattccattcaactccaccaacaaataccaagtttcgattcacgacaatggagatcattacttgcttgttatgaagggtgctccagaaagaattttggatgtttgctcgaccatcttcttgaacggaaaagaatctgaacttactgacaaacttcgcgaagatttcaacactgcctatcttgagttgggaggaatgggagaacgtgttctcggattctgtgacttcgtacttccagccgacaagttcccgaaaggattcaaattcgatgttgaagaggttaacttcccattaaaaaatttgagattcgtcggactcatgtctatgatcgatccaccacgtgctgctgtcccagatgccgtcgccaagtgccgttccgcaggaatcaaagtcgtcatggtcaccggagatcacccaatcacagccaaggccattgccaagtctgtcggaatcatctctgatggaactgaaaccgttgaagatattgctatccgtcgtggaattccagtcgaagaagtcaacccacgtgaagccaaggccgctgttattcacggatccgatctccgtgagatgagcgaggatcagcttgccgagatcatcaagtaccactctgaaatcgtattcgctcgtacttcaccgcagcaaaagctgatgatcgtcgaaggattccagaagcaaggtcaaatcgtcgctgtaaccggagacggatgcaacgattctccagctttaaagaaggccgacatcggagttgctatgggtattgctggatctgatgtgtcaaaacaagctgctgacatgatcttgcttgatgataacttcgcttcctacgtcgttggtgttgaagaaggacgtcttattttcgataacttgaagaaatccatcgcctacacactcacctcaaatattccagaaatctctccattcttgacctacatcctgttcggaatcccacttccactcggaaccgttaccatcctttgtatcgacctcggaactgacatggtgccagctatctcccttgcctacgaagaagccgaatccgacatcatgaagcgtcagccacgtgacccaatccgtgacaagcttgtaaacgaacgtttgatctcccttgcttatgggcaaattggtatgattcaagcttctgctggattcttcacctatttctggatcatggctgataacggattcatgccatgggatctctaccagctccgtgctcaatgggattctcgtgcctacaacaacgttctcgattcctacggacaagaatggacctatgccaacagaaagatcctcgaatacacctgccaaaccgcctacttcgtgtccattgttgttgtacaatgggctgatttgatcatctccaagaccagacgtaactcccttgtccaacagggaatgtccaactggaccctcaactttggacttgtcttcgaaaccgcccttgcctggttcatgtgctattgcccaggacttgacaatggacttcgtatgtacggactcagattctcctggtggttctgtgcccttccattctcaatcctcatcttcgtctacgacgagatccgtcgtttcttgattcgcagatatccaggaggatgggtcgagcgtgagacctactactaa

SEQ ID NO: 107782 - protein, 996 aa, Caenorhabditis elegans
MGKKDKKQELHDLKQEVKMDEHIVPIEELVARLGTNLETGLTRQKAQEVLAKNGPNALSPPETTPEWIKFCKNLFGGFAMLLWVGAILCYIAYSVDYFTMEYPSKDNLYLGIVLMTVVVITGVFQYYQESKSSKIMDSFKNMVPTFALVHRDGQKQQVKTEELVVGDIVEVKGGDRVPADLRVVSAFGFKVDNSSLTGESEPQSRSPDCTNENPLETRNIAFFSTNAVEGTAKGIVIYTGDNTVMGRIAHLASGLDTGMTPIAREIEHFIHLITGVAVFLGISFFIIAFILGYHWLTAVVFLIGIIVANVPEGLIATVTVCLTLTAKRMASKNCLVKNLEAVETLGSTSTICSDKTGTLTQNRMTVAHMWYDETIHECDTTETQTSQEKRTGASFEALVRIASLCNRAEFKAGQQDTPILRRDCTGDASEIALLKFTELTQGNVIAVREKNKKIAEIPFNSTNKYQVSIHDNGDHYLLVMKGAPERILDVCSTIFLNGKESELTDKLREDFNTAYLELGGMGERVLGFCDFVLPADKFPKGFKFDVEEVNFPLKNLRFVGLMSMIDPPRAAVPDAVAKCRSAGIKVVMVTGDHPITAKAIAKSVGIISDGTETVEDIAIRRGIPVEEVNPREAKAAVIHGSDLREMSEDQLAEIIKYHSEIVFARTSPQQKLMIVEGFQKQGQIVAVTGDGCNDSPALKKADIGVAMGIAGSDVSKQAADMILLDDNFASYVVGVEEGRLIFDNLKKSIAYTLTSNIPEISPFLTYILFGIPLPLGTVTILCIDLGTDMVPAISLAYEEAESDIMKRQPRDPIRDKLVNERLISLAYGQIGMIQASAGFFTYFWIMADNGFMPWDLYQLRAQWDSRAYNNVLDSYGQEWTYANRKILEYTCQTAYFVSIVVVQWADLIISKTRRNSLVQQGMSNWTLNFGLVFETALAWFMCYCPGLDNGLRMYGLRFSWWFCALPFSILIFVYDEIRRFLIRRYPGGWVERETYY

SEQ ID NO: 107783 - DNA, 3319 bp, Vicia faba
  CDS (152)..(3022)
gaattcgcggccgccgtctttttcttgggattaattctcattcaatggttcttttatccctttgaaattcatttctcttttcactttttcttcacaaattcactttgcagtttcttcctgagtggtctgattcttctccttttctcacaacatggctgctatctcactagaacagatcaagaatgagtctgttgatttggaaaaaatcccaattgaggaagtgtttgcgcaattgaaatgtaccagagaaggtttgtcctctacagaaggagaaagcaggattcaaatatttggtcctaacaagcttgaagagaaaaaggagagcaaatttctcaagtttcttgggtttatgtggaatcccttatcatgggtgatggaagctgcagctgtaatggcgattgctcttgcaaatggtggagggcagcctccggattggcaagattttgtgggaattgtgtgcttgttggttatcaattcaactatcagtttcattgaagaaaacaatgctggaaatgctgctgctgctcttatggcaggtcttgctcctaagacgaaggttcttagagatggtaaatggagtgagcaagaagctgcaattctcgttccaggagacatcattagtatcaagcttggtgacatcataccagccgatgctcgtcttctagaaggtgatcctttaaaggttgaccaagcagcattaacaggagaatcacttccggttactagacatccaggacaagaagttttctcaggctcaacatgcaaacaaggagaaattgaagctgttgttattgcaaccggtgtccacacattcttcggaaaagcagcacatttggttgacaatacaaacaatgttggacatttccaaatggttctcaaatcaattggaaacttttgtatctgttccattgcagttggtatgttggctgagattatagtcatgtatccaattcaacatcgcaaatatcgcgatggtattgacaacctgttagtccttttgattggtggaattcctattgctatgccaactgttttgtctgtgacaatggctattggttctcataagctttctcagcaaggtgctattacaaaaagaatgacggccattgaggaaatggctggtatggacgttctttgtagtgacaagacgggaacacttacgcttaacaaattgagtgttgataggaacttgattgaagtttttattaagggtatggataaggaacatgtgattcttcttgctgctagggctgctaggactgaaaatcaggatgctattgatgctgctattgttggaatgcttgctgaccctaaagaggcgagggccgagataacagaggtgcatttcttgccattcaatccaaatgataagagaactgctttgacatacattgataataaggatggaacctggcatagagctagcaaaggtgctcctgagcagattatagagttgtgtaacatgagagaagatgctcaaaagaagattcattccatgattgaaaagttcgcagaaagagggctacgttcacttggtgttgctagacaggaagttcctgagaaaacaaaggaaagtgctggtgctccatggcagtttgttggtttgttgtcggtgtttgatcctcctaggcatgacagtgctgagaccattagacaagctcttaacctcggtgttaatgttaagatgattacaggtgatcaacttgccatagctaaggaaactggtaggagacttggtatgggaaccaatatgtatccttctgctacattgcttggtctagacaaagattcaagtgtggcttcaatgccagttgaagagcttattgagaaggcagatggatttgccggagttttcccagaacataaatatgaaattgtgaagaagctacaagagaggaagcacatttgtggaatgactggagatggtgtgaatgatgctcctgcattgaagaaagctgatattggaattgctgttgccgatgctactgatgctgcaagaggcgcttctgatatagtcttgacagaacctggtttgagtgttatcattagtgcagtcttgacaagtagagctattttccaaagaatgaaaaactacacgatctatgcagtgtctatcactatccgtatagtgtttggatttatgtttattgcattgatatggaagtttgatttctctccattcatgattttgattattgccattttaaacgatggaaccatcatgacaatttcaaaggatagggttaagccatctccattgcccgatagctggaaactgaaagaaatatttgctactggagtcatgcttggaggttaccaggcattgatgactgtgatattcttttggatagtgcaaggcactaaattcttccctgacagatttggagttagacatattcatgacaatcccgatgaattgactgctgctttgtatctacaagttagcatagtcagtcaggctttgatcttcgtgactcgttcgcgtagtggtcttatgttgaacgccccgggactgctgttactgggtgctttcctcattgctcaactgattgctacattaatagcagtatatgccaactgggcctttgcaagaatccaaggaattggttggggttgggccggagtcatttggctctatagtatcatcttctatattcctcttgacatcatcaaattcgccactcgctatttcttgagtggcaaagcttggtcaaatctagaaaacaagactgccttcactaccaagaaagactatggtaaaggagagagagaagctcaatgggctcatgctcaaaggacacttcatggcctcgaaccaccagaaagttctggtatcttccatgagaagaacagttatagagaattgtccgagattgccgagcaggccaagagacgcgctgaagttgctaggcttcgtgaacttcatactcttaaaggacatgttgaatctgttgtgaagctcaaagggttggacattgacaccatacaacaacattacactgtgtacaaaggcaacacataaatgttgtagtagatatagttatggagccaagattcaatgacatactgaagagataaattaccattacctccccagagtaatctcttccagtgttttactttcttaatgtattttctagtaatcttttgatgctagagacaaagtagtttttagtttcaatcaaaccttatgcttctttatgctgttgagcccactaaaatttcattttgtggtgttcatttttattgtatgtcactttgaaagtggtggttattagacaatgagttaacctattgggaaacttggcggccggaattc

SEQ ID NO: 107784 - protein, 956 aa, Vicia faba
MAAISLEQIKNESVDLEKIPIEEVFAQLKCTREGLSSTEGESRIQIFGPNKLEEKKESKFLKFLGFMWNPLSWVMEAAAVMAIALANGGGQPPDWQDFVGIVCLLVINSTISFIEENNAGNAAAALMAGLAPKTKVLRDGKWSEQEAAILVPGDIISIKLGDIIPADARLLEGDPLKVDQAALTGESLPVTRHPGQEVFSGSTCKQGEIEAVVIATGVHTFFGKAAHLVDNTNNVGHFQMVLKSIGNFCICSIAVGMLAEIIVMYPIQHRKYRDGIDNLLVLLIGGIPIAMPTVLSVTMAIGSHKLSQQGAITKRMTAIEEMAGMDVLCSDKTGTLTLNKLSVDRNLIEVFIKGMDKEHVILLAARAARTENQDAIDAAIVGMLADPKEARAEITEVHFLPFNPNDKRTALTYIDNKDGTWHRASKGAPEQIIELCNMREDAQKKIHSMIEKFAERGLRSLGVARQEVPEKTKESAGAPWQFVGLLSVFDPPRHDSAETIRQALNLGVNVKMITGDQLAIAKETGRRLGMGTNMYPSATLLGLDKDSSVASMPVEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMFIALIWKFDFSPFMILIIAILNDGTIMTISKDRVKPSPLPDSWKLKEIFATGVMLGGYQALMTVIFFWIVQGTKFFPDRFGVRHIHDNPDELTAALYLQVSIVSQALIFVTRSRSGLMLNAPGLLLLGAFLIAQLIATLIAVYANWAFARIQGIGWGWAGVIWLYSIIFYIPLDIIKFATRYFLSGKAWSNLENKTAFTTKKDYGKGEREAQWAHAQRTLHGLEPPESSGIFHEKNSYRELSEIAEQAKRRAEVARLRELHTLKGHVESVVKLKGLDIDTIQQHYTVYKGNT

SEQ ID NO: 107785 - DNA, 3250 bp, Zostera marina
  CDS (148)..(3006)
gtttgtttgttatcaccaccaccggagtttcaaattgcgaacattaccaccggccaccggaggagacaaatacgaatggttgagcttcttctcggaagttgtgtttaactgttttctttacatcgactgagtagtgagtgagtaaaaatggcagggaagggtttggatgacatcaagaacgagactgttgatctggaaaagattcctatcgaagaagtgtttgagcagctgaaatgtactcgacaaggtctttccacgacggagggagagagtcggctcgccatcttcggcgcaaacaagttggaggaaaagaaggagaacaaaattctgaaatttctggggtttatgtggaacccgctctcatgggttatggaagctgctgcattgatggccatcgttctggccaacggagacggcaacccacctgattggcaggatttcctcggtatcgtcgtcttgcttgtcatcaactccaccatcagtttcatcgaagaaaataatgctggtaacgctgcggcggctctcatggccggtctagctcccaaaactaaggttctgagagacggatcatggagtgagcaggaagcgtcgatccttgttcctggcgatatcgtcagtatcaaactgggagatattgttccagcagatgctcgtcttcttgagggtgatcctttaaagattgatcaatctgctctcaccggtgagtcacttccggtgacccgtaatcccggatctgaggttttctccggatcaacctgcaaacaaggagaaatcgatgctgtggtcattgcaactggagttcacactttcttcggaaaggcagctcatctcgtggacagcaccaacaatgtgggtcacttccagaaagtccttacagccatcggaaacttctgtatagtttccattgctatcggtattgttatcgagatcatcgtgatgtggcctattcagagacgtaagtacagagacggaatcgacaatctccttgttctgttgatcggaggtatacccatcgccatgcccactgttctttccgtaaccatggccattggatcgcataaactggcggaacagggagccatcaccaagagaatgaccgccatcgaagagttggctggaatggacgtgctgtgcagcgacaagactggaactctcactcttaacaagttaagcgtcgacaagaatctcatcgaggtattcgccagaggagcagataaagaacttgttgttctactggcagcacgatcctcgagaactgaaaaccaagacgccattgacacggctatggtgggtatgcttgccgatcccaaggaagccagagctaacatccaagaagtccactttttaccattcaaccctgttgacaaacgaaccgctctcacctacatcgacgagaaaggcaactggcatcggtgcagcaaaggtgcgccggagcagatcatgactctgtgcaactgcaagcctgacatgaaagccaagattcactccgtcatcgacaaatacgcggaacgtggacttcgatctttgggtgtcgggcaacaggaggtcccggagaagaacaaggagagtccgggaggaccgtggcagttcgtaggtgtgttgcctcttttcgatccaccgagacatgacagtgcagagacgattcggagagctcttgatctaggagtgaatgtgaagatgattaccggagaccaactggcgattggaaaggaaactggacgtcggttggggatgggaaccaacatgtacccttcatcatcattgctcggcgaccacaaagacccagcagtgggtacgatagggatcgacgagttgatcgagaaagccgatggattcgccggagtgtttcccgaacacaagtacgaaatcgtgaagaggttacaagacaagaaacacatatgcggtatgactggtgacggagtgaatgatgctccggctttgaagaaagccgatatcggaatcgccgttgcagatgcaacagatgccgcgagaggtgcctcagatatcgtgttaacggaaccaggactcagcgtcatcatcagtgccgttctctccagtagatgcatcttccagaggatgaagaactacacaatatacgcggtgtccatcacaatccgtattgttcttgggttcatgctcattgctttgatatggaagttcgatttctcccccttcatggttctgattatcgccattctaaacgacgggacaatcatgaccatctccaaggatcgagtgaagccatcgcctttaccagatagttggaagctgaaagagattttcgcaactggagttgttttgggaagttacatggctgtgatgacggtggtgttcttctggatcatgaaagacacaagcttcttctcggataaatttggtgtgagatcaatcagtaacagtgaagatgagatgatgggtgccctctatctacaagtcagtatcatcagccaggctctgatcttcgtcacacgttcccggagctggagcttcatggaacgtcccggtcttctcctggtcactgctttcttcatcgctcaaatgtgcgcgactttcatcgcagtttatgcagactggggatttgcaagggtgaaaggagttggatggggatggggtggtattatctggctctacagtatggtcaccttctttccacttgacattctcaagttcatcacacgttatgttctcagcggaagaggttgggaaaacatcacggagaacaagactgcatttacttccaagaaagactacggaagagaggaaagagaggcacagtgggcaacagcacagagaactctccacggtctacaaaccgccgagagcaccaccaatattttccccgacaaaggtggttacagagaactctccgaaattgctgagcaagccaagaggcgagctgaagttgcaaggctgagggaactgaacactctgaagggacatgtggagtcggtggtgaagcttaaaggtcttgacattgaaaccatccagcagaactacaccgtttagaaagaaaacaactagctataataacacacctggatatgctggaacctcccccaaaggaaatgaggaatggaatgtccttataaacacttattactatcaacttcttcaaccctctttttttttaatttccccaaattttcttctttccctcgcaaattcgcaattgctgtgcaaacttaatctttcctttctgctattttattattatatattctggttgctccatggatgcaacactatctat

SEQ ID NO: 107786 - protein, 952 aa, Zostera marina
MAGKGLDDIKNETVDLEKIPIEEVFEQLKCTRQGLSTTEGESRLAIFGANKLEEKKENKILKFLGFMWNPLSWVMEAAALMAIVLANGDGNPPDWQDFLGIVVLLVINSTISFIEENNAGNAAAALMAGLAPKTKVLRDGSWSEQEASILVPGDIVSIKLGDIVPADARLLEGDPLKIDQSALTGESLPVTRNPGSEVFSGSTCKQGEIDAVVIATGVHTFFGKAAHLVDSTNNVGHFQKVLTAIGNFCIVSIAIGIVIEIIVMWPIQRRKYRDGIDNLLVLLIGGIPIAMPTVLSVTMAIGSHKLAEQGAITKRMTAIEELAGMDVLCSDKTGTLTLNKLSVDKNLIEVFARGADKELVVLLAARSSRTENQDAIDTAMVGMLADPKEARANIQEVHFLPFNPVDKRTALTYIDEKGNWHRCSKGAPEQIMTLCNCKPDMKAKIHSVIDKYAERGLRSLGVGQQEVPEKNKESPGGPWQFVGVLPLFDPPRHDSAETIRRALDLGVNVKMITGDQLAIGKETGRRLGMGTNMYPSSSLLGDHKDPAVGTIGIDELIEKADGFAGVFPEHKYEIVKRLQDKKHICGMTGDGVNDAPALKKADIGIAVADATDAARGASDIVLTEPGLSVIISAVLSSRCIFQRMKNYTIYAVSITIRIVLGFMLIALIWKFDFSPFMVLIIAILNDGTIMTISKDRVKPSPLPDSWKLKEIFATGVVLGSYMAVMTVVFFWIMKDTSFFSDKFGVRSISNSEDEMMGALYLQVSIISQALIFVTRSRSWSFMERPGLLLVTAFFIAQMCATFIAVYADWGFARVKGVGWGWGGIIWLYSMVTFFPLDILKFITRYVLSGRGWENITENKTAFTSKKDYGREEREAQWATAQRTLHGLQTAESTTNIFPDKGGYRELSEIAEQAKRRAEVARLRELNTLKGHVESVVKLKGLDIETIQQNYTV

SEQ ID NO: 107787 - DNA, 2703 bp, Burkholderia mallei ATCC 23344
  CDS (1)..(2703)
atgcgcatcgaatacgcatccgcgcaaccgctcgccgatacgctcgcgcatcttcgcacgagcgagtgcggcctcacgacgcccgacgcgaggcagcgcctgctcggcgacggcccgaacgaaatcgcgcacgacaagccgccgcactggagccggcagttgctcgcggcgctgaacaatccgttcgtctacgtgctgctcgtgctcgccgcgatcagtttgctcaccgacgtctatttcgccgacccgggcgatcgcgactacgtgaagatcacgatcctgctgtctatggtgacgatcagcgtgctgctgcgcttcgtgcaggaattccgctcgctgcgcgcggccgaaaagctcaaggcgatggtccgcacgacggcgaccgtgcagcgccgcgccgacgacgcgagcgcgccgatcaggcacgacgtgccgatgcgcgaagtcgtcgtcggcgatatcgtgcatctgtcggcgggcgacatgattcccgcggacgtgcggctgatctcgtcgcgcgacctcttcatcagccaggcggtgctcacgggcgaggcgctgcccgtcgagaagtacgacacgctcggcgccgtcgcgcaaaagtcggccgatccggcgagccgctccagcggcgccgccgtgcgcctcgagcgcgtggaacacggcggctcgctgctcgatctcgcgaacgtgtgcttcatgggcaccaacgtcgtgagcggcaccgccaccgcggtcgtcgtcgcgacgggcggcgatacgtacttcggcgcgctcgcgaagaacgtcgtcagccacaagcgcatcgagacgagcttcgatcgcggcgtctcgagcgtgagctggctgctgatccgcttcatgctcgtgatggtgcccgtcgtcttcatgatcaacggcctcacgaaaggcgactggctgagcgcgctcacgttcgcgctcgcggtggcggtcggcctcacgcccgagatgctgccgatgatcgtcagcgcgaacctcgcgcgcggcgcgatcgcgatggcgcggcgcaaggtggtcgtcaagcggctgaactcggtccagaacttcggcgcgatggacgtgctctgcaccgacaagacgggcacgctcacgcaggacaagatcatcctcgagcatcatctcgacgtgtcgggccgcaagaacgaggacgtgctgcggctcggctggctgaacagcttccatcagagcggccagaagaacctgatcgacatcgcgatcgtcgagcgcgcgaaccagctcggcgaatggatcaagccgcagggctaccgcaagatcgacgagctgccgttcgacttcgtgcgccggcgcctgtcggtcgtcgtcgaggatccgcgcggcacgcatctgctcgtctgcaagggcgcgctcgaggagatgctcgccgtctcgacgcacgttcaggatgacgaaggggtgcatccgctcgatttcgtcgcgcgcaagcggctgctcgcgcaggcgaatgcgtacaacgaagacggctttcgcgtgctgatcgtcgcgacgcgcacgatcgcgcgcggcgacgaacgcgagcagtaccgcacggccgacgagcgcgacctcgtcgtgcgcggcttcctcacgttcctcgatccgccgaaggaatcggccgcgcccgcgctcgccgggctgcgcgagaacggcgtcgccgtgaaggtgctcacgggcgacaacccgaccgtcacgctgaacgtctgccggcaggtcggccttgcgcccggcaagccgctgctcggcaccgaaatcgaggcgctccacgacgcggcgctcgagaaggccgtcgagcacacgacggtgttcgcgaagctcacgccgctgcagaaggcgcggatcgtcaaggcgctgcaggcgaacggccacacggtgggcttcctcggcgacgggatcaacgacgcgccggcgctgcgcgacgccgacgtcggcatctcggtcgacagcggcgcggacatcgcgaaggagacggccgacatcatcctgctcgagaagagcctgatggtgctcgaggaaggcgtgatcaagggccgcgagacgttcggcaacatcctcaagtacctgaacatgaccgcgagctcgaacttcggcaacgtgttctcggtgctcgtcgcgagcgcgttcctgccgtgggagccgatgctcgccgtgcagatgctcgtgctgaacctcatctacgacacgtcgcagatgctgctgccgtgggacaagatggacccggagttcctgaagaagccgcgcaagtgggaagcgaacaacatcggccgcttcatgctgtgggtggggccgacatcgtcggtgttcgacatcacgacctacgtgctgatgtggacggtgttcggcgcgggcgcgctctaccacgcgcagggcggcgcggccggccagctggtgatgaactccggctggttcgtcgagagcctcgtgtcgcagacgctcgtcgtccatctgctgcgcacgcagaagatcccgttcctgcagagcaccgcttcgctgcccgtgctgctgtcgacgacgatcgcgatcgcgatcggctgctggctgccgttctcgccgttctccgaagcgctcggcttcatccgcctgcccggcagctactggctgtggctcgccgcgacgatgatcggctacatcgcgctcgcgcagatcgtgaagacgctctacgtgcgccgctacaagcggtggttctga

SEQ ID NO: 107788 - protein, 900 aa, Burkholderia mallei ATCC 23344
MRIEYASAQPLADTLAHLRTSECGLTTPDARQRLLGDGPNEIAHDKPPHWSRQLLAALNNPFVYVLLVLAAISLLTDVYFADPGDRDYVKITILLSMVTISVLLRFVQEFRSLRAAEKLKAMVRTTATVQRRADDASAPIRHDVPMREVVVGDIVHLSAGDMIPADVRLISSRDLFISQAVLTGEALPVEKYDTLGAVAQKSADPASRSSGAAVRLERVEHGGSLLDLANVCFMGTNVVSGTATAVVVATGGDTYFGALAKNVVSHKRIETSFDRGVSSVSWLLIRFMLVMVPVVFMINGLTKGDWLSALTFALAVAVGLTPEMLPMIVSANLARGAIAMARRKVVVKRLNSVQNFGAMDVLCTDKTGTLTQDKIILEHHLDVSGRKNEDVLRLGWLNSFHQSGQKNLIDIAIVERANQLGEWIKPQGYRKIDELPFDFVRRRLSVVVEDPRGTHLLVCKGALEEMLAVSTHVQDDEGVHPLDFVARKRLLAQANAYNEDGFRVLIVATRTIARGDEREQYRTADERDLVVRGFLTFLDPPKESAAPALAGLRENGVAVKVLTGDNPTVTLNVCRQVGLAPGKPLLGTEIEALHDAALEKAVEHTTVFAKLTPLQKARIVKALQANGHTVGFLGDGINDAPALRDADVGISVDSGADIAKETADIILLEKSLMVLEEGVIKGRETFGNILKYLNMTASSNFGNVFSVLVASAFLPWEPMLAVQMLVLNLIYDTSQMLLPWDKMDPEFLKKPRKWEANNIGRFMLWVGPTSSVFDITTYVLMWTVFGAGALYHAQGGAAGQLVMNSGWFVESLVSQTLVVHLLRTQKIPFLQSTASLPVLLSTTIAIAIGCWLPFSPFSEALGFIRLPGSYWLWLAATMIGYIALAQIVKTLYVRRYKRWF

SEQ ID NO: 107789 - DNA, 2667 bp, Bacillus cereus ZK
  CDS (1)..(2667)
atgagcaattggtacagtaagacgaaagaccaaacattaatcgacttagaaacaaatgaacaacacggtttaacagaggaaattgtaaatgaacgtttaacgcaatacggtgctaatgaattagctacaaaacaaaaacgctctttatggcagcgtattttcgcccaaattaatgacgtcctcgtatatgtccttattattgctgcccttatttcagcttttgtaggtgaatgggctgatgcaagtattattgcgctcgttgtagttttaaatgctgttatcggtgtcgtccaagaatcgaaagcagaacaagctttagaggcattgaaaaagatggcgacacctaaagctatcgtcaagcgagatggtgaactaaaagaaattccatctgagcacgtcgttccaggtgatatcgttatgctcgacgccggacgatatatcccatgcgatttacgccttatcgaaaccgcaaatttaaaagttgaagaatctgctctaactggtgaatctgtccctgttgataaagatgcaatctaccacccttccatgcaaagtgatgaacaagtaccactcggtgatcaaaaaaacatggcctttatgtctacccttgtaacatacggaagaggcgttggtattgctgttgaaactggaatgaactcacaaattggtaagattgctaccctgttacatgaagcagacgatgatatgacaccactccaaaaaagcttagctcaagtcggaaagtatttaggctttgtcgctgtagctatttgtatcgtgatgtttctcatcggctttttacaaggacgagatacactagaaatgtttatgactgctattagtttagccgttgcagctattccagaaggtttgccagctatcgtttccatcgttcttgcaattggtgtgcagcgtatgattaaacaaaatgttatcattcggaaactaccagctgtcgaagctctcggttctgtcacaattatttgttcagataaaacaggtacgttaacacaaaataaaatgaccgttactcacttttatagtgataacacatacgatcacttagaaagtttaaatgtaaataatgatgcacaacgtctattgttagaaaatatggtgctatgtaatgatgcgtcttacaacaatcaatcacaaacaggggacccgactgaaattgctcttctcgttgccggaagcacttttaacatacaaaaagatcatttagaaaaaatacatgaacgtgttaatgagctacctttcgattcagatcgtaaaatgatgtcaaccgtgcatacatacgataaaagctactatagcatgacgaaaggtgctatcgataaactcttacctctatgtacccacatatttaaaaacggtaaaatcgagagtctaacagaggatgataaaaatcaaatattagaagctgctggggcaatgtctcaagaagctttaagagtactttcattcgcatttaaacaatacaattcaaacgatgtggatatagatcatcttgaagaaaacctcatctttattggtcttgtcggtatgattgatccaccgcgaactgaagtaaaagactcaatttcagaatgtaaaaaagctggtattcgtacagttatgattactggtgaccataaagatactgcctttgcaattgccaaagaacttggcattgctgaagacatatctgaaattatgattggaactgaattagataacatttcagatacagaactagcaagcaaaattgatcacttacatgtattcgctagagtctctccagaacataaagtaaagatcgtaaaagcattacgtgcaaaaggcaatatcgtttctatgactggtgatggcgtcaatgacgctccatctttaaaacaagcagatgttggcgtagcgatgggcattacaggaacagacgttgcaaaaggggcagcggatgtcgtattaacagatgataatttctcatctatcgtgaaggctgttgaggaaggtagaaacatttatcgtaacataaaaaaatcaattctcttcctactctcttgtaacttcggagaaattatcactttatttttagccattttactcggttgggcaacaccactacgacctattcacattttgtgggtaaatttaattacagatacgctgcctgcattatcacttggggttgatcctgaagatcctgatgtgatgaaggaaaaaccacgacatgcgaaagaaagcttatttagcggtagcgttccttttcttattttcaatggggttgtcattggacttttaacgctaatagcctttatcgccggagcaaagttctatactggagatacaaatttattccctcttttcccagagcgaattgatgaggatgctctattacacgctcaaacgatggcatttgtcgttcttagtttttctcagctcgttcattcatttaacttgcgttcaagaacgaaatcgatcttttcaattgggatctttacaaataaatatttagtcttctcccttcttatcggtgttcttatgcaagtttgcatcatctccatcccgccccttgcaaatatattcggtgtgcatgcattaacgatgcgagattggggatttgttctcttattaagtatcattccgcttgttgtgaatgaaatcattaaattagtgaagaaaaactaa

SEQ ID NO: 107790 - protein, 888 aa, Bacillus cereus ZK
MSNWYSKTKDQTLIDLETNEQHGLTEEIVNERLTQYGANELATKQKRSLWQRIFAQINDVLVYVLIIAALISAFVGEWADASIIALVVVLNAVIGVVQESKAEQALEALKKMATPKAIVKRDGELKEIPSEHVVPGDIVMLDAGRYIPCDLRLIETANLKVEESALTGESVPVDKDAIYHPSMQSDEQVPLGDQKNMAFMSTLVTYGRGVGIAVETGMNSQIGKIATLLHEADDDMTPLQKSLAQVGKYLGFVAVAICIVMFLIGFLQGRDTLEMFMTAISLAVAAIPEGLPAIVSIVLAIGVQRMIKQNVIIRKLPAVEALGSVTIICSDKTGTLTQNKMTVTHFYSDNTYDHLESLNVNNDAQRLLLENMVLCNDASYNNQSQTGDPTEIALLVAGSTFNIQKDHLEKIHERVNELPFDSDRKMMSTVHTYDKSYYSMTKGAIDKLLPLCTHIFKNGKIESLTEDDKNQILEAAGAMSQEALRVLSFAFKQYNSNDVDIDHLEENLIFIGLVGMIDPPRTEVKDSISECKKAGIRTVMITGDHKDTAFAIAKELGIAEDISEIMIGTELDNISDTELASKIDHLHVFARVSPEHKVKIVKALRAKGNIVSMTGDGVNDAPSLKQADVGVAMGITGTDVAKGAADVVLTDDNFSSIVKAVEEGRNIYRNIKKSILFLLSCNFGEIITLFLAILLGWATPLRPIHILWVNLITDTLPALSLGVDPEDPDVMKEKPRHAKESLFSGSVPFLIFNGVVIGLLTLIAFIAGAKFYTGDTNLFPLFPERIDEDALLHAQTMAFVVLSFSQLVHSFNLRSRTKSIFSIGIFTNKYLVFSLLIGVLMQVCIISIPPLANIFGVHALTMRDWGFVLLLSIIPLVVNEIIKLVKKN

SEQ ID NO: 107791 - DNA, 2514 bp, Burkholderia pseudomallei K96243
  CDS (1)..(2514)
atgagcgctcgacaggccgcgcggcatcggcgagacggcgcgcccggcgccgcgacgcctgccgatgacgcgtggcgccgcacgccggcgagcggcctgtcgagcgcgcgggcggacgagttgcgcctgcgcttcggcccgaacgcgatcgacacgggcgggcggcgcggcacatggcgcacgtcgctcgacgtgctgcgcgagccgatgctgctcctgctgctcggcgcgggtgccgtctatctggcgctcggcgaattgcccgacgcgctgacgctgctcgcgttcgtcgccgcgatcgccgcgctcacgatcgtgcagagccagcgcaccgccggcgtgctcgccgcgctgcgcgcgctgtccgcgccgcgcgccgacgtgatgcgcggcggcgaacgccggctcgtgtcggccgccgagctggtgccgggcgatctggtgtggatcgccgaaggcgcgcgcgtgccggccgacggctggctcgtcgacgcgcacgagctgagcgtcgacgaatcgctgctcacgggcgaatccgcgcccgtcgacaaggccgccgagcggcccgacgcgccgacgcccgacgaagccgcgtgccgcgtccatttcggctcgatggtcgtgcgcgggcagggacggatgatcgtcaccgacaccgggccgcgcactgcgctcggccggatcggcaagtcgctgacggacatcgcggagacgccgtcgccgctgcagcgcgacgcgcgcacgctcgcgaaccggatcgcgctcgtcgcgctcgcgctgtgcgcggcgctcgtcatcgcctatcgctggcgctcgggcgaatggctgccgggcgtgctcgcggggatcacgctcgcgatgggcatctttcccgaggagattccggtcgtgatgaccgtgttcatggcgctcggcgcgcgccgcatcgccgacgagggcatgctcgcgcgccgcatgagcgcgatcgaggcgctcgggcagacctcggtgctgtgcgtcgacaagacgggcacgctcacgcagaaccggatgacggtgcgcgcgctgttcgcgaacggccgccgctggacgctcgacgacgatcgggccgacatcgacgcgtcgtttcacgagctgctcgaatacctggtgctcgcgagcgagatcgagcccgtcgatccgatggagcgcgcgttccggcgcgcgggcagccgctgcctcgcgggcaccgggcacctgcacgacgactggtcgctcgtgcaggaatacgcgctgacgcccgagctgccggcgatgtcgcacgtgtggcgcgcgccgcggctcgaccattgcccggttgcgtgcaagggcgcgcccgaggcgattttctcgctgtgccatctcgatgacgcggcggcgcgcgcgctgctcgacgaggccgagcgcatggctgcgcgcgggctgcgcgtgctcggcgtcgcgcgcgccgcgcatgcgcgaggcgaatggcccgcgcggcagcacgatttcgatttccggttcgtcgggctcgtcggcctgatcgacccggtacgcgccgaggtggccgaggcgatcgcgacctgccgcgcggccggcatccgcgtcgtgatgatcacgggcgactatccgtcgaccgcgcgcgcggtcgcgggcgaggtcggcatcggcgcggccgcggtcgtcacgggcgacgaaatcgcggcgatgagcgacgcggcgctcgatgccgcgctcgcgcgcgccgacgtgttcgcgcgcgtgcggccggagcagaagctgcgcctcgtcgccgcgctcgagcgcggcgggcgcatcgtcgcgatgacgggcgacggcgtgaacgacgcgcccgcgctgaaggccgcgcacgtcggcatcgcgatggggcggcacggcgccgaagtcgcgcgcgaggtcgccgcgctcgtgctgctgcgcgacgatttcacgccgatcgtgtcggcgatccgccaggggcggcgcatccacgcgaatctgatgcaggcgctcggctacacggtggccgtccatctgccgatgatcgccgcggtgatggtgcccgcgctcgccggctggcccgcgatgctcgcgccgctgcacatcgtgtcgctgcagctcgtgatcgatccggcgtgctcgctcgtgttcgagaacgagcctgcgcgcgccgatgcgatgcgcgtgccgccgcgcccgccgcacgcgcggctgtgggcgtcgccgctgatcgcacggggcgcggcggccggcgcgctcgcggcggccggcgtggtcggcctgtacgcgctgctgctcgcgcgcggcggcggcccggcgttcgcgcgcaccgccgcgttcgtcgcgctcgtctcggcgaacgtcgcgctgatcttcgtcgtccgcgcgctcgcgggcggcgcgcgcgcgagcgggccgttcgcgggcaaccggtatctgtggatcgtgcccgcgtgcgccgcgagcgcgctgctcgcgctgctgtcgattccgccgctcgcgtcgctgttcgggctcgtgccgctgctcgcgcgctga

SEQ ID NO: 107792 - protein, 837 aa, Burkholderia pseudomallei K96243
MSARQAARHRRDGAPGAATPADDAWRRTPASGLSSARADELRLRFGPNAIDTGGRRGTWRTSLDVLREPMLLLLLGAGAVYLALGELPDALTLLAFVAAIAALTIVQSQRTAGVLAALRALSAPRADVMRGGERRLVSAAELVPGDLVWIAEGARVPADGWLVDAHELSVDESLLTGESAPVDKAAERPDAPTPDEAACRVHFGSMVVRGQGRMIVTDTGPRTALGRIGKSLTDIAETPSPLQRDARTLANRIALVALALCAALVIAYRWRSGEWLPGVLAGITLAMGIFPEEIPVVMTVFMALGARRIADEGMLARRMSAIEALGQTSVLCVDKTGTLTQNRMTVRALFANGRRWTLDDDRADIDASFHELLEYLVLASEIEPVDPMERAFRRAGSRCLAGTGHLHDDWSLVQEYALTPELPAMSHVWRAPRLDHCPVACKGAPEAIFSLCHLDDAAARALLDEAERMAARGLRVLGVARAAHARGEWPARQHDFDFRFVGLVGLIDPVRAEVAEAIATCRAAGIRVVMITGDYPSTARAVAGEVGIGAAAVVTGDEIAAMSDAALDAALARADVFARVRPEQKLRLVAALERGGRIVAMTGDGVNDAPALKAAHVGIAMGRHGAEVAREVAALVLLRDDFTPIVSAIRQGRRIHANLMQALGYTVAVHLPMIAAVMVPALAGWPAMLAPLHIVSLQLVIDPACSLVFENEPARADAMRVPPRPPHARLWASPLIARGAAAGALAAAGVVGLYALLLARGGGPAFARTAAFVALVSANVALIFVVRALAGGARASGPFAGNRYLWIVPACAASALLALLSIPPLASLFGLVPLLAR

SEQ ID NO: 107793 - DNA, 2652 bp, Bacteroides fragilis
  CDS (1)..(2652)
atgatttggagaaagaaagaaaaaaagaaagcgcagtatcaatttaattccgaacgggtattcctggttgccacccaacctgctaagactgcatattcttatttccagacttcgagtgtgggactgagtgaagaagagatcgggcaacgacaatccgcctatggtaaaaatgaaatctcacgagagcaaaagaagaatccactcgtacttttcatccgtacgttcatcaatccgtttatcggtgtgttgacggcgctggctgtcatctctctggtcatcgatgtagtaatggcccgtcctgaagaccgtgagtggacggctgttctgattattatctcgatggtagtttgcagtgccattctccgcttctggcaggagtggaaagcaagtgaagctactgactcattgatgaagatggtcaaaaatacctgtttcgtaaagcggttttcgggaagtgaggaggttgatattacggaattggtaccgggtgatgttgtttgccttgctgccggtgacatgattccggcagacatccgcatcattgaatcgaaggatctgtttgtcagccaggcatcacttaccggtgagtccgatccagtagagaaatttcctgaaataaacggtaggagacacagtcacggaagcgtcatcgagcttgacaatatctgctacatgggttccactgttatcagcggatctgccaaaggaatcgtttttgggacgggtaacgatacctatctcggaacgatagcccgaagtttagtgggtgaacgtgcgactaccgctttcgacaagggaatcagtaaggtcagtttcttactgatacgctttatgctggtgatggttccattcgtcttctttgtcaacggtttcacaaaaggcgattggttcgaggcattcatatttgccttatcggtggctgtgggattgactcctgagatgcttccgatgatagtcacagcaaacctctcgaaaggtgctgtatcaatgtcgaagaaaaaaacggtcgtgaagaatctcaatgccatccagaacttcggggccatgaacattctttgtaccgacaagaccggtacgctgacctgcgataaaatcgtattggagaagtatatcaatgcggacggcagcgatgatcattcccgaaggatattgcgccacgcattccttaacagttactttcagacaggtctcaagaacctgatggacaaagctatccttgcccacgtacgcgaagaaaatctggaacatctgacggaaggttacacgaagatagatgagataccgtttgatttcagtcgacgtcggatgtcggtagttattgaagatcagcagggaaaaaggcaaatcatcacgaagggagctgtggaggagatgctgaatatttgctctcatgccgagttcaacggtcaggtatatgaattgaccgataaactcagaagtaaggcaaagagaatcagtgatgatatgaatcgtaacgggatgcgggtacttgccatcgcacaaaaaagctttatcaacaaggcacgggactttgccgtcaccgacgaggacgagatggtacttattggttacctggcgtttcttgatccccccaagccctcttctgccgaggctatccgccaattgcgcgaatatggtatcgaggttaagatactttccggtgataatgatgtaatcgtgaacgccattgcccggcagataggcattgatacgtgccattcggtaacaggggttgagcttgaaggcaaggacagggaagaattacgtgaaatagtgggacaagccactctcttttccaggctgacgcctttgcagaagagcgagataatcatgattcttcagcaaaatggcaacacggtaggatttttgggtgacggggtgaatgatgccggagcattgaggcagtcggacattggtatttccgtagattctgccgtggacattgcgaaggagagtgccgatatcattcttttggacaaagatttgagtgtgctcaaagagggtgtcttggaagggcgtaagacctttggcaatatcaccaaatacataaagatgaccgccagttccaatttcggcaatatgttcagtgtgatgttcgccagtgcatttctgccgtttctgcccatgttgccgatacatctgctcattcagaaccttttgtatgatatctcgcaaactaccattccgtttgaccggatggatgccgagtttctgaagcaaccccagaagtgggacgcatccgatctgagtcggtttatgatttacatcgggccgataagttccgttttcgatattgccacctattgtttgatgtggtacgtgtttgcctgtaattcacctgagcaccagactctctttcagtccggttggtttgtcgagggattattgtcacagacattgatcgtacatatgatcaggactcgtaagataccgttttttcagagtcgtgccacctggccggtgctggggttgaccttcctgatcatggcaatgggcatagctattcctttcacatcgtttggcctgtcgataggacttgaaccgttaccgttgagttacttcccctggctggtgcttatcttggtatcctactgtgttcttacacaatttatgaagagctggtatattcgaagattttcgaaatggttataa

SEQ ID NO: 107794 - protein, 883 aa, Bacteroides fragilis
MIWRKKEKKKAQYQFNSERVFLVATQPAKTAYSYFQTSSVGLSEEEIGQRQSAYGKNEISREQKKNPLVLFIRTFINPFIGVLTALAVISLVIDVVMARPEDREWTAVLIIISMVVCSAILRFWQEWKASEATDSLMKMVKNTCFVKRFSGSEEVDITELVPGDVVCLAAGDMIPADIRIIESKDLFVSQASLTGESDPVEKFPEINGRRHSHGSVIELDNICYMGSTVISGSAKGIVFGTGNDTYLGTIARSLVGERATTAFDKGISKVSFLLIRFMLVMVPFVFFVNGFTKGDWFEAFIFALSVAVGLTPEMLPMIVTANLSKGAVSMSKKKTVVKNLNAIQNFGAMNILCTDKTGTLTCDKIVLEKYINADGSDDHSRRILRHAFLNSYFQTGLKNLMDKAILAHVREENLEHLTEGYTKIDEIPFDFSRRRMSVVIEDQQGKRQIITKGAVEEMLNICSHAEFNGQVYELTDKLRSKAKRISDDMNRNGMRVLAIAQKSFINKARDFAVTDEDEMVLIGYLAFLDPPKPSSAEAIRQLREYGIEVKILSGDNDVIVNAIARQIGIDTCHSVTGVELEGKDREELREIVGQATLFSRLTPLQKSEIIMILQQNGNTVGFLGDGVNDAGALRQSDIGISVDSAVDIAKESADIILLDKDLSVLKEGVLEGRKTFGNITKYIKMTASSNFGNMFSVMFASAFLPFLPMLPIHLLIQNLLYDISQTTIPFDRMDAEFLKQPQKWDASDLSRFMIYIGPISSVFDIATYCLMWYVFACNSPEHQTLFQSGWFVEGLLSQTLIVHMIRTRKIPFFQSRATWPVLGLTFLIMAMGIAIPFTSFGLSIGLEPLPLSYFPWLVLILVSYCVLTQFMKSWYIRRFSKWL

SEQ ID NO: 107795 - DNA, 2673 bp, Bacillus licheniformis DSM 13
  CDS (1)..(2673)
atgaaatggcacgagatgggacaaaccgaattgttaaatataacaaaaacgtccatcgacaaaggtctaacagaaaaagaggccggaaagcggctggaaagacacggaacaaacgaacttcaggaaggggaaaaaacatcggcggtcgcattgtttttttctcaattcaaagatttcatggttcttgttttgcttgcggccacgttgatttcgggtttcctcggcgaatacattgacgccatcgcgatcatcgcgatcatctttgttaacggcattctcggattctttcaggagaggcgggcggaaaggtcgctcgaggctttgaaagaactgtcagctcctcaagtggctgtgctccgggaggggaattgggtgaaaattccttccaaagagcttgtcccgggagatgttgtccgttttgcaagcggagacagaatcggcgccgatctcagacttgtcgagacaaagagccttgaaatagaagaatcggcccttacaggtgaatcgctccccgtgtccaaacaggcagatgcttttcaggcgtcagatgtatcgctgggcgatctgaagaatatggctttcatgggaacgcttgtcacaagggggagcggaatcggcgtcgtcatcggtacgggtatgaactctgcgatggggaaaatcgccgatatgcttgaatctgccgggaatacggcgaccccgctgcaaagaaggcttgaagagctcggcaaaattttgattgtcgccgctttgttcctgacactgcttgtcgttgctgccggcgtcattcaggggcatgatttatacagcatgtttttagcgggagtttcccttgccgtcgctgccatacctgaagggctgcctgccattgtcacggtcgctctgtctctcggcgtgcagcggatgatcaggcaaaagtcgatcgtcaggaagctgcccgcggttgagacgctcggctgcgcgtccattatttgctccgataaaaccgggacgatgacgcagaacaaaatgacggtcacccatgtctggtcaggcgggaagatatggaacgtgtcagggatcggctatgagcctgaaggctctttcagcatgaacgggcgcgatgtgcaagcaaagcatcataaaccgctccagcaggtactattgttcggcgcattatgcaattcatcttcgattatcgaaaaagacggggagtttcgtcttgatggcgatcccaccgaaggggctttgctgacggcggctcgaaaagcaggctttacggacaaatatgttgatgaacattttaaaatcatcgaggagtttccgtttgattcaacgcggaaaatgatgtctgtcattgtggaagacaagagcggcaagcgctttgtcattacaaagggcgcgccggatgtattgatgaagcgttcgtcgcatacgctgacagaagaaaagcgagaaatcttcacaaaggaaaggctcgctgaaacaagcgcggcgctggaaactcttgcgtcacaggcgctgagaacgattgccgtcgcgtataaaccgatcaaagatacagaaaatcccccgctcgaaaaagcggagtcaggcttaactttcatcgggctgttagggatgatcgatccgccgcggcccgaagtgaaaacagcgattaaagaatgccgggaagcggggatcaaaacggtcatgatcaccggggaccatgtgataacggcgacggcgattgcaaaagatctcggattgctgcctccgcgcggaaaggtcatggacggccagatgctgaacgaactctcgcaggaagaattggcggaaattgttgacgatgtttacgtatttgcaagggtgtcgcccgaacataagctgaagatcgtgaccgcctaccaggaaaacggccacatcgtcgccatgacgggagacggagtcaatgatgcccctgcgattaaacaggcggatatcggcatatcgatggggattacgggaacggatgtcgccaaggaggcgtcctcactcatccttgtcgatgataattttgcaacgattaaatcggccatcaaggaaggacgcaatatctatgaaaatattagaaagttcatcagatacttgctcgcatccaatgtcggcgaaattttggtcatgctgtttgcaatgctgctcgctctgccgctgccgcttgtcccgatacagattctgtgggtcaaccttgtaacggacggcctgcctgccatggcgctcggcatggatcagcctgaggacgatgtgatgcagagaaagccgcggagtccgaaagaaggcgtgtttgcaagggggctcggctggaaggtcgtatcgcgcggattcttaatcggaatcgcgacactcggggcgtttatgttcatttataaccgcaatccagaagcgcttgagtatgcacagacggttgcatttgcaacgctcgtccttgcgcagctgatccacgtgttcgactgccgaagcgagcggtccatctttgaccgcaatccgtttgaaaacatttatttgctcggtgcagtgctgtcttcgattcttttgatgcttgtcgttatttattatccgccgctgcagccgatttttcatacggttccgattttaatggcagactggctcctgattgtcggaatgtcggcgattccaacttttttactggccgggtcacttttgacaagaaaaaaatag

SEQ ID NO: 107796 - protein, 890 aa, Bacillus licheniformis DSM 13
MKWHEMGQTELLNITKTSIDKGLTEKEAGKRLERHGTNELQEGEKTSAVALFFSQFKDFMVLVLLAATLISGFLGEYIDAIAIIAIIFVNGILGFFQERRAERSLEALKELSAPQVAVLREGNWVKIPSKELVPGDVVRFASGDRIGADLRLVETKSLEIEESALTGESLPVSKQADAFQASDVSLGDLKNMAFMGTLVTRGSGIGVVIGTGMNSAMGKIADMLESAGNTATPLQRRLEELGKILIVAALFLTLLVVAAGVIQGHDLYSMFLAGVSLAVAAIPEGLPAIVTVALSLGVQRMIRQKSIVRKLPAVETLGCASIICSDKTGTMTQNKMTVTHVWSGGKIWNVSGIGYEPEGSFSMNGRDVQAKHHKPLQQVLLFGALCNSSSIIEKDGEFRLDGDPTEGALLTAARKAGFTDKYVDEHFKIIEEFPFDSTRKMMSVIVEDKSGKRFVITKGAPDVLMKRSSHTLTEEKREIFTKERLAETSAALETLASQALRTIAVAYKPIKDTENPPLEKAESGLTFIGLLGMIDPPRPEVKTAIKECREAGIKTVMITGDHVITATAIAKDLGLLPPRGKVMDGQMLNELSQEELAEIVDDVYVFARVSPEHKLKIVTAYQENGHIVAMTGDGVNDAPAIKQADIGISMGITGTDVAKEASSLILVDDNFATIKSAIKEGRNIYENIRKFIRYLLASNVGEILVMLFAMLLALPLPLVPIQILWVNLVTDGLPAMALGMDQPEDDVMQRKPRSPKEGVFARGLGWKVVSRGFLIGIATLGAFMFIYNRNPEALEYAQTVAFATLVLAQLIHVFDCRSERSIFDRNPFENIYLLGAVLSSILLMLVVIYYPPLQPIFHTVPILMADWLLIVGMSAIPTFLLAGSLLTRKK

SEQ ID NO: 107797 - DNA, 2727 bp, Yersinia pseudotuberculosis IP 32953
  CDS (1)..(2727)
atgcaaaactcatcaaaccctaaaagtgcctccccccctccagagggtaaggcttggtatcaacttactgtggaagaatctttgcagcatctaaatagccgcgaagaaggattaagccaaaaagaggcacaagagcgcctggcgcaatatggtcccaatgcactacctgccagaaaaacaaaacaccctctactgcaattcctggcacattttaacgatgtcctgatttatattctgttggccgcagcgttagtaaaaggtttgatggggcactcagttgataccattattatcctttgtgtcgcggtgattaacgcgctaattggctttattcaggaaaataaagctgaaaaatcattgaaaagcatccaaaacatgctttccagcaaagccgtggttattcgggatggcaaggcacaaactattgatgcgcagaatctggtgccaggagatatcgtcaccttgcgcccaggggataagatccccgcagacctgcgtttactggaagcccataatctccagattgaagaagctattctgaccggtgagtctaccgtggttgaaaagcagatcggcgtcattgagaacgaatccgtcatcggtgatcgcaagaacctcctcttctcgggcaccaccatcagtgccggtacggccaaaggcgtcgtcatcgcgagcggtggagataccgagctgggtcatatcaatcagatgatggcgaccgtggagtcgacccgcacccctctgttacaacaaatggatcgtctgggaaaagccattttcatcctgattttggtgatgatggcgatattgttcgttttcgcctttatcttacgtgacctaccagtcgatgagttgctactggccttaatcagcttggctgtcgcctcggtaccggaaggtttaccggcgatcatttcgattattctgtctctgggtgtgcaagcgatggcgcgcaaccgcgcgattatccgcaagttgccaacggtagaaaccttgggtgccatgaccgtcgtctgctccgataaaaccggtacgctgacgatgaacgaaatgacggttaaagccgtgattctggcggatcattgctaccgcgtggaaggtgaaagctatgaaccggtaggtaatatctatccagaaggtcgcgagcagcaagcggagttggacaccaataaggcgctgaaaacatttattactgcggtcaatctatgtaatgacagccagattcagcaaaacgaacaaggccattggaccattactggtgggccaaccgaaggggcgttgaaagtactggcggcaaaatctgggatcaagctggaccacgttacccaacacggcaaaattcctttcgattctgcctataaatacatggctaccagccatcaggttcagtcagataacagtatcttcctaaccggtgcgcctgatgtcttgttcaccttctgccaacaagaactgaccgacagcggtgttgcgccgttccgccgtgattattgggaagcggaaatggcgcgctatgccaaacaaggcttgcgtatggtggcagcggccttccgcccaacggatcaaccggtcaacgaactcgatcacaaagatattcaacaaggcatggtgtttgttggtatcgccggcatgatggacccaccacgccctgaagctatcgatgcgattgctacctgccaacaggccggtattcgggtgaaaatgatcactggcgaccatcaggaaacggcgatggcgatcggggccatgttagggattggcaacggtacagattccataacaggcagccaactggaacatatggatgaccaacaactggcagaagccgctgttcgttatgatatttttgcccgcaccagcccggaacataaactgcgtctggtaaaagccttgcaggagaagggtgaaatcgtgggtatgaccggcgatggggttaacgatgctccggcgctgaaacaggccgatgtcggcattgctatgggtatcaaaggcaccgaggtgacgaaagaagccgccgacatggtgttatccgatgataacttcgccaccattgccagtgccgttgaagaaggccgccgggtttacgataacctgaaaaaaaccattctgtttgttttgccaactaacctggcgcaaggtttattaatcatctttgctatccttgcgggtgcggtgatcccattaacaccactacaaatcctgtggatgaacatggcaacctccaccaccctctcctttggtctggcatttgaacccgcggaaaaaggcattatgcgccgtaagccacgtgacccatcccgccatgtattggatggtcatgccatttggcggattggttttgtcgggaccttgattgcttgtagtgctttcgccctggaagcctatttagaaccccgtggttacagtaccgaatttatccgtaccgttctcatgcaaacactggtgaccgctcagtggatctacatgtttaactgccgtgtgatggatcgtttcccactgaataaagaagtattcgttaacaaaggtctgtggttagtctctggcgtactggtgctgttgcagctagctatcatctacctgccatttatgaatactgcctttggtaccgcgccattacccgcctattactgggggataaccttactggttgctattgccatctttattattgttgaaatagaaaaatgggttatcgggcgctttaaaggcatgaataaccccgtttaa

SEQ ID NO: 107798 - protein, 908 aa, Yersinia pseudotuberculosis IP 32953
MQNSSNPKSASPPPEGKAWYQLTVEESLQHLNSREEGLSQKEAQERLAQYGPNALPARKTKHPLLQFLAHFNDVLIYILLAAALVKGLMGHSVDTIIILCVAVINALIGFIQENKAEKSLKSIQNMLSSKAVVIRDGKAQTIDAQNLVPGDIVTLRPGDKIPADLRLLEAHNLQIEEAILTGESTVVEKQIGVIENESVIGDRKNLLFSGTTISAGTAKGVVIASGGDTELGHINQMMATVESTRTPLLQQMDRLGKAIFILILVMMAILFVFAFILRDLPVDELLLALISLAVASVPEGLPAIISIILSLGVQAMARNRAIIRKLPTVETLGAMTVVCSDKTGTLTMNEMTVKAVILADHCYRVEGESYEPVGNIYPEGREQQAELDTNKALKTFITAVNLCNDSQIQQNEQGHWTITGGPTEGALKVLAAKSGIKLDHVTQHGKIPFDSAYKYMATSHQVQSDNSIFLTGAPDVLFTFCQQELTDSGVAPFRRDYWEAEMARYAKQGLRMVAAAFRPTDQPVNELDHKDIQQGMVFVGIAGMMDPPRPEAIDAIATCQQAGIRVKMITGDHQETAMAIGAMLGIGNGTDSITGSQLEHMDDQQLAEAAVRYDIFARTSPEHKLRLVKALQEKGEIVGMTGDGVNDAPALKQADVGIAMGIKGTEVTKEAADMVLSDDNFATIASAVEEGRRVYDNLKKTILFVLPTNLAQGLLIIFAILAGAVIPLTPLQILWMNMATSTTLSFGLAFEPAEKGIMRRKPRDPSRHVLDGHAIWRIGFVGTLIACSAFALEAYLEPRGYSTEFIRTVLMQTLVTAQWIYMFNCRVMDRFPLNKEVFVNKGLWLVSGVLVLLQLAIIYLPFMNTAFGTAPLPAYYWGITLLVAIAIFIIVEIEKWVIGRFKGMNNPV

SEQ ID NO: 107799 - DNA, 2658 bp, Symbiobacterium thermophilum
  CDS (1)..(2658)
atggaacgaacggactggcacacgctgacgcccgctgaagtcaccgagcggctgcaggtcgaccccgggccggggctcacggccgcggaggccgcgcagcggctggcccggcacggcccgaaccggctggccgaagagaagcggcgcagcatgctggcggcattcatcgatcagttccgggaccccctggtgctcatcctgctggcggccgcgctcctggcgctggtcctcagggagttcctggacggcggagcgatcctcgccatcgtcatcctgaacgccgtgctcgggctggtccaggagttcaaggccgaccaggccctgcaggccctgaaggagctcagcgcaccccactgcaaggtgaggcgggacggccgggtgatcgagatcgacacccgcgagctggtgccgggcgacatcgtggtgctggaggccggcgatcccgtgcccgccgacctgcgcctgctccggtccgccatgctgcagatcgacgagtcgctgctgaccggcgagtccgtgccggtggagaaggacgcggacaagaccctggaagccggcgccccgctggccgaccgggtgaacatggcgttcatgtccacggccgtcacctacggccacggcgagggggtggtcgtcggcacgggcatgcgcaccgaggtgggccgcatcgccgacaggctgcaggaagagccccaggaggcgacgccgctgcagaagcggctctcccacttcgcccgggtgctcggcggggccatgctggtgctggtcatcctgctcggcgccgtgggcctgtggcggggcatgccctggctggaggtgctgatggtcgccgtctcgctggcggtggcgacgattcccgaggggctgccggcggtcaccaccatcgtgctcgcgctggggatgcagcgcatggcccggcgcaacgcggtcatccgccggctgtccgccgtggagaccctgggctccgccacgttcatctgctccgacaagaccggcaccctcacgcagaacaagatgaccgtcacccggctctggctgccggaggagtgggtggcgcccgatcagccccacccgctggaaagccgggccggcctgctgctggccgccggcgccctctgcaccgacgcgagcctctcggaggaggacggcgagtaccggtccgtcggcgacccgacggagaccgccctggtcctgggcgcggcgaaggccgggctggacaagcgcgacctggaggcgcggcatccgcgggtcgccgaggtgcccttctcctcgacccgcaagcgcatgaccaccttccacgcgctgggcgatccggacgagggctacaccggcatcgtgaagggcgggcccgacgtggtgctcgcccgctgcacgcgcatccgcacggcccagggcaccgagcccatgacccccgggcgccgccgggcggtggaggaagccaaccgggagatggccgagcagggcatccgcgtcctggcggtggccttcacggccccccggacggaactgccggaggaccccgcggcgctggaggagaacctggaactgatcggcctgatcgggatgacggacccgccgcggcccgagagcgcggcggccgtgcggaaggcccacgaggcgggcatccgcaccatgatgatcaccggcgatcacgcgaccacggcgctggccatcgcccggcaggtccacatcgccggtgcggacgaccgggtgctgagcggccccgatctggaggagatggacgacgccgccctggagaaggccgtgcgcacggtgccggtatacgcccgggtctcgccggatcacaagctgcgcatcgtcgaggcgctccggcggcagggccacgtggtggcgatgaccggcgacggcgtcaacgacgcgcccgccctgaaacgggccgacatcggcgtcgcgatgggcgtggtgggcaccggcgtggcccggggcgcggccgacatggtcctgatggacgacaacttcgccaccatcgtggcggccgtggaagaggggcgcaccatctacgccaacatccagaaggccacgttcttcctgctttcggccaacgtcgccgagatggcgatcatgaccgtcgccatgctggccggctggcccgtgccattgcagccgatccacctgctgtgggtcaacctggtcaccgactcgctgccggccatcgccctgggcgtggagcccgccgaacccgggatcatgcggcagaagccgcgggacccccgggagccggtgctgacctcccggctcctcaccctgatggccatccaggccgtgttcctgggtgtcgccgtactggccgcgctgttcctggggatgcgggccggggccgcgggcaacccggtggcgaccggctccacctacgccttcgcgaccctggccatcggcgagctctggtgggcgcacagctgccgcagcctgacccgggccccgtggcgcatcgggttcttccgtaaccgggtggcctggctcgcgaccggcgtgggcttgctgctgatggtcgcggtcatgagcatccccttcctgcagcccttcttcaaggtgacgcccatcggcctgcaggggtggctcacggtgctcatcctgtcgctgatccccacggccttgatggaaccggtcaagtgggtcttcgcccgccggaagaagtag

SEQ ID NO: 107800 - protein, 885 aa, Symbiobacterium thermophilum
MERTDWHTLTPAEVTERLQVDPGPGLTAAEAAQRLARHGPNRLAEEKRRSMLAAFIDQFRDPLVLILLAAALLALVLREFLDGGAILAIVILNAVLGLVQEFKADQALQALKELSAPHCKVRRDGRVIEIDTRELVPGDIVVLEAGDPVPADLRLLRSAMLQIDESLLTGESVPVEKDADKTLEAGAPLADRVNMAFMSTAVTYGHGEGVVVGTGMRTEVGRIADRLQEEPQEATPLQKRLSHFARVLGGAMLVLVILLGAVGLWRGMPWLEVLMVAVSLAVATIPEGLPAVTTIVLALGMQRMARRNAVIRRLSAVETLGSATFICSDKTGTLTQNKMTVTRLWLPEEWVAPDQPHPLESRAGLLLAAGALCTDASLSEEDGEYRSVGDPTETALVLGAAKAGLDKRDLEARHPRVAEVPFSSTRKRMTTFHALGDPDEGYTGIVKGGPDVVLARCTRIRTAQGTEPMTPGRRRAVEEANREMAEQGIRVLAVAFTAPRTELPEDPAALEENLELIGLIGMTDPPRPESAAAVRKAHEAGIRTMMITGDHATTALAIARQVHIAGADDRVLSGPDLEEMDDAALEKAVRTVPVYARVSPDHKLRIVEALRRQGHVVAMTGDGVNDAPALKRADIGVAMGVVGTGVARGAADMVLMDDNFATIVAAVEEGRTIYANIQKATFFLLSANVAEMAIMTVAMLAGWPVPLQPIHLLWVNLVTDSLPAIALGVEPAEPGIMRQKPRDPREPVLTSRLLTLMAIQAVFLGVAVLAALFLGMRAGAAGNPVATGSTYAFATLAIGELWWAHSCRSLTRAPWRIGFFRNRVAWLATGVGLLLMVAVMSIPFLQPFFKVTPIGLQGWLTVLILSLIPTALMEPVKWVFARRKK

SEQ ID NO: 107801 - DNA, 2880 bp, Symbiobacterium thermophilum
  CDS (1)..(2880)
atgtcgacaccgtggcaccagaagggggcggccgaggtcgccgccgccctgcggacggacctgaccgccggcctgaccgaggccgagtgccggcggcggctggaggagtacggccccaaccagctggagggggcgccccgggttccctggtggcggatcctgctcgcgcagttccaggacttcatggtggtcgtgctcctgatggcgaccgcgatctcctacggcatgggcgagacggcggatgcgatcaccatcgtcgtcatcgtcgtgctcaacgccgtgctcggcttcgtgcaggagtaccgggccgagcgttccctggaggcgctgaaggaactggccgcgcccaccgcccgggtgatccgggacggccgcgaggtcacggtctccgcccgggacctggttcccggcgacctgctgctggtggaccccggcgatcgcatccccgccgacgcccggctggtggaagcgccggggctggaggtggaggagtcggccctgaccggcgagtcgttgcccgtgcgcaagtcggcgtcgtgggtgggcgatccggacgtgccgctgggcgaccggcggaacatgctctacatgggcacaaccgtcacccgcggccggggccgcgccctggtggtggccaccggcatgcagaccgagatggggcgcatcgcccacctgatccaggaggtgggagaagaagagacgcccctgcagcggcggctggcccagctgggccggtggctggtggccggctgtctgatcgtgtgcgcgatcgtggtggcggccggactgctgcgggaggagcggctgaccggaccggtcatctcgcagctgttcatggccggcgtctccctcgcggtggccgcgatcccggaggggctcccggccatcgttaccgtctcgctggccctgggcgtgcagcggatgatccggcgcaacgccatcgtccgccggctgcagtcggtggagaccctgggctgcgccacggtcatctgctccgacaagaccggcaccctgaccaagaacgagatgatggtgcgtgccgcctgggtcggcggccggtcctacaccgtcaccggcgacgggtaccgcccctccggcgagttcctgcgggagggccgaccggtgagcccccagcaggagccggacctggcccaggcgctgaagtcggccgcgctctgctccaacgcgaagctggtgcaggcccagcccgctcgccgcggccggggcgacggggcggccggcggacggtcggggagaagccaccgcccggggatggggcaggtcgtcttcagcgtccagggggacccgaccgaaggcgccctggtggtcgcagcgcagaagggcgggtaccggcccgccgtgctgcaggaccgctaccggcgggtgctggaggtccccttcgagtcggagcggcggcgcatgagcgtgatcaccgaggacggcgacggcgggtacctgctgcacgtgaagggcgcgccggacgtcatcctggaactttccacccacatgttgagagacggccgcatcgttcccctcactgaccaggatcggcaggcgatcctcgacgagaacctgcgcatggctgaccaggccctgcgggtgctggccgtcgcgtaccggcccctttccttccccgcgggcgagggtccggatcagctggccgagctgtccaccgacgaggccgcggcgcggctggagcggaacctcgttttcctgggcctgctgggcatgatcgacccgccccggccggaggtgaagcaggcggtggccgccgcccggcgggccggcatccgcacggtgatgatcaccggcgaccacccggccacggccctggccgtcgcccgcgagctgggcatcgtgggggcggaggggcgggccgtgaccggccgggagctggaccagctcagccactcggagctcatcgcggccgtggaggagtgccaggtgttcgcccgggtatcgccccagcacaagctgcagatcgttcgggccctgaaggagctgggcgaggtggtggcgatgaccggcgacggcgtcaacgacgccccggcggtgaaggaggccgacatcggcatcgccatgggccgcacgggcaccgacgtcaccaaggaggcgtcggcgatgatcctggcggacgacaactacgcgaccatcgtggccgcggtggaggaagggcggggcatctacgacaacatccgcaagttcatccgctacctgctctcctgcaacaccggcgaggtgctgaccatgtttctggcggcggtcatgcggctgccgctgccgctcctgccgatccagatcctcttcgtcaacctggtcaccgacggtctgccggcgatcgccctggggatcgacccgcccgagccggacgtgatgcgccgcccgccccgacggcccgacgagggcgtcttcgcccgccggctgggcatcaagatcctggggcggggcacgctgatcggcctcggcaccctgacggccttcctgatcgccttcttcacgctgccgggcacgcccggcgtcgcaccgctggacgacccggcggtgctcaacccggcccggacgatggccctggcgaccctggtgtgcgcgcagctcatccacgtgtttgactgccggtccgagcgacgggccatctgggagaccccgctctcttccaatccctggctggtggccgcggtcgcctcgtcggtcacggcgctgctgctcgcgatctactggccgccgctggctgccattttcgaaacggctccgctccaggcctggcaatggctggtggtcttgctgctggccagcgcgggcgaactgctggtggccatccgccggctgatcctgttcggccggccggtgcgcttgcgggcgcacgtcgaggaggaagcatga

SEQ ID NO: 107802 - protein, 959 aa, Symbiobacterium thermophilum
MSTPWHQKGAAEVAAALRTDLTAGLTEAECRRRLEEYGPNQLEGAPRVPWWRILLAQFQDFMVVVLLMATAISYGMGETADAITIVVIVVLNAVLGFVQEYRAERSLEALKELAAPTARVIRDGREVTVSARDLVPGDLLLVDPGDRIPADARLVEAPGLEVEESALTGESLPVRKSASWVGDPDVPLGDRRNMLYMGTTVTRGRGRALVVATGMQTEMGRIAHLIQEVGEEETPLQRRLAQLGRWLVAGCLIVCAIVVAAGLLREERLTGPVISQLFMAGVSLAVAAIPEGLPAIVTVSLALGVQRMIRRNAIVRRLQSVETLGCATVICSDKTGTLTKNEMMVRAAWVGGRSYTVTGDGYRPSGEFLREGRPVSPQQEPDLAQALKSAALCSNAKLVQAQPARRGRGDGAAGGRSGRSHRPGMGQVVFSVQGDPTEGALVVAAQKGGYRPAVLQDRYRRVLEVPFESERRRMSVITEDGDGGYLLHVKGAPDVILELSTHMLRDGRIVPLTDQDRQAILDENLRMADQALRVLAVAYRPLSFPAGEGPDQLAELSTDEAAARLERNLVFLGLLGMIDPPRPEVKQAVAAARRAGIRTVMITGDHPATALAVARELGIVGAEGRAVTGRELDQLSHSELIAAVEECQVFARVSPQHKLQIVRALKELGEVVAMTGDGVNDAPAVKEADIGIAMGRTGTDVTKEASAMILADDNYATIVAAVEEGRGIYDNIRKFIRYLLSCNTGEVLTMFLAAVMRLPLPLLPIQILFVNLVTDGLPAIALGIDPPEPDVMRRPPRRPDEGVFARRLGIKILGRGTLIGLGTLTAFLIAFFTLPGTPGVAPLDDPAVLNPARTMALATLVCAQLIHVFDCRSERRAIWETPLSSNPWLVAAVASSVTALLLAIYWPPLAAIFETAPLQAWQWLVVLLLASAGELLVAIRRLILFGRPVRLRAHVEEEA

SEQ ID NO: 107803 - DNA, 2577 bp, Desulfotalea psychrophila
  CDS (1)..(2577)
atgtcaaacgaaaaaccgccagccagcacccttgacgctgatattgaccttgagaaaataccagtcgatcagctgctcaccaaactcggcgttcaagcagaacaaggtctgagtagccccgaagcacaacaacgactcagccaatatgggccgaatgccctggttgaaaaagaggaaagcctgtccgccaaaattatgggccatttcatggggcctattgcctacatgattgaggccgcagcgctcatttcagccctgatcggtcactgggccgacttcgccatcatcagcgtcctgctgttgtttaacgtcggacttgagatgtggcaggatcgcaagtcctcgaatgccttggcagaacttaaaaagggactggcgccggaagccaccgccatgcgcgatggcaaatggcaaacagtggcggcggcaaatctagttcccggcgacatcgtcaagattcgcttgggtatggttgttcccgccgatgtgcggatggtcggcggcgactacgcgtccatagatcagtcggggctaaccggtgaatcgctaccagtaaccaagaaggttggcgacgagggttattcaggcagtgtagttaagcagggcgagatggtttgcgtagtcattaacacgggctccaatactttatttggtcggaccgctaaactggttgccggcgcggggtcggtcagtcacgctcaaaaagccatgttccagattggtaactttctcattatcgtcgccgtcgcacttgcgctgatcatggtcgccgttcaggtttatcataattttgtcgtcgcagatacctgggatatgaatgatgccctcagcattctgcagttcgtgctggtcttattggttgcctcaatccccgtggcaatgccgacggtgttttcgatgaccatggccctgggagcgctacaactatcgaaggaaaaggcgattgtttccaagctctcagcgattgaggagatggcaggggtcaatattctctgctccgacaaaaccggaaccttaaccaagaatcagctctcgttggcagaccccatccttatagagggcacgcacgcgcaagactgtcttttggccgcagcgctcgcctcgaacatcgaagataaagatgccattgataccgctgttatccaggcactcaaggatcaaaatgttctcaataactggaaaaaactaaaattcgtaccttttgatccagtaacaaagcgcacctcggcaagcgtaatcgattcaacaggcaaggccttcgtagtcactaaaggcgcgccacaggcgattattgatattgccaaaccctccacagagattgcgcagaaagtcaaagatgcagttgccgcactggcggccaagggttcgcgggcgctaggcgttgcccgttctgaagataacggggtgacctggtctttcctgggcatactaccgatgtttgatccaccgcgtgatgattcgaaattgaccattgataacgctcgcgaaaaaggggtgttggtgaaaatgatcactggcgacgacaccgctatcgctatcgaaacggctcgccaacttggcattggtataaatattattccggcggcggatgcctttcctaaggagatggatcccaacaatgtaccaccggaaatcgtagacttaattgagcaggcggacggcttcgcgcgtgtatttcctgagcataaatacgctatcgtcaaggccctacaatcgcgcggccatctggtggctatgaccggcgacggcgttaacgacgcaccagcactcaaacaagccgattgcggcaccgctgtttccggcgccactgatgcggcacgcagcgctgcggcattgattctcaccgcccccggtttatcggtcatcaacagcgcgatcgacgaagcacggcgtatttttggccgcattaccagctacaccatttaccgggtagctttaaccatggacatcatgttcctggtcgtgctctccattatttttctcggctttacaccactgacacccattatgattgtcgccatgtcgctgctcgatgatgtgccgatcatggctatcgcctacgacaacacaccggtcagtgaaaagccgattcgttggaaaatgccacagttgttaggcgtctcagcagtacttggcctgttttctattgcccagtcctttggttttctcttaatcggcatggaagtattatcaagcccaactgagcaagctttttttggtttgacaacacatgcccagctacagacactgatgtttctgcaactggttgccggcggtcatctgctgctgttcgttactcgcacggaacgctggttttttctgcgccccctcccagccgcgcctctgttcctggcgatcctctgtacccaaatcctggcaatcctaatgtgcgctctgggttggctggtcgaccccatttcatggaccatgatcggctggacttgggcctacaatctggtctggatgttcctgctaggcgcagtcagactaattaccgagcaccttatggcttatcgtacgacacgtcatttaaagagtttgaaaatggtgaatcagccactgcaagcgcatgattaa

SEQ ID NO: 107804 - protein, 858 aa, Desulfotalea psychrophila
MSNEKPPASTLDADIDLEKIPVDQLLTKLGVQAEQGLSSPEAQQRLSQYGPNALVEKEESLSAKIMGHFMGPIAYMIEAAALISALIGHWADFAIISVLLLFNVGLEMWQDRKSSNALAELKKGLAPEATAMRDGKWQTVAAANLVPGDIVKIRLGMVVPADVRMVGGDYASIDQSGLTGESLPVTKKVGDEGYSGSVVKQGEMVCVVINTGSNTLFGRTAKLVAGAGSVSHAQKAMFQIGNFLIIVAVALALIMVAVQVYHNFVVADTWDMNDALSILQFVLVLLVASIPVAMPTVFSMTMALGALQLSKEKAIVSKLSAIEEMAGVNILCSDKTGTLTKNQLSLADPILIEGTHAQDCLLAAALASNIEDKDAIDTAVIQALKDQNVLNNWKKLKFVPFDPVTKRTSASVIDSTGKAFVVTKGAPQAIIDIAKPSTEIAQKVKDAVAALAAKGSRALGVARSEDNGVTWSFLGILPMFDPPRDDSKLTIDNAREKGVLVKMITGDDTAIAIETARQLGIGINIIPAADAFPKEMDPNNVPPEIVDLIEQADGFARVFPEHKYAIVKALQSRGHLVAMTGDGVNDAPALKQADCGTAVSGATDAARSAAALILTAPGLSVINSAIDEARRIFGRITSYTIYRVALTMDIMFLVVLSIIFLGFTPLTPIMIVAMSLLDDVPIMAIAYDNTPVSEKPIRWKMPQLLGVSAVLGLFSIAQSFGFLLIGMEVLSSPTEQAFFGLTTHAQLQTLMFLQLVAGGHLLLFVTRTERWFFLRPLPAAPLFLAILCTQILAILMCALGWLVDPISWTMIGWTWAYNLVWMFLLGAVRLITEHLMAYRTTRHLKSLKMVNQPLQAHD

SEQ ID NO: 107805 - DNA, 2775 bp, Debaryomyces hansenii CBS767
  CDS (1)..(2775)
atgagtgataatccttatgaaatcaatcttgggtcgcttccacccacacgggccagttcgccatcgatcaagtactgccagttatcaattaaggagactgaatccgagctacaaacagatatatcgtacgggttaaataacaatcaagatatattgaatagaagatcgcttcacggatctaatgaactaaatggtgaggaagaagaaagtcttttcaagaagtttttatcgagtttctatggcgatccattaatcttgttattaataggttcggctgctatcagtttctggatgggaaacgtcgatgatgctatttctatcacgttggccatcactattgttgtcactgttggatttgtacaagagtacaggtctgagaaatcattggaggctttgaataaattagttccagcggaagcaaagttaacgagaaatggtagtacatccactgttttagcatcaacgttggttccgggagatttggttcattttagtcaaggggacagaattccagctgatatcagattgaccgaatgcacctacttgtctattgacgaaagtaatttaaccggtgaaaatagcccagttagaaagaactcaaaaaccttacaaaataacaaaaatgaattaattcctgtcacagagagaacctcgattgcgtatatgggtacattggtgagagatggacatggttcaggtattgttgtagccacaggaccaaagactgaatttggtgccgtatttgagatgatgtctgaaattgaaaaacctaagactcctttacaacaagccatggataaattaggtaaagatttatctcttttcagttttatagtaattggtgtgatttgtttgattggaatttttcaaggtcgttcttggttggatatgtttcaaatttctgtatcattggctgtagcagctattcctgaaggcttacctatcattgtcactgttacattagctttaggtgttttaagaatggctcgtcataaggctattgtcaagagattaccaagtgtcgaaacattaggaagtgtaaatgttatttgctctgataagactggaacattaacccaaaatcatatgaccgttactaaaatatgggcgcttgattttaagggcagcttcaatagtccattcttggtcgttgaaaaactagacgataacagtttacatcaccaattaactgataatatgcataaaattttagaaactggtaatatttgtaataatgctaaatactcgagtgaaaatgaaaaatatgttggtaatccaagtgatattgctctcgttgaatgcttgcctcattttggtttagaagatttgagagctaccaaagagaaggtttatgaattaccattttcctctactaggaagtacatggcagtatgcgttcacactggtgatatggacaagtctgagacattcgccaaaggtgcttctgaaagaattgtttcactttgctcaaagtattatgatgaaaatggtgatgctaagcctttgacaaatgaaattaagaaattaatttcggacaagtcagatgctttggcatcagacggtttaagagttttgggattagcaagaaacaatttaaagttttctaatagtggtgaagaaactagtgaaccaaaaaatttaatattctgtggattagtcggtatgaaggatccaccaagaccaaatgtcggaaaatctatttctttattaatgaaaggtagagtacatgttgttatgatcacaggggactctgcaaccacagcaatcaatattgccaaacaaattggaattccagttttgaacgaaagttctgttatgactggtgatcaattggataatttgaatgaagaaaaattggctgaagcaattcataatatttcggtctttgcaagaaccacaccagaacataaggttttaatcgtcaaggcccttcaaaagaggggtgacattgttgcaatgacaggcgatggtgttaatgatgcaccagccttgaagttggcagatattggtattgcaatgggtaaaaacgggacagatgttgctaaagaagctgctgacatggtgttgacggatgatgatttttccacaattttgtctgcaattgaagaaggcaaaggtattttttataacattcaaaactttatcactttccagttatctacatctattgcggccttgacattaattgcattagccacgttctttggattaccaaaccctcttaacgccatgcaaatcttgtggattaacatcttgatggacggtccaccagcccaatccttgggtgttgagccggtggatcatgaagtcatgagtaaaccaccaagaaaacgtaacgacagaattttgaccgataacgtcctcaagagggttttacaatcagctgctatgattatcgctggtacattgtacatattcattaaggaaatgaccgacaatgaaatcacggccagagataccactatgaccttcacgtgttttgtcttatttgacatgttcaatgcattagcctgccgtcactactccaaatctattttcgaacttggtatgaagaatcagatgttcaatttcgctgttcttggttcgttgattgggcaattctgtgcaatctatgttccattcttccagacaatctttcaaactgaggctttgtattttattgacttggtccatcttgtttgtttgacaagttctgttttcttcgccgatgaggctagaaagtacttcctcaagcggaggaatgcctacgataatggctttcactgcggtgtttag

SEQ ID NO: 107806 - protein, 924 aa, Debaryomyces hansenii CBS767
MSDNPYEINLGSLPPTRASSPSIKYCQLSIKETESELQTDISYGLNNNQDILNRRSLHGSNELNGEEEESLFKKFLSSFYGDPLILLLIGSAAISFWMGNVDDAISITLAITIVVTVGFVQEYRSEKSLEALNKLVPAEAKLTRNGSTSTVLASTLVPGDLVHFSQGDRIPADIRLTECTYLSIDESNLTGENSPVRKNSKTLQNNKNELIPVTERTSIAYMGTLVRDGHGSGIVVATGPKTEFGAVFEMMSEIEKPKTPLQQAMDKLGKDLSLFSFIVIGVICLIGIFQGRSWLDMFQISVSLAVAAIPEGLPIIVTVTLALGVLRMARHKAIVKRLPSVETLGSVNVICSDKTGTLTQNHMTVTKIWALDFKGSFNSPFLVVEKLDDNSLHHQLTDNMHKILETGNICNNAKYSSENEKYVGNPSDIALVECLPHFGLEDLRATKEKVYELPFSSTRKYMAVCVHTGDMDKSETFAKGASERIVSLCSKYYDENGDAKPLTNEIKKLISDKSDALASDGLRVLGLARNNLKFSNSGEETSEPKNLIFCGLVGMKDPPRPNVGKSISLLMKGRVHVVMITGDSATTAINIAKQIGIPVLNESSVMTGDQLDNLNEEKLAEAIHNISVFARTTPEHKVLIVKALQKRGDIVAMTGDGVNDAPALKLADIGIAMGKNGTDVAKEAADMVLTDDDFSTILSAIEEGKGIFYNIQNFITFQLSTSIAALTLIALATFFGLPNPLNAMQILWINILMDGPPAQSLGVEPVDHEVMSKPPRKRNDRILTDNVLKRVLQSAAMIIAGTLYIFIKEMTDNEITARDTTMTFTCFVLFDMFNALACRHYSKSIFELGMKNQMFNFAVLGSLIGQFCAIYVPFFQTIFQTEALYFIDLVHLVCLTSSVFFADEARKYFLKRRNAYDNGFHCGV

SEQ ID NO: 107807 - DNA, 2691 bp, Debaryomyces hansenii CBS767
  CDS (1)..(2691)
atgagtggtactgaaccaactaacgaaaaggtcgacaagattgtgtctgacgatgaagaagaagatattgatcaattgatcatggacttgcaatctcataaaggtcttgatgatgaagatgacgatgaagcagttgacgacagctctttcaaggctgttccagaggaattattgaaaaccgacccaactaccggtttgactgccgatgaagttaccaagagaagaaagaagtacggtttgaaccaaatgtctgaagacaaagaaaacttggttttgaagttcgttatgttctttgttggtccaattcaattcgttatggaagccgctgctattttagccgctggtttagaagattggattgatttcggtgttatctgtgctttgttattattgaacgctttcgttggtttcgtacaagaataccaagctggttctattgtcgatgaattgaagaagactttagctaactttgctttcgttatccgtgacggttctttaatcgaaattgctgcaagtgaaattgttccaggtgatattttacaattggaagacggtaccgttattccagctgatggtagagttgtttctgaagactgtcatttacaaattgatcaatctgctattactggtgaatctttagctgttgaaaagagatttggtgatgccacttactcttcttctactgttaagactggtgaagctttcatgattgttactgctactgctgattctaccttcactggtagagctgctgctttagtcaacaaggccggtgctagtggtggtcacttcactgaagtcttgaactccattggtaccttattattggttttagtcattgttactttgttacctatctgggttgcttgtttctaccgtactgttagaattgttccaattttaagatacactttagctattcttattgtcggtgtcccagttggtttaccagctgttgttaccactaccatggctgtcggtgctgcttacttagctaagaagcaagctattgttcaaaaattgtctgctattgaatccttagccggtgtcgaaatcttatgttccgataagaccggtactttaaccaagaacaagttatctttacacgagccatacactgtcgaaggtgttgaagccgacgacttaatgttgaccggttgtttagctgcttctagaaagaagaagggtttagatgctattgataaggctttcttaaaatctttaattgactacccaagggccaaggctgctttaaccaagtacaagcttattgaattccaacctttcgatcctgtctcaaagaaggtcacctctattgtcgaatcaccagaaggtgaaagaattatctgtgttaagggttctccattattcgttttaaaaactgttgaagatgatcacccaatcccagaagatgtccacgaaaactatcaaaacactgttactgaatttgcttctagaggtttcagatctttaggtgttgctagaaagagaggtgaaggtcactgggaaatcttaggtattatgccagttatggatcctccaagagatgatactgctcaaactattaacgaagctagaagattaggtttaagagttaagatgttaactggtgatgccgttggtattgctaaggaaacttgtcgtcaattaggtttaggtactaacatttatgatgctgacagattaggtttatccggtggtggtgacatggccggttctgaaattgctgatttcgttgaaaacgctgatggtttcgctgaagttttcccacaacacaagtacaatgccgttgaaattttacaatcaagaggttacttagttgccatgactggtgatggtgttaacgatgccccatctttgaagaaggctgatactggtattgccgtcgaaggtgctactgatgctgccagatccgctgctgatattgttttcttagccccaggtttatctgctattattgatgctttaaagacctccagacaaattttccacagaatgtacgcttatgttgtctaccgtattgctttatctttacacttggaaattttcttaggtttatggattgttatcttgaaccaatccttatctattgatttaattgtctttattgctcttttcgctgatgttgctactttagccattgcttatgataatgctccatatgacccaatgccagttaagtggaacactccaagattatggggtatgtctattgtcttaggtataatcttagctatcggtacttggattactttaaccaccatgttcatgaagaagggtggtattgtccaaaacttcggtggtcttgatggtatcttattcttgcaaatttccttgactgaaaactggttaattttcattaccagagctcaaggtccattctggtcatccatcccatcctggcaattaggtggtgctatccttattgtggatatcatcgccacctgtttcaccttattcggatggtggtctcaaaactggactgatattgttactgttgtcagaacctggatcttctccttcggtgtcttctgtgtcatgggtggtttatactacttaatgtccggctccgaagcatttgacaacatctgtaacggtagaccagccaaaccacacaaggacaacagatctgtcgaagatttcttaatgtccatgcaaagagtctctactcaacacgaaaagtctacttag

SEQ ID NO: 107808 - protein, 896 aa, Debaryomyces hansenii CBS767
MSGTEPTNEKVDKIVSDDEEEDIDQLIMDLQSHKGLDDEDDDEAVDDSSFKAVPEELLKTDPTTGLTADEVTKRRKKYGLNQMSEDKENLVLKFVMFFVGPIQFVMEAAAILAAGLEDWIDFGVICALLLLNAFVGFVQEYQAGSIVDELKKTLANFAFVIRDGSLIEIAASEIVPGDILQLEDGTVIPADGRVVSEDCHLQIDQSAITGESLAVEKRFGDATYSSSTVKTGEAFMIVTATADSTFTGRAAALVNKAGASGGHFTEVLNSIGTLLLVLVIVTLLPIWVACFYRTVRIVPILRYTLAILIVGVPVGLPAVVTTTMAVGAAYLAKKQAIVQKLSAIESLAGVEILCSDKTGTLTKNKLSLHEPYTVEGVEADDLMLTGCLAASRKKKGLDAIDKAFLKSLIDYPRAKAALTKYKLIEFQPFDPVSKKVTSIVESPEGERIICVKGSPLFVLKTVEDDHPIPEDVHENYQNTVTEFASRGFRSLGVARKRGEGHWEILGIMPVMDPPRDDTAQTINEARRLGLRVKMLTGDAVGIAKETCRQLGLGTNIYDADRLGLSGGGDMAGSEIADFVENADGFAEVFPQHKYNAVEILQSRGYLVAMTGDGVNDAPSLKKADTGIAVEGATDAARSAADIVFLAPGLSAIIDALKTSRQIFHRMYAYVVYRIALSLHLEIFLGLWIVILNQSLSIDLIVFIALFADVATLAIAYDNAPYDPMPVKWNTPRLWGMSIVLGIILAIGTWITLTTMFMKKGGIVQNFGGLDGILFLQISLTENWLIFITRAQGPFWSSIPSWQLGGAILIVDIIATCFTLFGWWSQNWTDIVTVVRTWIFSFGVFCVMGGLYYLMSGSEAFDNICNGRPAKPHKDNRSVEDFLMSMQRVSTQHEKST

SEQ ID NO: 107809 - DNA, 2751 bp, Yarrowia lipolytica CLIB99
  CDS (1)..(2751)
atgtccgccaacccttccctggaccctgctcagctcccccaggagcaccccattgaggagaaggctcccgcccctcccgctccccccgccggtggcctcgatgacgagcccgatgatgatatggacgccctcattgaggagctccagtctgatgccggagatgacattttcggtgaggacgccgacgacgccgaggaaggtgcctccgccaagcccgttcccgaggagcttctccagaccgacccctccgtcggtcttacctccgaccaggtccttcagcgacgaaagaagtacggtctcaaccagatgtccgaggagcaggagaacctcatcctgaagttcatcatgttcttcatcggtcccattcagttcgtcatggagggtgccgctattctcgccgccggtctggaagattgggtcgatttcggtgttatttgcggtcttctgatgcttaacgcctgtgtcggtttcatccaggaattccaggctggttctattgttgaggagctcaagaagactcttgccctcggtgctgttgttgttcgagacggtcgtgatgttgagattgaggctcccgaggttgtccccggtgatatcctcaagctcgaggagggtaccattatccccgctgatggccgaattgtcacccccgattgtttcctccagattgatcagtccgctcttaccggtgagtctcttgccgtcgataagcactttggcgacaacacctttgcctcttcttccgtcaagcgaggtgagggtttcatgattgttacctccactggtgacaacaccttcgtcggtcgtgccgctgctcttgtcaacaaggcctccggaggccagggtcatttcactgaggtcctcaacggtatcggaacaacccttcttgttctcgttatcatcacccttcttgttgtctggatctccaccctttaccgatctgtccccattgttgagattctgcgatacacccttgccatcaccattgtcggtgtccccgtcggtcttcccgctgtcgttaccaccaccatggctgtcggtgccgcctacctcgccaagaaggaggccattgtccagaagctgtctgctattgagtctcttgccggtgtcgagatcctgtgttccgataagaccggtaccctcaccaagaacaagctgtctcttgccgagcccttcactgtcgagggtgttgatgccgatgacctgatgcttactgcttgtctcgctgccacccgaaaggccaagggtcttgatgctattgacaaggccttcctgaagtccctgaagatgtacccccgagccaagtctactcttaccaagtacaaggttgttgagttccaccccttcgaccccgtttccaagaaggttgttgctgttgtcgagtcccccgccggtgagcgaatcatctgtgttaagggtgcccctcttttcgttctcaagactgtcgaggaggaccaccccatccccgagcagatcctcaacgactacaaggctaaggttgctgactttgcttctcgaggttaccgatcccttggtgttgcccgaaagcgaggcgagggacactgggagattctcggtattatgccctgtatggaccccccccgacacgataccttcaagaccgtccaggaggccaagcagcttggtctgtccatcaagatgcttactggtgatgccgtcggtattgctaaggagacttcccgacagcttggtctcggtaccaacatctacgacgccgaccgacttggtctcggtggaggaggtgacatgcccggttctgaggtttacgatttcgttgaggctgctgatggtttcgctgaggtttttcccgagcacaagtacaatgtcgttgagattctgcagcagcgaggctaccttgttgccatgaccggtgatggtgttaacgatgctccttcccttaagaaggccgatactggtatcgccgtcgaaggtgcttccgactctgcccgatccgccgctgatattgttttccttgcccctggtctctccgccattatcgatgccctgaagacttcccgacagattttccaccgaatgtactcttacgtcgtctaccgaattgctctgtccctccatcttgagattttccttggtctgtggattgctatcctcaacgagtctcttgacattgacctcattgtcttcattgccattttcgctgatgttgccacccttgccattgcctacgataacgctccctactctcccaagcccgtcaagtggaacctgcccaagctttggggaatgtccattgtccttggtgttgtgcttgctgtcggaacctggatcaccctcaccaccacctttgtcaacaacggtggtatcatccagaacttcggtgttcgagaccccattctcttccttcagatttcccttactgagaactggctgattttcatcacccgagctaacggtcctttctggtcctctatcccctcttgggagcttgctggtgccgtcttcatcgtcgatatggtcgccactgtcttctgtctgtggggttggttcattggtggtcagacctccattgttactgtcgtccgtgtctgggtcttctccttcggtatcttctgcatctgtggtggtctctactacgtcatgcagggctccgttggctttgaccgactcatgaacggtcagcccatgaaggagaagcctaagcagcgatctcttgaggactttgttgttgctatgcagcgagtctccacccagcacgagaaggccgcataa

SEQ ID NO: 107810 - protein, 916 aa, Yarrowia lipolytica CLIB99
MSANPSLDPAQLPQEHPIEEKAPAPPAPPAGGLDDEPDDDMDALIEELQSDAGDDIFGEDADDAEEGASAKPVPEELLQTDPSVGLTSDQVLQRRKKYGLNQMSEEQENLILKFIMFFIGPIQFVMEGAAILAAGLEDWVDFGVICGLLMLNACVGFIQEFQAGSIVEELKKTLALGAVVVRDGRDVEIEAPEVVPGDILKLEEGTIIPADGRIVTPDCFLQIDQSALTGESLAVDKHFGDNTFASSSVKRGEGFMIVTSTGDNTFVGRAAALVNKASGGQGHFTEVLNGIGTTLLVLVIITLLVVWISTLYRSVPIVEILRYTLAITIVGVPVGLPAVVTTTMAVGAAYLAKKEAIVQKLSAIESLAGVEILCSDKTGTLTKNKLSLAEPFTVEGVDADDLMLTACLAATRKAKGLDAIDKAFLKSLKMYPRAKSTLTKYKVVEFHPFDPVSKKVVAVVESPAGERIICVKGAPLFVLKTVEEDHPIPEQILNDYKAKVADFASRGYRSLGVARKRGEGHWEILGIMPCMDPPRHDTFKTVQEAKQLGLSIKMLTGDAVGIAKETSRQLGLGTNIYDADRLGLGGGGDMPGSEVYDFVEAADGFAEVFPEHKYNVVEILQQRGYLVAMTGDGVNDAPSLKKADTGIAVEGASDSARSAADIVFLAPGLSAIIDALKTSRQIFHRMYSYVVYRIALSLHLEIFLGLWIAILNESLDIDLIVFIAIFADVATLAIAYDNAPYSPKPVKWNLPKLWGMSIVLGVVLAVGTWITLTTTFVNNGGIIQNFGVRDPILFLQISLTENWLIFITRANGPFWSSIPSWELAGAVFIVDMVATVFCLWGWFIGGQTSIVTVVRVWVFSFGIFCICGGLYYVMQGSVGFDRLMNGQPMKEKPKQRSLEDFVVAMQRVSTQHEKAA

SEQ ID NO: 107811 - DNA, 2817 bp, Kluyveromyces lactis NRRL Y
  CDS (1)..(2817)
atgagtgacaatccgtttgagtcttatctcgcacgagaccagcaaccgccacagcccgctgtcgatgtgctttcgcagcctaatgcctcactagaatattgcacggtgtcagtggaagatacgatagcacaattaggaactgatttcgataatggtttatccaatccatcagaaattgcttataggaaatcaatttggggatcaaacgaagtcctacctgatgagaaagtatctctttggaaaaaattcttgtctacattcattgaagaccctttaattcttttgttgatcggatctgcagttatatctttcttaatgggaaacatcgatgattccatcagtattgctctggccatcatcattgttgttaccgtcgggtttgtacaagaatataagtcagagaagtcattagaagcattaaacaagttagtcccagcggaatgtcatttgacaagatcagggcagttatcccatgttcttgcgtcaaacttagttccaggtgatttggtcagatttaaggtcggtgatagaattcctgctgatttaagaattgtagaatctatcgatttgtgcgtagatgaaagtaatttgacaggtgaaaatgaaccagtacacaagagttctggtgcagtggaccctaagaactactctcatatacctggatccattattccagttggcgatagaaactgtatcggatttatgggtactttggtcagagaaggccatggtaagggaatagtcattgccacaggcaagcatactgtttttggttctgtctttgaaatgatgagtggtatagataagccaaagactccattgcagacagcaatggacaaattgggtcaggatttgtcctacatgagtttcgttttgattggtattatttgtttgattggtattatccagggtagatcatggttggaaatgttccagatcgctgtttctctagcggtggctgctatccctgaaggtttaccaattattgttactgttactttggccctaggggtcttaagaatggctaaacgtaaggctattgtcaggaggcttccaagtgttgaaactttgggttctgtaaacgttatttgttctgataagactggtactttgaccgcaaatcatatgactgtttcaaagatttggtgtttgggcagtatggaaaataaaactaattgtttggcattatctaaggtgaaagaaagaccgattaaaatggagcaagatgttgctaccactttgagaatcggtaacatttgcaataatgggacctactcccaggaacatcttaaataccttggtaatccaacagatattgccatcttagagtcattacaacattttggtataaatgattgcagaaactccgtcaacaagattaacgaaatccctttcaattcgaagagaaaatttatggctgtcaaaactatcgatgccaatgataaagtggtagtatacgtgaaaggtgctttcgaaaagattgttgagaaatccatcaactacattggcagagacgggaaggtgcataagctgaaaccaaatgataaagccatcattaacgatgcagctgttgcactggcttctgaaggacttcgtacacttgcttttgcggagctggaggtgagcgccacccatggtgacaaagaattcaatgaagacatggttgaaggcttaacatttactggtctaattgctatgaatgatccacctaggccgacagtccgcagtgccattgaagaactactccaaggtagcgtacatgttattatgatcacaggtgatgctgaaaacactgctgttagtattgctagacaaattggaattcctgtcatcaaccctgaatacagtgtgctttcaggtgataagctggaccaaatgactgatgaccaattggctagtgttattgatcatgttaacgtgtttgctcgtgctacccctgaacataagttgaacattgttcgcgccttgcaaaagcgtggtgatattgtagcaatgactggcgatggtgttaatgatgcacctgccttgaagttggcagatataggtgtgtctatgggtaaaatgggaactgatgttgccaaagaagcctctgatatggttttaaccgacgatgacttcagtacaattttaactgccattgaagaaggtaaaggtattttcaataatattcaaaatttcttgactttccaattgtctacctcagttgctgctctttcgttggtcgctatttcgacttctttgaaactaccaaatcctttaaatgccatgcagattctttggattaatatattaatggatggacctccagctcagtccttaggtgttgagcctgtcgatcatgaagttatgagaaaacccccaagaaaaaggactgacaagatcctaactgacgctgtcctcaaaagagtgttgattagtgcatgttttataattgttggaacaatatatgtctttgtcaaggaaatggcagaagatggccaagttacatcaagagacacaactatgacatttacctgttttgtcttttttgatatgtttaatgccttgtcttgtagacatgcaacgaaatccatcttcgagataggattctttgcaaacaagatgttcaactatgctgtgagcttatctcttttaggacaattatgcgccatttatataccattctttcagggtatttttaagacagaaagtcttagcctgggagatttactgttcctcttaacgttaagcagcagcgttttcattggtgatgaaatcaggaaatactatgtcaagaaaaatagatacttggactcatatagctcctcaattgtttaa

SEQ ID NO: 107812 - protein, 938 aa, Kluyveromyces lactis NRRL Y
MSDNPFESYLARDQQPPQPAVDVLSQPNASLEYCTVSVEDTIAQLGTDFDNGLSNPSEIAYRKSIWGSNEVLPDEKVSLWKKFLSTFIEDPLILLLIGSAVISFLMGNIDDSISIALAIIIVVTVGFVQEYKSEKSLEALNKLVPAECHLTRSGQLSHVLASNLVPGDLVRFKVGDRIPADLRIVESIDLCVDESNLTGENEPVHKSSGAVDPKNYSHIPGSIIPVGDRNCIGFMGTLVREGHGKGIVIATGKHTVFGSVFEMMSGIDKPKTPLQTAMDKLGQDLSYMSFVLIGIICLIGIIQGRSWLEMFQIAVSLAVAAIPEGLPIIVTVTLALGVLRMAKRKAIVRRLPSVETLGSVNVICSDKTGTLTANHMTVSKIWCLGSMENKTNCLALSKVKERPIKMEQDVATTLRIGNICNNGTYSQEHLKYLGNPTDIAILESLQHFGINDCRNSVNKINEIPFNSKRKFMAVKTIDANDKVVVYVKGAFEKIVEKSINYIGRDGKVHKLKPNDKAIINDAAVALASEGLRTLAFAELEVSATHGDKEFNEDMVEGLTFTGLIAMNDPPRPTVRSAIEELLQGSVHVIMITGDAENTAVSIARQIGIPVINPEYSVLSGDKLDQMTDDQLASVIDHVNVFARATPEHKLNIVRALQKRGDIVAMTGDGVNDAPALKLADIGVSMGKMGTDVAKEASDMVLTDDDFSTILTAIEEGKGIFNNIQNFLTFQLSTSVAALSLVAISTSLKLPNPLNAMQILWINILMDGPPAQSLGVEPVDHEVMRKPPRKRTDKILTDAVLKRVLISACFIIVGTIYVFVKEMAEDGQVTSRDTTMTFTCFVFFDMFNALSCRHATKSIFEIGFFANKMFNYAVSLSLLGQLCAIYIPFFQGIFKTESLSLGDLLFLLTLSSSVFIGDEIRKYYVKKNRYLDSYSSSIV

SEQ ID NO: 107813 - DNA, 2712 bp, Erwinia carotovora
  CDS (1)..(2712)
atgaccgatatgatcacgcaaacggggcatcgccgcgcccgtaagacacccacggccacctttgcgattgcccgtgaggcacaaaacagcctcgatcaaacactggcgaacctaaatacgcatctgcacggcttaagccatgatgacgtcattgagcgtcagcaaacctatggcgaaaaccgcgtcgcccatgaaaaggcgccgcacgcgctggtgcagttagccgcagcgtttaataacccgtttatttacgtgctaatggcgctggccgctatcagctttttcaccgattactggctgccacagcgcaataacgaagagacctcactcactggcgtgatcattattctggtgatggttagcctgagcggcctgctgcgcttctggcaggagtttcgtaccaataaagccgcagaagcactgaaatccatggtgcggacaacggccaccgtactgcgccgacctcacgccagcgccaccgccgtcatgcaggaaatcccacttcagcaactggtacccggcgatatcctgatcctctccgcaggcgacatggtgcctgcggatgtccgtctggtggaatcccgcgatctgttcgtcagccaggcggtactgaccggtgaatcgctgccaatcgaaaaatacgatgtattcagcaatatcagtgccaaaggctgtcagcccactgactgcggcagcgagagcgatctgctggcgctatccaacatctgcctgatgggcaccaacatttccagcggcacggcaacggcaatcgtggtggcaaccggcagccacacctatttcggttcactggcaaaatctatcgtcggcacgcgctcccaaactgccttcgatcgtggtgttaacagcgtaagctggctgctgatccgctttatgatcgtgatggtgcctgtcgtgctgctgatcaacggcttcaccaaaggtgactggatggaggccagcctgtttgcgctggcggtcgcggtcggcctgacgccggaaatgctgccgatgattgtctcatccaatttggcgaagggcgcgattgccatggcacggcgtaaagtggtggtcaaacggctgaacgcgattcagaattttggcgcgatggacgtactgtgcaccgacaaaaccggcacgctaacgcaggatcgcatcatccttgagcatcacctgaacacgcagggccagatcgatgagagtgtgttgcaactcgcctggctcaacagcgcgcaccagagcggcatgaaaaacctgatggatcaggccatcatgcattttggtcgccataatccagccatctccgcgctgggtcgctatcgcaaaatcgatgaactgccgtttgattttattcgtcgtcgcctgtccatcattgttgccgatgaacacaaccagcaacgcttgatttgcaaaggcgcggtagaagagatgctagccgtcgctacgcatgtcagtgagaacggacagcggcatgaactggacgacgaacgtcgcaatacgctgaaaaaactggcagagagctacaaccagcaagggttccgcgtgctgatgattggcacacgagagctgagcccggtgggtagcacgatgccgctcagcgccgtggatgaacgcgatctgaccctctgcggtctgctgacgttcctcgatccacccaaagaaagtgcctccgccgcgattcgcgccctgcatgaaaacggcgtgacggttaaagttctgaccggcgacaacgcgattattaccagtaagatctgtcgcgatgtcgggctagagccgggcgaggtgctagaagggaacgagattgatgcactcagcgatgaacagctcggcgtgctggtagaacagcgcaccatttttgctcgactgacgccgctacaaaaatcccgcgtactgaaagcattgcaaggtaatgaccatacggtcggctttctaggcgacggtatcaacgatgcccctgccctgcgtgatgctgatatcgggatttccgtcgataccggaacggatatcgccaaagagtcagccgatattattctgctggaaaaaaacctgatggtgctggaagaaggcatcatcaaaggtcgcgagacgttcggtaatatcatcaaatacctgaacatgaccgccagttccaacttcggtaacgtgttttcagtgctggtcgccagcgcctttattccgttcctgccgatgttggcgatccacctgctgattcaaaacctgatgtacgacatctcccaactgtcgctgccgtgggacaaaatggataaggagttcctacgcaagccccgcaaatgggatgctaaaaatattggtcgcttcatgctgtttatcgggccaacgtcatcgatttttgacatcaccacctacgcgctgatgtggttcgtgtttgccgccaatagcgtcgagcatcaggcactgtttcagtcaggctggttcgttgaagggctactgtcacaaacgctggtcgtgcacatgctgcgtacccagaagatcccattcattcagagtaccgcagcgctgccggtgatgttgatgaccggactggtaatggcgctgggcatctatctgccgttctctccgatggggccactggtcggtttacagccgctgccgtgggagtatttcccttggctagccgccacgttgattggctactgcaccgtcgcacaactggtcaaacgcgcctacatccgccgcttcggccaatggttctaa

SEQ ID NO: 107814 - protein, 903 aa, Erwinia carotovora
MTDMITQTGHRRARKTPTATFAIAREAQNSLDQTLANLNTHLHGLSHDDVIERQQTYGENRVAHEKAPHALVQLAAAFNNPFIYVLMALAAISFFTDYWLPQRNNEETSLTGVIIILVMVSLSGLLRFWQEFRTNKAAEALKSMVRTTATVLRRPHASATAVMQEIPLQQLVPGDILILSAGDMVPADVRLVESRDLFVSQAVLTGESLPIEKYDVFSNISAKGCQPTDCGSESDLLALSNICLMGTNISSGTATAIVVATGSHTYFGSLAKSIVGTRSQTAFDRGVNSVSWLLIRFMIVMVPVVLLINGFTKGDWMEASLFALAVAVGLTPEMLPMIVSSNLAKGAIAMARRKVVVKRLNAIQNFGAMDVLCTDKTGTLTQDRIILEHHLNTQGQIDESVLQLAWLNSAHQSGMKNLMDQAIMHFGRHNPAISALGRYRKIDELPFDFIRRRLSIIVADEHNQQRLICKGAVEEMLAVATHVSENGQRHELDDERRNTLKKLAESYNQQGFRVLMIGTRELSPVGSTMPLSAVDERDLTLCGLLTFLDPPKESASAAIRALHENGVTVKVLTGDNAIITSKICRDVGLEPGEVLEGNEIDALSDEQLGVLVEQRTIFARLTPLQKSRVLKALQGNDHTVGFLGDGINDAPALRDADIGISVDTGTDIAKESADIILLEKNLMVLEEGIIKGRETFGNIIKYLNMTASSNFGNVFSVLVASAFIPFLPMLAIHLLIQNLMYDISQLSLPWDKMDKEFLRKPRKWDAKNIGRFMLFIGPTSSIFDITTYALMWFVFAANSVEHQALFQSGWFVEGLLSQTLVVHMLRTQKIPFIQSTAALPVMLMTGLVMALGIYLPFSPMGPLVGLQPLPWEYFPWLAATLIGYCTVAQLVKRAYIRRFGQWF

SEQ ID NO: 107815 - DNA, 2994 bp, Arabidopsis thaliana
  CDS (1)..(2994)
atggaagacgcctacgccagatctgtctcagaggtgcttgatttctttggggtagacccaacaaagggtctttctgattctcaggttgttcatcattccaggctttatggcaggaatgtactgcctgaagagaaaagaacgccattctggaaactggttctgaaacagtttgatgatttacttgtcaagatattgattgtggctgcaattgtttctttcgtattggctttggctaatggagagactggtttaacagcatttctggagccttttgtcattctgctgatattggctgcaaatgcggcagtgggggtgatcacggagactaatgctgagaaggctcttgaggagctacgtgcctaccaagcaaatatagctacagtgttgcgaaatgggtgcttctctatcctaccagcaacagagctggttccaggcgacattgttgaagttactgtgggatgtaagattccagctgacctgaggatgattgagatgtctagcaatacgtttcgagttgatcaagccattctaactggtgaaagctgttccgtggaaaaagatgttgactgtactttaacaacaaatgctgtctaccaaaacaagaaaaatattttattttcgggaactgatgtggtcgcgggtaggggaagggctgttgtcattggagttggttcaaacaccgcaatgggtagcatacacgattctatgttgcagacagatgatgaggcaactccattgaaaaagaagctggacgagtttggcagctttttggctaaggtaattgcgggtatttgtgtacttgtgtgggttgtcaacattggtcacttcagtgacccttctcatggtggattttttaaaggcgcaattcactattttaagattgcagttgcccttgctgttgcagctattcctgaaggacttcctgctgtcgtgacaacgtgtttagctcttggaacaaagaaaatggctcgtttgaatgctattgtacggtcattaccatctgtcgagacgcttgggtgcactactgtaatttgcagtgacaagactggaacattgacaaccaatatgatgtcggtgtctaagatatgtgtagtccaatctgcagagcatggtcctatgattaatgaattcactgttagtgggacaacttatgcaccagaaggtaccgtctttgacagcaatgggatgcagcttgacttacctgctcagtcaccttgccttcatcatttaacaatgtgttcatcactctgcaatgactccatcttgcaatacaatccagataaggattcttatgaaaaaattggagagtcaactgaagttgctcttcgagttcttgcagaaaaggttgggctccctggttttgattcaatgccttctgctctaaacatgttgagcaagcatgaacgtgcatcatattgcaaccattattgggaaaaccaattcaaaaaggtttatgttttggagtttactcgtgaccgaaaaatgatgagcgtcctatgtagccataagcaaatggatgttatgttctcaaagggtgctccagagagtataatagctaggtgtaataaaattctctgcaacggtgatggttctgttgttcctctaactgctgctggccgtgcagagcttgagtcgaggttttacagttttggcgatgaaacattgagatgcttagcattagcatttaagaccgtgccccacggtcaacaaactatttcctatgataatgagaacgacctgacgtttattgggttgggaatgcttgatccaccaagagaagaagtgagagatgctatgcttgcgtgtatgactgctgggatacgtgttatagttgttactggggataacaagtccacagcagagtcactatgtagaaaaataggggcttttgacaatctggtagacttttctggtatgtcctacaccgcttctgaatttgaacggcttccagcagtgcagcaaactctagcattgcgacggatgacacttttttccagggttgaaccttcccacaaaaggatgcttgttgaagccctacagaaacaaaacgaagtggtggcaatgactggtgatggcgttaatgatgcccctgcattgaagaaagctgacattgggattgccatgggttctggaacagctgtagcaaagagtgcttcagatatggttttggctgatgataattttgcttcaatagttgcggctgttgcagaaggaagggctatatataataacacaaagcaattcattagatacatgatttcttcaaatataggggaagtggtctgtatatttgttgcagctgtactgggaatccctgataccttggcacctgttcaacttctgtgggtcaatttggtaacagatggattgcctgccactgccattggctttaataaacaagattccgatgttatgaaggcaaaaccccgaaaggttggtgaagcagtggtcactgggtggttattcttccgctatttggttatcggagtttatgtcggcctggccactgttgctggctttatatggtggtttgtttactctgatggtggtcctaaacttacttacagtgaactgatgaactttgaaacttgcgcacttagagagacaacttatccctgcagcatatttgaggatcggcacccatctactgtggctatgacagtacttgttgttgtcgagatgtttaatgctctaaataacctcagcgaaaatcaatcccttctggttataaccccaaggagtaacttatggcttgttggttcaattatcctgacgatgcttctgcacgtgctaatattatatgttcatccactggcagtcttattttctgtcacgccattatcctgggccgagtggactgctgttctgtatctttcgtttccagttatcatcatcgatgagcttctgaagttcctctctagaaatacaggcatgagattcaggttcagattgaggaaggctgatttactccccaaggaccggcgtgacaagtag

SEQ ID NO: 107816 - protein, 997 aa, Arabidopsis thaliana
MEDAYARSVSEVLDFFGVDPTKGLSDSQVVHHSRLYGRNVLPEEKRTPFWKLVLKQFDDLLVKILIVAAIVSFVLALANGETGLTAFLEPFVILLILAANAAVGVITETNAEKALEELRAYQANIATVLRNGCFSILPATELVPGDIVEVTVGCKIPADLRMIEMSSNTFRVDQAILTGESCSVEKDVDCTLTTNAVYQNKKNILFSGTDVVAGRGRAVVIGVGSNTAMGSIHDSMLQTDDEATPLKKKLDEFGSFLAKVIAGICVLVWVVNIGHFSDPSHGGFFKGAIHYFKIAVALAVAAIPEGLPAVVTTCLALGTKKMARLNAIVRSLPSVETLGCTTVICSDKTGTLTTNMMSVSKICVVQSAEHGPMINEFTVSGTTYAPEGTVFDSNGMQLDLPAQSPCLHHLTMCSSLCNDSILQYNPDKDSYEKIGESTEVALRVLAEKVGLPGFDSMPSALNMLSKHERASYCNHYWENQFKKVYVLEFTRDRKMMSVLCSHKQMDVMFSKGAPESIIARCNKILCNGDGSVVPLTAAGRAELESRFYSFGDETLRCLALAFKTVPHGQQTISYDNENDLTFIGLGMLDPPREEVRDAMLACMTAGIRVIVVTGDNKSTAESLCRKIGAFDNLVDFSGMSYTASEFERLPAVQQTLALRRMTLFSRVEPSHKRMLVEALQKQNEVVAMTGDGVNDAPALKKADIGIAMGSGTAVAKSASDMVLADDNFASIVAAVAEGRAIYNNTKQFIRYMISSNIGEVVCIFVAAVLGIPDTLAPVQLLWVNLVTDGLPATAIGFNKQDSDVMKAKPRKVGEAVVTGWLFFRYLVIGVYVGLATVAGFIWWFVYSDGGPKLTYSELMNFETCALRETTYPCSIFEDRHPSTVAMTVLVVVEMFNALNNLSENQSLLVITPRSNLWLVGSIILTMLLHVLILYVHPLAVLFSVTPLSWAEWTAVLYLSFPVIIIDELLKFLSRNTGMRFRFRLRKADLLPKDRRDK

SEQ ID NO: 107817 - DNA, 2661 bp, Mesoplasma florum
  CDS (1)..(2661): transl_table=4
atgaaaaaactaaagaaattaaacaataatacaaaaattgaattaatcaattatgtagactctgataataataaattactaaaacaatttgaagtaaatagttttggtttaaacgatgaacaagttgaagtaaatagagaaaaatttggtggtaaagaattaaaaccagcaagatttaatgtttttcttgtatttgttaaatcatttttttcaccatttaatattattttaatggcgatcgatgcatttaacttttatgagtatgttagtgatccaaatacattttcactagtggctgctgttattgtgctaattatgatattagctagtggaacaatggcattcattcaagaaatcagatctcatttagttattaaaagaatgataactgagaataaaaaaacatcaaaagtcataagaaatatttcatacaactataaatcagtagataacgctaattcaattagaatgattaaagaagctgaagttattgaaaatgatgagttagttccaggagatgttatctatttagtgaatggagatattattccagctgatgttagaattatttgatcaaataatttatatgttaaccaatcatctttaactggtgaaagtttcccagtacaaaaaaaagattcacatgataaagaattcgaatctcatttaagttatgaaaacattggttatatgggaacagaagttatgtcaggtagtggattagcaattgtagttgctacagggcaaaaaacttatttctcattaattgataacaaagttaaagaaaaaagaaaaagttcttcatttgaaaaaggaattaaaagaattacattatacctaattgcatttatgattgctgtaattcctgttgttttattaatctcaggtttacaacaaggagattgagttaagggcgcaatgtttactatagctattgctgtaggtataacaccagaaatgttaccaattattgtaacttcaaacttaacaagaggttacaaacaaattgaaaaaaatggtgaaatgattgttaaaaatttaaattcagtacaaaacataggtgctattgatattttatgtacagataaaacaggaactattacaagtggtgaaattagtttagataaagtaactggagttaatggtgaaaaatcagaattcttagaaaatgttttatatctaaatagttatttccaatcaggattccaaaatcctattgatagtgctgttttgtcatcaaaaattaaaaaacctgatgtagatgattatacaaaagaatgagaaataccttttgactttgaaagaaaaatcttatctgtaattttaactagtaaaaaagataaagaaatttttacaaaaggtgcagtagaagaagttttaaaagtatgtaatagaatttctattaatggaaaaatagaaaaattagacgctaagctaaagaaaatgattttgaaaaaaactcatgaattaaacattgatggttaccgagtaattggtatagctcataatgttttacaagatgaagacgttgaagaagaactaattttttatggatttggtactttctttgataaacctaaaaaaacttcaaaaaaattaattaaaaatttagcatcaaaaggaatatcaacaaaagttcttactggtgataatgaaattattacaagagcaatctgtaaaaatgttgattttgaaattactaaactattttctggtgcagaaattgaagctatggatgatagacaattacacaaagctgttgttgaagctaatgtattcgtaaaattatcaccaattcataaatcaacaattattgcagcattacaagcgcaagggcatgtagttggtttcatgggagatggaattaatgatgctccagttcttagagaatctgatgtagctatttcatttagtgaagcatcaaatattgctcaagatgcagctgatatgatcttaacaagtgaatcattaatggctattgaaaatgctgttattgaaggacgtaagagtttggctaatatgcttaaatacattaaagtaacagttgcatcaaactttggtaacgttatatctgttattgttgcattgttcttaacaaaagaagagccaatgttagcattacatctattattacaaaacttattatatgactttgtaatgtttgctttagtttttgataatgtagatgaagagtttttacaaaaacctagaccatttacaaccaaaaatataatatggtttgcagttataaatggacctataagttctatatttgatatttcaacattcttagttttaatattcggatacaaattagtgccattccaaggaagtgtgcctgaaggaagcactaatgcaatgcaattccacgcttcttgatttgttgttggattaatgactcaaacagctgtaatgcaagtgtatagaactgaaaaaacaccatttatacaatctaaatgttcaatgtcaatgttaatagcaactattgtgatttgtttagctgctatattgattccatttacaccaattaatcaattggttcaaatgtcaacaccacactgatcatttatatttgtagcattgggatttgttggaacttatatagttctagcacaattagttaaaaaactatacatcaaaaaatttaaagaatgattataa

SEQ ID NO: 107818 - protein, 886 aa, Mesoplasma florum
MKKLKKLNNNTKIELINYVDSDNNKLLKQFEVNSFGLNDEQVEVNREKFGGKELKPARFNVFLVFVKSFFSPFNIILMAIDAFNFYEYVSDPNTFSLVAAVIVLIMILASGTMAFIQEIRSHLVIKRMITENKKTSKVIRNISYNYKSVDNANSIRMIKEAEVIENDELVPGDVIYLVNGDIIPADVRIIWSNNLYVNQSSLTGESFPVQKKDSHDKEFESHLSYENIGYMGTEVMSGSGLAIVVATGQKTYFSLIDNKVKEKRKSSSFEKGIKRITLYLIAFMIAVIPVVLLISGLQQGDWVKGAMFTIAIAVGITPEMLPIIVTSNLTRGYKQIEKNGEMIVKNLNSVQNIGAIDILCTDKTGTITSGEISLDKVTGVNGEKSEFLENVLYLNSYFQSGFQNPIDSAVLSSKIKKPDVDDYTKEWEIPFDFERKILSVILTSKKDKEIFTKGAVEEVLKVCNRISINGKIEKLDAKLKKMILKKTHELNIDGYRVIGIAHNVLQDEDVEEELIFYGFGTFFDKPKKTSKKLIKNLASKGISTKVLTGDNEIITRAICKNVDFEITKLFSGAEIEAMDDRQLHKAVVEANVFVKLSPIHKSTIIAALQAQGHVVGFMGDGINDAPVLRESDVAISFSEASNIAQDAADMILTSESLMAIENAVIEGRKSLANMLKYIKVTVASNFGNVISVIVALFLTKEEPMLALHLLLQNLLYDFVMFALVFDNVDEEFLQKPRPFTTKNIIWFAVINGPISSIFDISTFLVLIFGYKLVPFQGSVPEGSTNAMQFHASWFVVGLMTQTAVMQVYRTEKTPFIQSKCSMSMLIATIVICLAAILIPFTPINQLVQMSTPHWSFIFVALGFVGTYIVLAQLVKKLYIKKFKEWL

SEQ ID NO: 107819 - DNA, 2916 bp, Mesoplasma florum
  CDS (1)..(2916): transl_table=4
atggatagttgagagagtagtcagataaaagaaattgaaaataagttagatactgatataaaaacaggtttaacagaagaagaagcaacaaaaagacttatagagaatggtaaaaatgaattaccaactgcaaaggttactccttgatgagttacattcttgcatgcctttgttgaaccattacaattaatattaatgtttgctgctgttatatcagttgtagctccattaatttcatctcctggtgaaaaaataggttttcatgaatttatagactttgttgttattatgcttattgttattgttgatgctgttttagagacagttcaaacagttaaagctagaaagagtgttgacgcacttaaatcactttctaaaccaaaagctgtagttttaagagatcataatcaaaaagaaatagatgcatctgatcttgtagttggtgatattgtaattcttgaagctggtaaatatgtacctgctgaattaagaattgtacaatcagctgatttcatgattgatgaagcaattttaactggtgaatcagttcctgttgaaaaaacacacaaagcaataaaagagacaactatattagcagaaaaaactaatatagcattcatgtcaacatttactacagctggtagagctgttggtattgttattggaactggtttaaacacagaaatagggaaaatttcagaagctattgataaaaacgaagaaactgaaactccacttgagaaaaaaattagtaaatttggatatgtgattagttgtgtagctggtctaataggaatttttgttttcttattattatctttagttggtggatttgaagcatgagctagttatttaatggtggcaattactttagcaatcggtgttataccagaatcattggctgctgtaatttctattacattgagtttctcaacaaaaagaatggcaaataataatgttattgttaaaaaattagctagtgttgaaactttaggttcagttaatgttatttgtacagataaaactggaactttaactcaaaataaaatgacagttaaaaaagttattgataataatagaattatggattcagatgaatatcttgatttagataaaagtattcaaaaagaattattacttaaagctttagttttaccaaatgatagtattactgagggaaacgaaagaattggagatccaacagaattagcattagtagattttgcagaattaatgggtgttgatgaattagtttatcgtaagaaattcgaaagaattgatgaaataccttttgatagtgaaagaaagttaatgagtactttaaatactgttgataaaaaaacaatagcatttacaaaaggtgctattgaccaattattaagtatttgtgatcatataatgattgaaaacaaagttattaaattaactgaatctcataaacatgaaattatgcgcgcaagtattaatttaagtgatgatgctttaagagttttagcttttgcgtataaagaagttaaaaataataaacttgaagaaaaaggtcttacttttattggagcagttgcaatgattgacccagttagaaaagaagctgttcaagcaattgaagaagctcacgctgctggagttgaggtttgtatgattacaggtgatcatgcgattactgctttagctattgctagagatttaggattagcttatgaagaaaaacaagttatttcatcagataaacttgatactatgtctgatgcagaattggaagaagttattgataacataagagtgtttgctcgtgttaatccagaacataaagttaagattgttgctacattacagaaaaagggatatattgtctcaatgactggtgatggagtaaatgatgcaccaagtttaagcaaagctgatattggggttgctatgggtattacaggtactgatgtggctaaacaagccagtgatgttattttaactgatgataactttgcaactattatgactggagttaacgaaggaagaaacgtttatcaaaaaattaaacgagcaattactttattaatgggattcaacttggctaacgttttatctattttaataatttcattaatatttaaaatatcaccattagaagcaacaaatattttatatatcaacttaattgttgagtcatgtttagcgattgcgattggtatgggtcctttagatgatactttaatgaaactgaaaccacaggttggtaagaatggtttattaaaaggattaatattaccaataattaaaattggagtattatcagcattatgttctgttggttctttctttattggaatgatggcaacagatacaaaagcttgaatagattatgatttttatgctcaatttaaaattaactttgaattaagttcaacaacatgattaggtcaaattcatgaaatcatgaataatgtttcagatggtattataagaaataaaattttagatgaatatattgtatttggaagaacagcaatgtttataacaatagttatgtcaccattattctttgcacatttaattaaaatttctaattgaaaagcatcaaataaaattaaattacaaatttctaagcctttaatatatgcatcattaatagcattagtattatcaatcggagttataacaattcctggattaaatgatagtattttaggattagtaggatattcaaaagctacttcaaaatgaacaagtgataatatatgaattatgtttgtagcatttgcaatttcaattgttccgttcttattaatcttaatgatagatacaattgtattttactcatatcatttatcagttggtaattgacaaaaaaatcaaatattaattgctgaaatgattaaccaagatgctaaagaacaaaacaaaaaacgtaaaaaataa

SEQ ID NO: 107820 - protein, 971 aa, Mesoplasma florum
MDSWESSQIKEIENKLDTDIKTGLTEEEATKRLIENGKNELPTAKVTPWWVTFLHAFVEPLQLILMFAAVISVVAPLISSPGEKIGFHEFIDFVVIMLIVIVDAVLETVQTVKARKSVDALKSLSKPKAVVLRDHNQKEIDASDLVVGDIVILEAGKYVPAELRIVQSADFMIDEAILTGESVPVEKTHKAIKETTILAEKTNIAFMSTFTTAGRAVGIVIGTGLNTEIGKISEAIDKNEETETPLEKKISKFGYVISCVAGLIGIFVFLLLSLVGGFEAWASYLMVAITLAIGVIPESLAAVISITLSFSTKRMANNNVIVKKLASVETLGSVNVICTDKTGTLTQNKMTVKKVIDNNRIMDSDEYLDLDKSIQKELLLKALVLPNDSITEGNERIGDPTELALVDFAELMGVDELVYRKKFERIDEIPFDSERKLMSTLNTVDKKTIAFTKGAIDQLLSICDHIMIENKVIKLTESHKHEIMRASINLSDDALRVLAFAYKEVKNNKLEEKGLTFIGAVAMIDPVRKEAVQAIEEAHAAGVEVCMITGDHAITALAIARDLGLAYEEKQVISSDKLDTMSDAELEEVIDNIRVFARVNPEHKVKIVATLQKKGYIVSMTGDGVNDAPSLSKADIGVAMGITGTDVAKQASDVILTDDNFATIMTGVNEGRNVYQKIKRAITLLMGFNLANVLSILIISLIFKISPLEATNILYINLIVESCLAIAIGMGPLDDTLMKLKPQVGKNGLLKGLILPIIKIGVLSALCSVGSFFIGMMATDTKAWIDYDFYAQFKINFELSSTTWLGQIHEIMNNVSDGIIRNKILDEYIVFGRTAMFITIVMSPLFFAHLIKISNWKASNKIKLQISKPLIYASLIALVLSIGVITIPGLNDSILGLVGYSKATSKWTSDNIWIMFVAFAISIVPFLLILMIDTIVFYSYHLSVGNWQKNQILIAEMINQDAKEQNKKRKK

SEQ ID NO: 107821 - DNA, 2763 bp, Acinetobacter sp
  CDS (1)..(2763)
atgaaatatgatctatggcaacgtctatttactcgattcttagaaacatttcatctcaaacgtttttttgagcgtcatcgttcttttaaagaaatgcatcaatctagctatgccaaagagattggtcagactttatctcaacagcttaaagtccatgctcaaatggaaactggtgagcttttagaaaaattacacactgaacaagatggtttaacagaagcgcaagcctacctgcaacaacaaacatgtggtttaaatgaggttgctcaggaaaaaccgctcacgtggtggcagcatttatggtattgctatcgtaacccgtttaatgtgctgctgagccttctagcacttgttgcatttctgacagatgatttgacaggtggaatgatcatcacggtcatggttttactgtcaactttgcttcgttattggcaggagtctaaatcgaataaggctgctgaggcactcaaagccatggtcaccaatacggccatggtgttacgccaaaaggtcagcactcaagatcagattttattcaagcaacgctatggcgtcgaagttaagcagttaaagagtacacaatttgaaatgccaattcagtatcttgtgcctggcgatatcatcttgctttcagctggcgacatgattccagcagattgtcgtattttaactgcaaaagatttattcgtttcgcaggcagcaatgacaggagagtccatgcctgttgagaaatttgcgattccaaacacatcagatatcgattcgcctttagaacttgataatttactgtttatgggaactaacattgtttctggaacagcacgtgcagttgtgattagtaccggcattcaaacctattttggtgcgctggctcatcgcgtgactgcaacagatcatgcagtcacttctttccagttgggtgtcaataaagtcagttggttattgattcgctttatgttggtcatggcaccagtcgtcttgttgatcaatggttttaccaaaggtgattggggtgaggcggtattatttgctttatctgttgctgtaggtttaacgcccgaaatgctgccaatgattgtgacttcaacactggcaaaaggagcagtttttttatcgcgtaaaaaagtcattgtgaaacgactggatgcaatccaaaactttggtgcgatggatgtactttgtacagataaaactggaacattgacgcaggataaaatttttctatcacatcatgtcgatgtgttaggaaaaaaatcgcatgcagtcttgatgcaagccttcttaaacagttattaccagacagggcttaaaaacttgctggatgttgctgtgcttgaagcggttgatcaggacatgaagtttgaaaagctacgctttaaaaagctggatgaagtgccttttgattttgaacgccgcaggatgtctgtcgtggtacgcactccacagtgccaagtacgcatggtgaccaaaggagcagtcgaagaaattttaaaagtatgtactcgtgtcgagttgcaaggcgagatcaaagcactcactgctgatttgcgccgtgatatagaagcgattacgcagaattataaccgtgaagggttgcgcgttgttgcggtcgcatatggtgactttaatactgtacaagaaaatttttctgtggcagatgaaaatgatctgattctcattggttatcttactttcttagatccaccaaaagaatcagctcgacctgccatccagcaactgcatgcacatggtgtatctgtcaaagtattgactggcgataatgagttcgttacacaaaaaatatgttatgaaattggtattgcgcatgacaaggtgttgcttggtggagaaatcgaaaatttgtctgatgaacaacttaaagatgcggttgaacagcacactatttttgcaaagctgagccctattcataaagaacgtattgtcgatcagctcaaagccaatggtcatgttgtcggctttttgggtgatggaattaacgatgctgccgcaatacgttctgcagatattggtatctctgtcgattcggcagttgatattgccaaagagtctgccgatctgattttacttgaaaagagtttgatggtacttgaaaacggtgtgcttgaaggacgtcggacatttgccaatatgctcaaatatatcaaaatgaccgccagttcaaattttggtaatgttttttcagtattggtagccagtgcatttattccatttttaccgatgctcccgattcatctactggtgcaaaacttactttatgatgtatctcaaattgcaattccgttcgatcatgtcgatgaagaacaacttgaaaaaccgcaacgctggcagccttccgaggtagggcggtttatggtggtgtttggtccaatcagctctatttttgatattttgacgttttgtttaatgtggtttgtgtttcacgccaatacgccagaacatcaaaccttgtttcaatctggctggtttgtggttgggctgctcactcaaacgatggttgtacatatgattcggacgaagaaaattccatttattcaaagttgtgcagctacaccattattggtgatgactgtggtgatttgtgcaattgggatatttttacctatggggccgtttgcaaattactttaaacttgaagcgttatcttggacttacttcttatatctaccttttattttgtttgcctatatgtgtttgactcaatgggttaagcgtatgtatatccgtcgttacggatggcaataa

SEQ ID NO: 107822 - protein, 920 aa, Acinetobacter sp
MKYDLWQRLFTRFLETFHLKRFFERHRSFKEMHQSSYAKEIGQTLSQQLKVHAQMETGELLEKLHTEQDGLTEAQAYLQQQTCGLNEVAQEKPLTWWQHLWYCYRNPFNVLLSLLALVAFLTDDLTGGMIITVMVLLSTLLRYWQESKSNKAAEALKAMVTNTAMVLRQKVSTQDQILFKQRYGVEVKQLKSTQFEMPIQYLVPGDIILLSAGDMIPADCRILTAKDLFVSQAAMTGESMPVEKFAIPNTSDIDSPLELDNLLFMGTNIVSGTARAVVISTGIQTYFGALAHRVTATDHAVTSFQLGVNKVSWLLIRFMLVMAPVVLLINGFTKGDWGEAVLFALSVAVGLTPEMLPMIVTSTLAKGAVFLSRKKVIVKRLDAIQNFGAMDVLCTDKTGTLTQDKIFLSHHVDVLGKKSHAVLMQAFLNSYYQTGLKNLLDVAVLEAVDQDMKFEKLRFKKLDEVPFDFERRRMSVVVRTPQCQVRMVTKGAVEEILKVCTRVELQGEIKALTADLRRDIEAITQNYNREGLRVVAVAYGDFNTVQENFSVADENDLILIGYLTFLDPPKESARPAIQQLHAHGVSVKVLTGDNEFVTQKICYEIGIAHDKVLLGGEIENLSDEQLKDAVEQHTIFAKLSPIHKERIVDQLKANGHVVGFLGDGINDAAAIRSADIGISVDSAVDIAKESADLILLEKSLMVLENGVLEGRRTFANMLKYIKMTASSNFGNVFSVLVASAFIPFLPMLPIHLLVQNLLYDVSQIAIPFDHVDEEQLEKPQRWQPSEVGRFMVVFGPISSIFDILTFCLMWFVFHANTPEHQTLFQSGWFVVGLLTQTMVVHMIRTKKIPFIQSCAATPLLVMTVVICAIGIFLPMGPFANYFKLEALSWTYFLYLPFILFAYMCLTQWVKRMYIRRYGWQ

SEQ ID NO: 107823 - DNA, 2841 bp, Candida glabrata CBS138
  CDS (1)..(2841)
atggttgagagttatgtgatgaaagctgtggaagagagtgtggatgattctgtggaggagacgcatgagatgctgccgagtgcccctgtgctggatgaggaagcgtatgagctgctgaacaggcccaatccgagtctcaagttttgcacgctttctgtcggggagaccgtggagaatctcgagacggatgtggacaatgggttgtcgtcggaggaagaagtcgtgaagcggagggagatacatgggaggaacgatttcgaggaggatgacgacgagagcatgatcaagaagttcctgatgagctttgtggaggacaggctgatcctgctgctgatagggtcggcggtgctgtcatttgcgataggccagattgacgatgcagtgagtatatcgctcgcgatactgatcgtggtaaccgttgggttcatacaggagtacagatcagagaagtcccttgaggctcttaacaagcttgtgcccacgaagtgtcacctgatcaggtatggtagggagtctaatacgctggcgtcggagttggtccccggtgacctggtgcggttcaagatcggggacaggattcctgcggacgtgagaattatcgaggctgtagacctgtccattgatgaaagtaatctcacgggtgaaacagaaccgctgcataaggatgcgcagaccatcgacccagaagaatatgacaatcgtaatgttccagtctctgagagatcttgtatcgcttatatgggtactctggtcaaagaaggtcacggtaaaggtatcgttattggaaccggaacaaatacttcctatggtgctattttcgagatggtcaatagcattgaaaagcctaagacgccattacaggagacaatggacagattgggaaccgaactgtcatacattagtttcttcatcattgctattatttccatagtcggaatcattagaggtaactctttgctgatgatgttccaagtgtctgtgtccttggctgtcgctgcgatcccagaaggtctacctattattgtgactgttactttggctcttggtgtgttgagaatgaccaagcagaacgctattgtcagaaggttaccaagtgttgagactttgggatcagtcaatgttatttgcacagataaaactggtactcttactactaaccatatgacagtgtctaagttgttttgtttagacagtagtggaacatacgaaaacgcaatatctcctgaggaagattcagaattcgatgtacatgacaacgatgttaaggaaacgttaacaattgcaaatatttgcaacaacgcaaaatattccgaagaacacaatttgtatattggtaatcctactgatgtggctctgatagaagtgttgacaaaatttggtattcccgatcaaagggacagtcatgaaaagatggaagaactgtcatttaactcaaagagaaaatacatggctataaagagttccaaagaatcaggcgagcatgttttatacattaaaggtgcctttgaaagaattttagataagtctagctattatctcgacaaagctggtgaagtcagggaatttgatgaacactctaaggtaatggtcctcgaagcagcacattcgtgtgcttctgatgggttgcgtacgattgcatgcgctttcaaaccaactgattctgataatgttattagtgaagatgatatcaatggtttaaccttcacaggtctctttggtttagctgatcccccaaggccaaacgtcaaggcgtcgattgaaaaactgcatagaggtggagttcatatcatcatgattactggtgattctgtaaacacagcagttagtattgccgaaaagattggtctgtccgttcaagacagggagagttcagttatgacaggtgataaggtaagtgagctcactgaagatgagctttcgaaagtcattgataaagttaacatatttgctagagcaacacctgagaataagttgaatattgtcaaagctcttagaaaacgtggtgatatagttgcaatgacaggtgacggtgtaaacgatgcgccagctttaaagttagcagacatcggaattgctatgggaattagtggtacagacgttgccaaagaagtgtcagatatgattttgactgatgatgatttcagttctatattaacagctattgaagaaggtaagggtatttttaataatatcaggaatttcttgacgttccaattgtccatatcagttgctacactttcattaattgcaattactactattgcaaaattacctgcgcccttaaacccaatgcaaattttgtggatcaatattatcatggacggtccgccagcacaatcacttggtgttgaacctgttgactctgatgttatggacaagccacctagaagtagagaggaaagaattttgaacatgaacatacttttgagattattatacctggccatatgtatattggtagggaccttttacatatttttgaaaggtatggacgaaaatcagcaaaccacttcaaaggacattaccatgacatttactgggtttgttttctttgctatttttaatgctgttgcatgtaggcatacaacgaagtctatcttccaaatcggcttatttagcaacaggatatttaatatcgctattttattgtctgtctgtggtcaaatgtgtgctgtctatattccatttttccagcatatcttcaagactgagaatttgggattttatgatttattaacacttgtacttgttagtagtagtgttctcattgttgatgaaattagaaaagctatttacgctctagcaagagtgaatgagccagtatactcctctgaagtttaa

SEQ ID NO: 107824 - protein, 946 aa, Candida glabrata CBS138
MVESYVMKAVEESVDDSVEETHEMLPSAPVLDEEAYELLNRPNPSLKFCTLSVGETVENLETDVDNGLSSEEEVVKRREIHGRNDFEEDDDESMIKKFLMSFVEDRLILLLIGSAVLSFAIGQIDDAVSISLAILIVVTVGFIQEYRSEKSLEALNKLVPTKCHLIRYGRESNTLASELVPGDLVRFKIGDRIPADVRIIEAVDLSIDESNLTGETEPLHKDAQTIDPEEYDNRNVPVSERSCIAYMGTLVKEGHGKGIVIGTGTNTSYGAIFEMVNSIEKPKTPLQETMDRLGTELSYISFFIIAIISIVGIIRGNSLLMMFQVSVSLAVAAIPEGLPIIVTVTLALGVLRMTKQNAIVRRLPSVETLGSVNVICTDKTGTLTTNHMTVSKLFCLDSSGTYENAISPEEDSEFDVHDNDVKETLTIANICNNAKYSEEHNLYIGNPTDVALIEVLTKFGIPDQRDSHEKMEELSFNSKRKYMAIKSSKESGEHVLYIKGAFERILDKSSYYLDKAGEVREFDEHSKVMVLEAAHSCASDGLRTIACAFKPTDSDNVISEDDINGLTFTGLFGLADPPRPNVKASIEKLHRGGVHIIMITGDSVNTAVSIAEKIGLSVQDRESSVMTGDKVSELTEDELSKVIDKVNIFARATPENKLNIVKALRKRGDIVAMTGDGVNDAPALKLADIGIAMGISGTDVAKEVSDMILTDDDFSSILTAIEEGKGIFNNIRNFLTFQLSISVATLSLIAITTIAKLPAPLNPMQILWINIIMDGPPAQSLGVEPVDSDVMDKPPRSREERILNMNILLRLLYLAICILVGTFYIFLKGMDENQQTTSKDITMTFTGFVFFAIFNAVACRHTTKSIFQIGLFSNRIFNIAILLSVCGQMCAVYIPFFQHIFKTENLGFYDLLTLVLVSSSVLIVDEIRKAIYALARVNEPVYSSEV

SEQ ID NO: 107825 - DNA, 2856 bp, Candida glabrata CBS138
  CDS (1)..(2856)
atgagtgataacccgtttacctactatgataaggataaagatgccggtggaagtagtgcttctctgaactcgcaggaaaaggagattctggaggccacaaatgccgctcttactaagccaaacccctctctggaatactgtacattgagtgtggaagagactttacataaattggataccgatgccaagctaggtctttcttctgtagaagaagccaccaagagaagacaatattatggtccaaatgaaatcagtgtcgatgacgatgaaagtttggtaaagaagttcttgtccaattttgttgaagacaggctaatattgttgttaatgggttctgctattatttcggtcttcttaggtaacattgatgacgctatcagtatcaccatggccattgttattgttgtcactgtcggttttgtgcaagaatacagatctgagaaatcgttggaagccctaaataaattggttccacaagaatgccatttgatcagaggcggtagagaatcgaacgtcctggcgacaaatttggttcctggtgatctagttcgttttagaattggtgaccgtatcccagccgatataagaattatagagtgtaatgatttgactattgatgagagtaacctaaccggtgaaactgatcctgttcataaaagttataaagctctttcccgggacagttacaatgatcaaccaaattctattgttccagtggctgagcgtactaatattgcatacatgggaacgttggtaaaagaaggtaatggtagaggtattgttgttggtactggtagagagacatcttttggtaacgtttttgaaatgatgagcagtattgaaaaacctaagaccccgctacaattaaccatggacaagcttggtaaagatttatcattagcaagttttgttgtaattggtattatttgtgttgtcggtatcatccaaggcagatcttggttagaaatgttccaaatttcagtctcacttgctgttgccgctattcctgaaggtttacctattattgtgactgtcactttagcactaggtgtactacgtatggctaagcgtaaagctattgttaggagattgcctagtgttgaaaccttgggctctgttaatgtcatttgttctgataagacgggtactttaacatcgaatcatatgactgtttcgaagatatggtgtttgggtagtatggctaacaaattaaatgttctatctcttgataaaaataaaggcggtaatttgaagaattacttaactgatgatgtcaagaccactttactttgtggtaacttgtgtaacaatgcatcatattctcaagagcatgcaaagtatttaggtaatccaacagacgtggccttattagagcagctgcaaaagtttgaactagctgatgtaagaagtgaatataccaaggtaaaagaactttccttcaactcaaaaagaaagatgatggcaactaaaatccaggataatgagaaaaagacaactctatttataaaaggtgctttcgagagaattttggacaagtcttcttcttatcttacagaaaagggaaaaattgagaagctgactgcaggacatagggaaaccattattgactgtgccaacacattggcttctgaaggtctacgagttttggcgtttgcaaaaagagctatgacggactcaagttctaaactggttgaagatgacataagtgatttggtttttactggtttgattggtatgaatgatcctcctagatcttctgttaaatttgcaattgatcaatttttgcaaggtggtattcatatcattatgataactggtgactctgaaaatacagctgttaacattgcaagacagataggtattccagtaatcgatccaaagctttccgttctaagtggtgataaattgaatgaaatgactgatgaccaattggccaatgtgattgatcatgttaatatttttgcccgtgctacaccagaacataaattgaacattgttcgtgctctaagaagaagaggtgatgtggtggctatgactggtgatggtgttaatgatgcaccagccttaaaattagctgatatcggtgtatctatgggtagaatgggaactgatgtggcaaaagaagcctctgatatgattttgacagatgatgattttagcaccatcctgactgctatagaagaggggaaaggtatttttaacaacattcaaaactttttgtcgttccaattatcaacctctattgcagccttgtctttggttgccctttctacagcattcatgttaccaaatccattaaatgcaatgcagattttatggattaacattttaatggatggaccacctgcacagtcattaggtgtagaaccagttgatcatgaagttatgaaaaaaccaccaagaaagcgtactgataaaatattgaccgcagagttgctaaagaggttgattgggacagcatcatgtatcattttaggtactgtttacgttttcgttaaagagatggcagaagatgggcaagttactgcaagagacacaactatgacattcacttgcttcgttttctttgacatgtttaatgccttagcttgcagacacacaacgaagtctatttttgaaattggttttttcacaaataagatgtttaacctagcggtgggtttctctttgttaggtcaaatgtgtgccatttatattccattcttccaagcaatctttaagacagaaagtcttgcatttagtgatttgattttcttggcaatgatcagtagcagcgtcttcattatcgatgagattagaaaatactgggtgaagaagaattcacatatggatcctttacgctactctatcgtgtaa

SEQ ID NO: 107826 - protein, 951 aa, Candida glabrata CBS138
MSDNPFTYYDKDKDAGGSSASLNSQEKEILEATNAALTKPNPSLEYCTLSVEETLHKLDTDAKLGLSSVEEATKRRQYYGPNEISVDDDESLVKKFLSNFVEDRLILLLMGSAIISVFLGNIDDAISITMAIVIVVTVGFVQEYRSEKSLEALNKLVPQECHLIRGGRESNVLATNLVPGDLVRFRIGDRIPADIRIIECNDLTIDESNLTGETDPVHKSYKALSRDSYNDQPNSIVPVAERTNIAYMGTLVKEGNGRGIVVGTGRETSFGNVFEMMSSIEKPKTPLQLTMDKLGKDLSLASFVVIGIICVVGIIQGRSWLEMFQISVSLAVAAIPEGLPIIVTVTLALGVLRMAKRKAIVRRLPSVETLGSVNVICSDKTGTLTSNHMTVSKIWCLGSMANKLNVLSLDKNKGGNLKNYLTDDVKTTLLCGNLCNNASYSQEHAKYLGNPTDVALLEQLQKFELADVRSEYTKVKELSFNSKRKMMATKIQDNEKKTTLFIKGAFERILDKSSSYLTEKGKIEKLTAGHRETIIDCANTLASEGLRVLAFAKRAMTDSSSKLVEDDISDLVFTGLIGMNDPPRSSVKFAIDQFLQGGIHIIMITGDSENTAVNIARQIGIPVIDPKLSVLSGDKLNEMTDDQLANVIDHVNIFARATPEHKLNIVRALRRRGDVVAMTGDGVNDAPALKLADIGVSMGRMGTDVAKEASDMILTDDDFSTILTAIEEGKGIFNNIQNFLSFQLSTSIAALSLVALSTAFMLPNPLNAMQILWINILMDGPPAQSLGVEPVDHEVMKKPPRKRTDKILTAELLKRLIGTASCIILGTVYVFVKEMAEDGQVTARDTTMTFTCFVFFDMFNALACRHTTKSIFEIGFFTNKMFNLAVGFSLLGQMCAIYIPFFQAIFKTESLAFSDLIFLAMISSSVFIIDEIRKYWVKKNSHMDPLRYSIV

SEQ ID NO: 107827 - DNA, 2709 bp, Candida glabrata CBS138
  CDS (1)..(2709)
atgtccgacgttgaatccaacaacgagaagccacctcaggacgtctacgaagacgaggagatgtccgaggatgacgacatcgacgccttgatcgaggagttgcaatcccaccacggtatgggcgacgacgacgacagcgaggacgagggccaccacactggctccgcccgtgtcgtcccagaggagtacttgcaaaccgacccatcctacggtttgacctccgacgaggtcgctcacagacgtaagaagtacggtctgaaccaaatggccgacgaaagagagtccatgatcgtcaagttcgtcatgttcttcgttggtcctatccaattcgttatggaagccgccgctatcttggccgccggtctgtctgactgggtcgatttcggtgttatctgtggtctgctaatgttgaacgcctgtgtcggtttcatccaagaattccaagccggttccatcgtcgacgaactaaagaaaaccttggctaacgtcgccgttgtcatcagagatggtcaattggtcgaagtcccagctaacgaggttgtccctggtgatatcttgcaattggaagacggtaccatcatcccagccgatggtcgtctagtcactgaaaactgtttcctacaagtcgatcaatccgctatcactggtgaatccctggctgttgacaagggttacggtgaccaaactttctcttcctccactgtcaagagaggtgaagccttcatggtcgttaccgctaccggtgacaacaccttcgtcggtagagccgccgctttggtcaacaaggcctccggtggtcaaggtcacttcactgaagtcttgaacggtatcggtatcttgctattggttttggtcattgtcaccttgttgggtgtctgggctgcttgtttctacagaactgacaacatcgttaagatcttgagatttactctaggtattaccattatcggtgtcccagtcggtttgccagctgtcgttaccaccaccatggctgtcggtgctgcttacttggctaagaagcaagccatcgtccaaaagttgtccgctattgaatccttggctggtgtcgaaatcttgtgttccgacaagaccggtactttgaccaagaacaagctttctttgcacgaaccatacactgtcgaaggtgtctctgcagatgacttgatgttgaccgcttgtttggctgcttccagaaagaagaagggtctagatgctatcgacaaggctttcttgaagtccttgatcaactatccaaaggctaaggacgctttgaccaagtacaaggtcattgagttccacccattcgaccctgtctccaagaaggttaccgctgttgttgaatccccagaaggtgaaagaatcgtctgtgttaagggtgctccattgttcgtcctaaagactgtcgaagaagaccacccaatcccagaagatgtccacgaaaactacgaaaacaaggtcgctgaattggcttccagaggtttcagagcccttggtgtcgccagaaagagaggtgaaggtcactgggaaatcttgggtgttatgccatgtatggatccaccaagagatgacactgctgaaactgttaacgaagctagaagactaggtttgagagttaagatgttaactggtgatgccgtcggtatcgctaaggaaacctgtagacaattgggtctaggtaccaacatttacaacgctgaaagactaggtctaggtggtggtggtgacatgccaggttctgaattggctgactttgttgaaaacgccgatggtttcgctgaagttttcccacaacacaagtacaaggtcgtcgaaattttgcaaaacagaggttacttggttgctatgactggtgacggtgttaacgatgccccatctttgaagaaggctgacactggtatcgctgtcgaaggtgcttctgatgctgctagatccgctgctgatattgttttcttggccccaggtttgtctgctatcatcgatgctttgaagacctccagacaaattttccacagaatgtactcttacgttgtctaccgtatcgctttgtctcttcacttggaattgttcttgggtctatggattatcatcttgaaccactccttggacattgagttgattgttttcattgccattttcgccgacgtcgctactttggccattgcttacgacaacgctccattctctcaaactcctgttaagtggaacctaccaagactatggggtatgtccattatcttgggtattgtgttggctatcggtacctggatctgtttgactaccatgttcttgccaagaggtggtatcatccaaaacttcggttccattgacggtgttcttttcttgcaaatctctttgactgaaaactggttgattttcgtcaccagagccgttggtccattctggtcttccatcccatcctggcaattggccggtgctgtgttcgccgttgacatcattgctaccatgttcactctattcggctggttctctcaaaactggaccgacattgtcaccgttgttaagatctacatctggtctatcggtgtcttctgtgtcttgggtggtttctactacatcatgtctgaatccgttgttttcgacagactaatgaacggtaagccattgaaggaagagaagtccaccagatctgtcgaagatttcttggctgctatgcaaagagtctccactcaacacgaaaaggaaaactaa

SEQ ID NO: 107828 - protein, 902 aa, Candida glabrata CBS138
MSDVESNNEKPPQDVYEDEEMSEDDDIDALIEELQSHHGMGDDDDSEDEGHHTGSARVVPEEYLQTDPSYGLTSDEVAHRRKKYGLNQMADERESMIVKFVMFFVGPIQFVMEAAAILAAGLSDWVDFGVICGLLMLNACVGFIQEFQAGSIVDELKKTLANVAVVIRDGQLVEVPANEVVPGDILQLEDGTIIPADGRLVTENCFLQVDQSAITGESLAVDKGYGDQTFSSSTVKRGEAFMVVTATGDNTFVGRAAALVNKASGGQGHFTEVLNGIGILLLVLVIVTLLGVWAACFYRTDNIVKILRFTLGITIIGVPVGLPAVVTTTMAVGAAYLAKKQAIVQKLSAIESLAGVEILCSDKTGTLTKNKLSLHEPYTVEGVSADDLMLTACLAASRKKKGLDAIDKAFLKSLINYPKAKDALTKYKVIEFHPFDPVSKKVTAVVESPEGERIVCVKGAPLFVLKTVEEDHPIPEDVHENYENKVAELASRGFRALGVARKRGEGHWEILGVMPCMDPPRDDTAETVNEARRLGLRVKMLTGDAVGIAKETCRQLGLGTNIYNAERLGLGGGGDMPGSELADFVENADGFAEVFPQHKYKVVEILQNRGYLVAMTGDGVNDAPSLKKADTGIAVEGASDAARSAADIVFLAPGLSAIIDALKTSRQIFHRMYSYVVYRIALSLHLELFLGLWIIILNHSLDIELIVFIAIFADVATLAIAYDNAPFSQTPVKWNLPRLWGMSIILGIVLAIGTWICLTTMFLPRGGIIQNFGSIDGVLFLQISLTENWLIFVTRAVGPFWSSIPSWQLAGAVFAVDIIATMFTLFGWFSQNWTDIVTVVKIYIWSIGVFCVLGGFYYIMSESVVFDRLMNGKPLKEEKSTRSVEDFLAAMQRVSTQHEKEN

SEQ ID NO: 107829 - DNA, 2667 bp, Bacillus thuringiensis
  CDS (1)..(2667)
atgagcaattggtacagtaagacgaaagaccaaacattaattgacctagaaacaaatgaacaacacggtttaacagaggaaattgtaaatgaacgtttaacgcaatacggtgctaatgaattagctacaaaacaaaaacgctctttatggcagcgtatttttgcccaaattaatgacgtcctcgtatatgtccttattattgctgcccttatttctgcctttgtaggtgaatgggctgatgcaagtattattgcgcttgttgtagttttaaatgctgttatcggcgtcgtccaagaatcgaaagcagaacaagccttagaggcattgaaaaagatggcgacacctaaagctatcgtcaagcgagatggtgaactaaaagaaattccatctgagcacgtcgttccaggtgatgtcgttatgctcgacgccggacgatatatcccatgcgatctacgccttatcgaaaccgcaaatttaaaagttgaagaatctgctctaactggtgaatctgtccctgttgataaagatgcaatctaccacccttccatgcaaagtgatgaacaagtaccactcggcgatcaaaaaaatatggcctttatgtctactcttgtaacatacggaagaggcgtcggtgttgctgttgaaactggaatgaactcacaaattggtaagattgctaccctgttacatgaagcagacgatgatatgacaccactccaaaaaagcttagctcaagtcggaaagtatttaggctttgtcgctgtagctatttgtatcgtgatgtttctcatcggctttttacaaggacgagatacactagaaatgtttatgactgctattagtttagccgttgcagctattccagaaggtttgccagctatcgtttccatcgttcttgcaattggtgtgcagcgtatgattaaacaaaatgttatcattcggaagctaccagctgtcgaagctctcggttctgtcacaattatttgttcagataaaacaggtacgttaacacaaaataaaatgaccgttactcacttttatagtgataacacatacgatcaattagaacgtttaaatgtaaataatgatacacaacgtctattgttagaaaatatggtgctatgtaatgatgcgtcttacaacaatgaatcacaaacgggggacccgactgaaattgcccttcttgttgccggaagcacttttaacatgcaaaaagatcatttagaaaaaatacatgaacgtgttaatgagctacctttcgattcagatcgtaaaatgatgtcaaccgtgcatacatacgatgaaagctactatagtatgacgaaaggtgctatcgataaactcttacctctatgtacccacatatttaaaaacggtaaaatcgagggtctaacagaggatgataaaaatcaaatattagaagctgctgaggtaatgtctcaagaagctttaagagtactttcattcgcatttaaacaatacaactcaagcgatgtggatatagatcatcttgaagaaaacctcatctttattggtcttgtcggtatgattgatccaccgcgaactgaagtaaaagactcaatttcagaatgtaaaaaagctggtattcgtacagttatgattactggtgaccataaagatactgcctttgcaattgccaaagaacttggcattgctgaagaaatatctgaaattatgattggaactgaattagataacatttcagatacagaactagcaaacaaaattaatcacttacatgtattcgctagggtctctccagaacataaagtaaagattgtaaaagcattacgcgcgaaaggcaatatcgtttctatgactggtgatggtgtcaatgacgctccatctttaaagcaagctgatgttggcgtagcgatgggcattacaggaacagacgttgcaaaaggggcagcggatgtcgtattaacagacgataatttctcatctatcgtgaaagctgttgaggaaggtagaaacatttatcgtaacataaaaaaatcaattctcttcctactctcttgtaactttggagaaattatcgctttatttttagcgattttacttggctgggcgacaccattacgaccaattcacattttgtgggtgaatttaattacagatacactacctgcattgtcacttggtgttgaccctgaagatcctgatgtgatgaaggaaaaaccacgacatgcgaaagaaagcttatttagcggtagcgttccttttcttattttcaatggggctgtcattggacttttaacgctaatagcctttatcgctggagcaaagttctatactggagatacaaatttattccctcttttcccagagcgaattgatgaagatgctctattacatgctcaaacgatggcatttgttgttcttagtttttctcagcttgttcattcatttaacttgcgctcaagaacgaaatcgattttttcaattgggatttttacaaataaatatttagtcttctcccttcttatcggtgttcttatgcaagtttgtatcatctccatcccgccccttgcaaatatattcggtgtgcatgcactaacgatgcgagattggggatttgttcttttattaagtatcattccgcttgttgtgaatgagttcattaaattagtgaagcgaaactaa

SEQ ID NO: 107830 - protein, 888 aa, Bacillus thuringiensis
MSNWYSKTKDQTLIDLETNEQHGLTEEIVNERLTQYGANELATKQKRSLWQRIFAQINDVLVYVLIIAALISAFVGEWADASIIALVVVLNAVIGVVQESKAEQALEALKKMATPKAIVKRDGELKEIPSEHVVPGDVVMLDAGRYIPCDLRLIETANLKVEESALTGESVPVDKDAIYHPSMQSDEQVPLGDQKNMAFMSTLVTYGRGVGVAVETGMNSQIGKIATLLHEADDDMTPLQKSLAQVGKYLGFVAVAICIVMFLIGFLQGRDTLEMFMTAISLAVAAIPEGLPAIVSIVLAIGVQRMIKQNVIIRKLPAVEALGSVTIICSDKTGTLTQNKMTVTHFYSDNTYDQLERLNVNNDTQRLLLENMVLCNDASYNNESQTGDPTEIALLVAGSTFNMQKDHLEKIHERVNELPFDSDRKMMSTVHTYDESYYSMTKGAIDKLLPLCTHIFKNGKIEGLTEDDKNQILEAAEVMSQEALRVLSFAFKQYNSSDVDIDHLEENLIFIGLVGMIDPPRTEVKDSISECKKAGIRTVMITGDHKDTAFAIAKELGIAEEISEIMIGTELDNISDTELANKINHLHVFARVSPEHKVKIVKALRAKGNIVSMTGDGVNDAPSLKQADVGVAMGITGTDVAKGAADVVLTDDNFSSIVKAVEEGRNIYRNIKKSILFLLSCNFGEIIALFLAILLGWATPLRPIHILWVNLITDTLPALSLGVDPEDPDVMKEKPRHAKESLFSGSVPFLIFNGAVIGLLTLIAFIAGAKFYTGDTNLFPLFPERIDEDALLHAQTMAFVVLSFSQLVHSFNLRSRTKSIFSIGIFTNKYLVFSLLIGVLMQVCIISIPPLANIFGVHALTMRDWGFVLLLSIIPLVVNEFIKLVKRN

SEQ ID NO: 107831 - DNA, 2853 bp, Oryza sativa
  CDS (1)..(2853)
atggcctccatctccctcgaggacgtccgcaatgagaccgtcgacctcgagacgatcccggtggaggaggtgttccagcacctgaaatgcagcaagcaggggctgtcggcagcggagggacagaacaggctcaacatcttcgggccaaacaagctggaggagaagacggagagcaagctgctcaagttcttgggtttcatgtggaatcccctctcctgggtcatggaggccgccgccatcatggccatcgtcctcgccaacggcggcgggaggccgcccgactggcaggacttcgtcggcatcgtcgtcctcctcgtcatcaactccaccatcagtttcatcgaggagaacaatgccgggaacgccgccgcggcgctcatggccggcctcgcgcccaagaccaaggtgctcagggacgggaaatggcaggagcaggacgcgtccatcctcgttcccggcgacatcatcagcatcaagctcggcgacatcatccccgccgacgcgcggctgctcgagggcgacccgctcaaggtcgaccaggcggcgctcaccggcgagtcgatgcccgtcaacaagcacgccgggcagggcgtcttctccgggtccaccgtcaagcagggcgagatcgaggccgtcgtcatcgccaccggcgtgcacaccttcttcggcaaggcggcgcacctggtggacagcaccaacaacatcggccacttccagctcgtgctcacggccatcggcaacttctgcatcatctccatcggcgtcggcatgataatcgagatcatcgttatgtacccgatccagcaccgcgcgtaccgcgacggcatcgacaacctgctcgtcctgctcatcggcggcatccccatcgccatgcccaccgtgctgtccgtcaccatggccatcggctcccaccggctgtcgcagcagggcgccatcaccaagcggatgaccgccatcgaggagatggccggcatggacgtgctctgcagcgacaagaccgggacgctgacgctcaacaagctcaccgtcgacaagacgctgatcgaggtgtacgggcgggggctggacaaggactcggtgctcctgtacgcggcgagggcgtcccgcgtcgagaaccaggacgccattgacacatgcatcgtgggcatgctcgccgaccccaaggaggcccgcgccggcatcaaggaggtccacttcctcccgttcaaccccgtcgagaagcgcacggccatcacctacatcgacggcaatggcgaatggcacaggatcagcaagggcgcgccggagcagatcatcgagctgtgcaagatgagcaaggacgccgagaagaaggtgcacacgctgatcgaccagtacgcggaccgcggcctccggtcgctgggcgtgtcgtaccagaaggtgccggagaagagcaaggagagcgagggcgagccatggcagttcgtcggcctcctgccgctgttcgacccgccgaggcacgacagcgcggagaccatccgccgcgcgctgcacctcggcgtgaacgtgaagatgatcaccggcgaccagctcgccatcgggaaggagacggcgcggcggctcgggatgggcaccaacatgtacccgtcgacgacgctgctgggcgacaagagcagcgagatgagcggcctccccatcgacgagctgatcgagaaggccgacggcttcgccggcgtgttcccggagcacaagtacgagatcgtgaagcgcctccaggaccggaagcacatctgcggcatgaccggcgacggcgtgaacgacgcgccggcgctgaagaaggccgacatcggcatcgccgtcgacgacgccacggacgccgcccggagcgcgtcggacatcgtgctcacggagccggggctcagcgtcatcgtcagcgccgtgctcacctcccgcgccatcttccagcggatgaagaactacaccatctacgccgtctccatcaccatccgcatcgtcctcggcttcatgctcgtcgccctcctctggaagttcgacttcgccccattcatggtgctcatcatcgccatcctcaacgacggcaccatcatgacaatctccaaggaccgtgtcaagccgtccccgaccccggactcgtggaagctcaaggagatcttcgccacgggcatcgtgctcggcacgtacatggcgctcatcaccgccctcttcttctacctcgcgcacgacaccgacttcttcacagagacgttcggggtgaggtcgatcaagacgaacgagaaggagatgatggcggcgctgtacctgcaggtgagcataatcagccaggcgctcatcttcgtgacgaggtcgcggagctggtcgttcgtggagaggccaggggcgctgctggtgatcgcgttcctggcggcgcagctggtggcgacgtgcatcgcggtgtacgcggagtgggagttctgcaagatgcaggggatcgggtgggggtggggaggggcgatctgggcgttcagcgtggtgacctacttcccgctggacgtgctcaagttcatcatccggtacgcgctgagcgggcgggcgtggaacaacatcaacaacaagacggcgttcgtgaacaagaacgactacgggaagggggagcgggaggcgcagtgggcgacggcgcagaggacgctgcacgggctcaaccagtcgtccaccagctccgacctcttcaacgacaagaccggctaccgcgagctctccgagatcgccgagcaggccgcaaagcgagccgaggtcgccagactgagggagttgcacacgctcaaggggcacgtagagtcggtggtgaagctcaaggggctcgacatcgacacaatccaacagagctacaccgtgtaa

SEQ ID NO: 107832 - protein, 950 aa, Oryza sativa
MASISLEDVRNETVDLETIPVEEVFQHLKCSKQGLSAAEGQNRLNIFGPNKLEEKTESKLLKFLGFMWNPLSWVMEAAAIMAIVLANGGGRPPDWQDFVGIVVLLVINSTISFIEENNAGNAAAALMAGLAPKTKVLRDGKWQEQDASILVPGDIISIKLGDIIPADARLLEGDPLKVDQAALTGESMPVNKHAGQGVFSGSTVKQGEIEAVVIATGVHTFFGKAAHLVDSTNNIGHFQLVLTAIGNFCIISIGVGMIIEIIVMYPIQHRAYRDGIDNLLVLLIGGIPIAMPTVLSVTMAIGSHRLSQQGAITKRMTAIEEMAGMDVLCSDKTGTLTLNKLTVDKTLIEVYGRGLDKDSVLLYAARASRVENQDAIDTCIVGMLADPKEARAGIKEVHFLPFNPVEKRTAITYIDGNGEWHRISKGAPEQIIELCKMSKDAEKKVHTLIDQYADRGLRSLGVSYQKVPEKSKESEGEPWQFVGLLPLFDPPRHDSAETIRRALHLGVNVKMITGDQLAIGKETARRLGMGTNMYPSTTLLGDKSSEMSGLPIDELIEKADGFAGVFPEHKYEIVKRLQDRKHICGMTGDGVNDAPALKKADIGIAVDDATDAARSASDIVLTEPGLSVIVSAVLTSRAIFQRMKNYTIYAVSITIRIVLGFMLVALLWKFDFAPFMVLIIAILNDGTIMTISKDRVKPSPTPDSWKLKEIFATGIVLGTYMALITALFFYLAHDTDFFTETFGVRSIKTNEKEMMAALYLQVSIISQALIFVTRSRSWSFVERPGALLVIAFLAAQLVATCIAVYAEWEFCKMQGIGWGWGGAIWAFSVVTYFPLDVLKFIIRYALSGRAWNNINNKTAFVNKNDYGKGEREAQWATAQRTLHGLNQSSTSSDLFNDKTGYRELSEIAEQAAKRAEVARLRELHTLKGHVESVVKLKGLDIDTIQQSYTV

SEQ ID NO: 107833 - DNA, 2346 bp, Picrophilus torridus
  CDS (1)..(2346)
atgcaggaaataaaaaagaaaattgatatgatccaattaatgaaggatctaaagacttcaaacaatggtctttctgattccgaggcgggttcaaggcttaacagctatggttacaatgaggtaaccgagaagaaggatagtatatacattaaattacttaaaaaattctgggctcctgttccatggatgcttgaggtaacctccataataacatatataataggaaggtacattgatacatatataatactgttcctgctttttttcaatgcaatcattggcttttttcaggaatcaagggcggaaaacgccgttgaattattaaaaaagaggctccaggttacatccagggttctaagaaatggaaaatgggaattgctcgaatcaatttatatcgttcctggagatataattaatgtaaggcttggtgacattgtaccggcagactgtgcaataatctcaggaaacgttgaaacagaccagtccgcactcacaggcgaatcattatctgtttcaaagggtgtttcagatcagctcttttcgggctctgtcataaagcgcggtgaggcaacagccgtggtcatggcaaccggagataaaacatactttggcaaaacggcaatgcttgtaagtgaggcaggttctaaatcgcatatagaatcacttatctttaatattgttaaatatcttataatacttgatgtctcgcttgttattataacaacaatttattcaattttaattaatgttccatttaatgatattatcccgttttcacttgtgcttcttataacttcaatacctgtggcactgcccgcaacctttacgatagcgatggccattggtgcaatggacatggcaaaaaagggatccattgtaacaaggttaaatgcaatagaggatgccgcatcaatggatatactttgctcagataaaacaggaacgataacagagaatgttcttacagtaagggatccatatcctgttggatgcagcatcaacgaactcatggaactggccatgtatgcatcagaggagaaatcagaggatccaatagatattgcaataataaattttgcaaggaatatgaaaataaatgttgattataataatgtaaaaaattttattccctttgatcctgcaacaaaaagaaccgaggctgttgttttaaaaaatggtaaaacaacaagaattttaaagggtgcaccgcaggttatagcaggcctttgcggccttgattaccaggaaatatcatcaaaaattgatgagtttgcccgctttggctaccgtgtaatagctgtggccaccattgatgaaaagcctgcttttaaaggcttaataccaatgtatgatcctccaagaaaggattccgctgagttaataaaggagcttggagatcttggaatttcagtaaaaatggttacaggtgataataaggagatagccgcaaagatagcaggcgaggttggtatctctggaatggcatgcaatgtccatgagaattttgatgtaaacaaatgctccgttttttctgaggttttccctgaggacaagtttaaaatagtaatggagctgcaaaaagatggtcatatcacgggaatgactggagacggcgttaatgatgcacctgcactcaagcaggccgaggttggcatagccgttagcaatgcgactgatgttgcaaaggcctctgcaagcatagttcttacacatgagggtatagttgatattgttgaatccgtaaaggatgggagaagaatataccagagaatgttaacatatacattaaataaaattataaaaacaatacaggttgttctgtttttaacaacagcattttttgcggtaaaattctttgttacaacgccgtttgacataattttactgctctttgcaaatgattttgtgaccatgtcaattgcaactgataatgtaagatattcaaaaaagcctgaaaaatggaatgttatgtcccttgtttactcatcaggattgattgcagcccttatggtaattgaggggtttttaattctttacataggcatctatgaacatttacctgttaatggtatacataccataatctttgacatgcttgttttttcaggattatttaatgttataatggtaagggaaagaggacatttctggcattcaaggccaagcaacaccctgcttctatcgataatcattgatataatttttgtatcctttatatcatattatggaatacttatcagtgcaataccattatatttaattatcatcactgttttaattgcattttcctggatggccgctgttgatcttttgaaaaaccttgtttttagaagatttaacctttag

SEQ ID NO: 107834 - protein, 781 aa, Picrophilus torridus
MQEIKKKIDMIQLMKDLKTSNNGLSDSEAGSRLNSYGYNEVTEKKDSIYIKLLKKFWAPVPWMLEVTSIITYIIGRYIDTYIILFLLFFNAIIGFFQESRAENAVELLKKRLQVTSRVLRNGKWELLESIYIVPGDIINVRLGDIVPADCAIISGNVETDQSALTGESLSVSKGVSDQLFSGSVIKRGEATAVVMATGDKTYFGKTAMLVSEAGSKSHIESLIFNIVKYLIILDVSLVIITTIYSILINVPFNDIIPFSLVLLITSIPVALPATFTIAMAIGAMDMAKKGSIVTRLNAIEDAASMDILCSDKTGTITENVLTVRDPYPVGCSINELMELAMYASEEKSEDPIDIAIINFARNMKINVDYNNVKNFIPFDPATKRTEAVVLKNGKTTRILKGAPQVIAGLCGLDYQEISSKIDEFARFGYRVIAVATIDEKPAFKGLIPMYDPPRKDSAELIKELGDLGISVKMVTGDNKEIAAKIAGEVGISGMACNVHENFDVNKCSVFSEVFPEDKFKIVMELQKDGHITGMTGDGVNDAPALKQAEVGIAVSNATDVAKASASIVLTHEGIVDIVESVKDGRRIYQRMLTYTLNKIIKTIQVVLFLTTAFFAVKFFVTTPFDIILLLFANDFVTMSIATDNVRYSKKPEKWNVMSLVYSSGLIAALMVIEGFLILYIGIYEHLPVNGIHTIIFDMLVFSGLFNVIMVRERGHFWHSRPSNTLLLSIIIDIIFVSFISYYGILISAIPLYLIIITVLIAFSWMAAVDLLKNLVFRRFNL

SEQ ID NO: 107835 - DNA, 2781 bp, Methanococcus maripaludis
  CDS (1)..(2781)
atgccagataccgattattatttaatgccaatttcagaggtatttaaaaaattaaatactgaaaaatcaggactttctaatgtagaagctgaaaataggctgaatacttttggaaaaaatgaattaaatgcagaaattaggcttccaaaatggttaaaatttttatttcagtttaaagacgtttttgcagcagttttaatttttgcatcggcagtttcttttttaattggtaattaccgtgacggaacaatcatggccttaatcgtgataataaatgcagtaattgggtattatcaagaaaataaagctgaaaatatcatggattctttaaaaaaacttatacaatctccttcaaaagtttaccgtgatggggagttaaaagaaatttcgcaagggttgctggttgtcggagatattgtacaccttgacgaaggtgacaaagtacctgctgatatcaggcttattgaatcttataatttaagtacaaatgatttttcacttactggtgaatcaatgcctcaggaaaaagatactgaagcgcttgattctgaagtaggggttgcagatcgtacaaatatggtttacttgggtacaaatattgcgacaggaaatgctaaaggagtagttgtggcaacagggatggctactgaacttggaaggattgcaaacctcacaagagaggaaaaacttgcaaaatctccattacaagtagaactcagcaatattgcaaacaaaattaccatttttgcagtagttattgcatcaatactttttttaataagtttaaatcagggtttaggcttaaaatttggtttaatttacggacttggaattgcagttgcgatagttccacaggcccttccgatgcagataacagtagctctcgcaaacggggtttctaagcttgcaaagaaaaatgcagtaataaaaaaactctcggcagttgaaacactcggttcgacaaacgtaattacaactgataaaaccggaaccttaactaaaaatgaaataactgttagaagcatctggtttgatggaaaagagtatgaaataacgggggtcggatatgaaccaaaaggtacgattcttgatgtatcgaaaaatgagttggatgaatcaggaatttcaaacatagaattaatttttaatactgctacaatggcttcaaatgcaaaaattcacgaacctgacgaaaatcactatggatggtacccaattggagacccgaccgaagctgctctgataacggctgctagaaaattaaatataatgtcgctagatgaggatgaaaaatatcctaaaattcaggagtttagttttgattctgttcgaaaaagaatgagttctattcggcttttcaatgataaaaagatgttaatgatgaaaggagcacttgatagtgttatttcagttagtaaatatatttataaggatggaaaagttgttgaattaaaaaaagaagatattgaactgttaaacgaattaaatatccagtattcaaaaaaagcaatgagggttcttgcattcacatatcgagaattgggaaacaatgaaggagaatattcgattgaaaacactgaaaaagatatggttttcttaggtttaatggcaatgagtgatcctccaaaagagggtgtgaaggatgcaataaaaaaagcacacgaagcacatataaaaacgtatattatgactggagatcacgctataaccgcacaggctgttggaaaacagatttttttagcagatggtgggagggaagtaaaagttataactggaaaagaactcgattcaatgcccgataatgagttaaaacaaaacatggctgaaaatgatgcactgatattttcgagaacttcgcctgaaaacaaacttaggattgtaaaaacattaaaagaacagggtcaaattgttgcagtaactggggatggggtaaatgatgctcctgctcttaaaagttcacatattggggttgcaatgggtaaaattggaacggacgtatcaaaagaagcatcagaacttattttactcgatgacagttttacaacgttagtttatgcaattcgggaggggcgtacaatctataataatcttacaaaaacgattattgcatcacttacaagtaatgggggagaattgacaatagttttaattgggttacttgctgttgcgtatatgggctggccaatgccaatattaacgattcagatacttgcaattgaccttcttgcagaaattttaccgttaactgcattaactttcgatcctgcatcaagagatataatgaatgcaccgcctcgaagaaaagaagaacacgttttaaataaatatgcaatctcagaaatcttgttttttggatttttgatgggttttttagcatttttaaacttcggactatttatttttagaaatgaccttgaattgacacaaattgctcaagtatatcctcttgcaactacgataagctatgctacaattgcattctgccagttcatgaatattctttcacgaaggtactcttacgaaaccttatttagcagaacgctctttacaaacatgaatatgatttattcaatactgatttccatagcatttacacttaccgcgatatatgtttcgccaataaacaaaatgattggttttgcaccgatggggcttgtcgactgggcttacgtgttgctggcatcatttgtatttttgggagcacatgaacttttgaaagtatataaaagacataaaaaatcaggcaaacatgcaacagttttaactgaaatttctgcataa

SEQ ID NO: 107836 - protein, 926 aa, Methanococcus maripaludis
MPDTDYYLMPISEVFKKLNTEKSGLSNVEAENRLNTFGKNELNAEIRLPKWLKFLFQFKDVFAAVLIFASAVSFLIGNYRDGTIMALIVIINAVIGYYQENKAENIMDSLKKLIQSPSKVYRDGELKEISQGLLVVGDIVHLDEGDKVPADIRLIESYNLSTNDFSLTGESMPQEKDTEALDSEVGVADRTNMVYLGTNIATGNAKGVVVATGMATELGRIANLTREEKLAKSPLQVELSNIANKITIFAVVIASILFLISLNQGLGLKFGLIYGLGIAVAIVPQALPMQITVALANGVSKLAKKNAVIKKLSAVETLGSTNVITTDKTGTLTKNEITVRSIWFDGKEYEITGVGYEPKGTILDVSKNELDESGISNIELIFNTATMASNAKIHEPDENHYGWYPIGDPTEAALITAARKLNIMSLDEDEKYPKIQEFSFDSVRKRMSSIRLFNDKKMLMMKGALDSVISVSKYIYKDGKVVELKKEDIELLNELNIQYSKKAMRVLAFTYRELGNNEGEYSIENTEKDMVFLGLMAMSDPPKEGVKDAIKKAHEAHIKTYIMTGDHAITAQAVGKQIFLADGGREVKVITGKELDSMPDNELKQNMAENDALIFSRTSPENKLRIVKTLKEQGQIVAVTGDGVNDAPALKSSHIGVAMGKIGTDVSKEASELILLDDSFTTLVYAIREGRTIYNNLTKTIIASLTSNGGELTIVLIGLLAVAYMGWPMPILTIQILAIDLLAEILPLTALTFDPASRDIMNAPPRRKEEHVLNKYAISEILFFGFLMGFLAFLNFGLFIFRNDLELTQIAQVYPLATTISYATIAFCQFMNILSRRYSYETLFSRTLFTNMNMIYSILISIAFTLTAIYVSPINKMIGFAPMGLVDWAYVLLASFVFLGAHELLKVYKRHKKSGKHATVLTEISA

SEQ ID NO: 107837 - DNA, 2505 bp, Methanococcus maripaludis
  CDS (1)..(2505)
atgacattttttaaaggttttaaggaagattacttcggacttacagatttagaggtaaaacaataccgcgaaacttacggaaaaaatgaattactccaaaaaaagaagaaaacattgttgagtcgcattttaaagatacttacagaaccaatgtttgtgctgttattcattgccgcttttatttattttttccttggagaacctcgcgatgggtcaataatggttatttcggttatatttatctgcgcgatcgagttttttcaggaatggagaactgacaggaccctgcaagcactaaaagaattatcttccccaaaatccactgttattcgaaacggaaaaatgatgacaatagacagcaccgaattaattgtaaatgaccttttaattttaaaagaaggggaaaaaatagctgctgatggaatcattgttgaaaattacggattgggagtaaacgaatctacattaacaggagaatcagatgttgtgtggaaaaaaattgatctaaaagaagatgaaaccttagaacactggaaaaagaacatctgctacgcgggaacgtctgtaacacaagggcgggccgttgttaaggttatacatatcggttctgaaactgaatatggaaaaattggaaaagatattttttcagtcgagtctatgcccacaccgcttgaaaaacagaccgaaaaacttgtaaaatattctgcgatagctgctttttttatgcttttattgattgtacttgttaatttttattacaggggaagcgttacagatagcatcttatcaggagtaaccgttgcaatggcaattattccagaagaatttccagtaattttgaccgtatttcttgcaatgggggcctggaggcttgcaaataaaaattcactcattcgaagaattcctgcggtagaaacgcttggctcaatatcattattatgtgttgataaaacaggaaccctcacaaaaaaccagatggaagtaaaagaaacatatttcgattcaaaatttaatgaaactgaacttatgacttatgcgtgtttagcatcagaaactgaagcttatgatccaatggaaaaggctataatgatttattcaaagtctatcagaataaatatagatgaattatgtaccggatgtcttttgcacgaatatccatttagctcagaaaccagaatgatgggaaacgtgtggaataaagataataaaaaatttatagctttaaaaggttcttttgaaaatattattaatttatgtgacttaaaagaatctgaaaaagtaaatttagagaaaaaatcaatcgaaatggctaaaaaaggataccgtgtaattgcagttgcaaaaaaaatggatgtagtaactattaatcagcatttagacgaatatacctttgaatttgttggattaattggtttgatggatccgccaagagaaggagtttcaaaagccatgaaaatatgtaataacgcagggatcagggttgtaatgcttactggagacaacgggactactgcaaaatcgattgcaaaaaccataggtctaaaaaacagcgaaaatgtgttaacaggaaacgaaatcgattctatgggtgatgaagaactcttagaaaaaataaatgtaacaaacatattttcacgagtaattccaaaacacaaattaaggatcattaaagcttttaaaaaactcggtgaaattgttgcaatgactggagatggcgtaaatgacgcacctgcactaaaatatgcagatattggtgtagctatggggaaaaggggtaccgaagttgcaaaagaagcgtctgacatgattttacttgacgataattttgaaaccattgttgaaacaatacatgatggaagaagaatttatgataatatcaaaaaagccataggctatgtttttgtaattcatatcccagtatttctgactgcactttttgccccccttttaaaactaccgctactactccttccgataaatgtggttttaatggagtttattatcgacccaacgtgctcgattgtgtttgaaagacagcctgcagaaaaaaacataatgcttagaaagccgcgaatgcctaccgaacctcttttggattatagccttatattcaaagcaataattcaaggagtaacgatttttgcatttgcttttggttcttacgtgtacctactatatcaaggattagaagtaaatactgcaaggacttttgcatttgtaattcttattgcagcgaatttcttcttggtatatgttaaccagtcagaaatagaatcagtattttcagcatttaaaaaattcaaaaatgatatgctcctctggcttgtaaatatcggaatatttgggggaattttaataatgctctatgttccatccgcaaccgaaattgcaaaaacagttccacttactgaaaaacagttgctctctgcaatattgatttcaggagtatctacactctggtgggaagtagtaaaacttttaaaaagaattaaaatgaaaaaatag

SEQ ID NO: 107838 - protein, 834 aa, Methanococcus maripaludis
MTFFKGFKEDYFGLTDLEVKQYRETYGKNELLQKKKKTLLSRILKILTEPMFVLLFIAAFIYFFLGEPRDGSIMVISVIFICAIEFFQEWRTDRTLQALKELSSPKSTVIRNGKMMTIDSTELIVNDLLILKEGEKIAADGIIVENYGLGVNESTLTGESDVVWKKIDLKEDETLEHWKKNICYAGTSVTQGRAVVKVIHIGSETEYGKIGKDIFSVESMPTPLEKQTEKLVKYSAIAAFFMLLLIVLVNFYYRGSVTDSILSGVTVAMAIIPEEFPVILTVFLAMGAWRLANKNSLIRRIPAVETLGSISLLCVDKTGTLTKNQMEVKETYFDSKFNETELMTYACLASETEAYDPMEKAIMIYSKSIRINIDELCTGCLLHEYPFSSETRMMGNVWNKDNKKFIALKGSFENIINLCDLKESEKVNLEKKSIEMAKKGYRVIAVAKKMDVVTINQHLDEYTFEFVGLIGLMDPPREGVSKAMKICNNAGIRVVMLTGDNGTTAKSIAKTIGLKNSENVLTGNEIDSMGDEELLEKINVTNIFSRVIPKHKLRIIKAFKKLGEIVAMTGDGVNDAPALKYADIGVAMGKRGTEVAKEASDMILLDDNFETIVETIHDGRRIYDNIKKAIGYVFVIHIPVFLTALFAPLLKLPLLLLPINVVLMEFIIDPTCSIVFERQPAEKNIMLRKPRMPTEPLLDYSLIFKAIIQGVTIFAFAFGSYVYLLYQGLEVNTARTFAFVILIAANFFLVYVNQSEIESVFSAFKKFKNDMLLWLVNIGIFGGILIMLYVPSATEIAKTVPLTEKQLLSAILISGVSTLWWEVVKLLKRIKMKK

SEQ ID NO: 107839 - DNA, 2733 bp, Mycoplasma mycoides
  CDS (1)..(2733): transl_table=4
atggcaagtatgcaattgccattttttatttgttctatttttgatatatgattattattgtattgaaaggcatatatgtttaaaacaaaaaaaggtaatttgaaatctttagattataaaaaacaagattatgtaattaaactatctaatactaattttgataatttaaaaaatgttttagactcaaaaataggtttaaataatcaatctagagcaaataatcttttaaaatttggatctaatcaaattgttgttaaaaagttttcagtatttaaaaaaatactagaaactctagtagaaccgtttaatttgttattgctatttattggtattttagaattaattatttattttttatttcaaagagattgaattactttaatatctgcttttattatcttttttatgatttttttagctagtattgttgatttcattcaagaatataaagcttataaatttaatttaaaactaactaaaataatagaaaatgacgtatttgtagttaatgatcaaataaaagattttaataatttaaactatcaaaatattaaaaataatttaataaaagaaaagcaatctaacttaacaattggtgatgttgtttatttatcaaaaggagatattattccaagtgattgtagaattatttgatcagaaaatctttatttagatgaatctactttgactggtgaatctaaagcaatcaaaaaacaaaccactaatactaagactaattttttagaactagaaaatattttatttaaagaaacattaatagtttcaggtaattgtttagctgtagttattagtattaataaagataattattctaattcattattaggtttaatcaatgatgatacagttactgattatgaaaaaggaattaataaagttactaaaattttaatttatttaatttctattttagtatttattattacttttatttctttattaaaaagtggatttagtaattgagcttcaagtttagtttttggattatctatagcagtttcactaactcctgaagctttacctgcgatcatttcttctaatttaaaattagcatcaaaaagattatctaaaaataaagttgtcattaaaaaattatcagtattacaaaacattgggtcagttaatattttagcaactgataaaactggaactttaactctagatacaactaatattgaaacatatttagatattaataatcaaaaaaataagcttttaaagcaatattttttttataatgcttattttcaaaataatttgtttgacactattgataaagcaatcattgaccagtttaaaacaaatattagtgatattaaattaattgatcatttaagttttgatcataattttagaatttcatcagttttgattaattttaataactctagtcttttaattactaaaggtagtttagaagaaatattagaaattactagttctattaatgttaataatcaagttattaatctttgtgataattataaaaatatgataattgatcaagttaatagttatactaaaaaaggttataaagtactagttttaagttataaaaattcagatgttattgataataaaaatttaatatatttaggaatggtagtttttagtgatcaaattagagagaatgtaaaacaagtaatagatacttttaaagtttatgatattgatattaaagttttaagtggtgataatttatatacttgtaaaaatgtatgtgatcaagtagggattaattcaaatactagtttaattggaaaacaaatcaataatttaactaaagaagagttaataaaaattagtcagtcagttaatattttttataaactttctccattagataaagcaaaaatcatagatagtttaaaatctaataatgttgttggttttctaggtgatggagttaatgatgcagttgctttaaaaaaagctgatgttggtatttcagtaaataatgcttcaagtttagcaaaacaatctgcagatgttattttattagaaaaagacttaaacgctttagagcacgcttttattattggaagaaaaacttttagtaatgctattaaatacattaaaataactgttgcttctaattttggaattttattaactttattattagctacaattttatttaaatttgaagtaatgtcatcaattcaattacttattcaaaatttaatttttgattttgctaatttagtttttgtatttgataatgttgatcaatcatctattaaaaaacctcaaaagtgaaatattaaatcaattattccttttgctatatttaatggactaacacaagtaattattagttttattaactttatgatcttatattttggatttaatataaaaggattagatgctcagtcaattgaattatttcaaacttgttattttattgagtgtatattaactcatattatgattattttagttttaagaactgataagctatcattttttaaatcaattgcatcaaaacagatgttaatttcaatgttattttttagtattattccttttgtaattgtatttattagcagtagttttaatagtttaggatttagattaatggttggtaatttaaataacattaatttatcttgatgatttttactattatttagtttagaaattttagcttgaataattagtgaaataattaaaaaaaattatttaaagatttttaaaaattgactttaa

SEQ ID NO: 107840 - protein, 910 aa, Mycoplasma mycoides
MASMQLPFFICSIFDIWLLLYWKAYMFKTKKGNLKSLDYKKQDYVIKLSNTNFDNLKNVLDSKIGLNNQSRANNLLKFGSNQIVVKKFSVFKKILETLVEPFNLLLLFIGILELIIYFLFQRDWITLISAFIIFFMIFLASIVDFIQEYKAYKFNLKLTKIIENDVFVVNDQIKDFNNLNYQNIKNNLIKEKQSNLTIGDVVYLSKGDIIPSDCRIIWSENLYLDESTLTGESKAIKKQTTNTKTNFLELENILFKETLIVSGNCLAVVISINKDNYSNSLLGLINDDTVTDYEKGINKVTKILIYLISILVFIITFISLLKSGFSNWASSLVFGLSIAVSLTPEALPAIISSNLKLASKRLSKNKVVIKKLSVLQNIGSVNILATDKTGTLTLDTTNIETYLDINNQKNKLLKQYFFYNAYFQNNLFDTIDKAIIDQFKTNISDIKLIDHLSFDHNFRISSVLINFNNSSLLITKGSLEEILEITSSINVNNQVINLCDNYKNMIIDQVNSYTKKGYKVLVLSYKNSDVIDNKNLIYLGMVVFSDQIRENVKQVIDTFKVYDIDIKVLSGDNLYTCKNVCDQVGINSNTSLIGKQINNLTKEELIKISQSVNIFYKLSPLDKAKIIDSLKSNNVVGFLGDGVNDAVALKKADVGISVNNASSLAKQSADVILLEKDLNALEHAFIIGRKTFSNAIKYIKITVASNFGILLTLLLATILFKFEVMSSIQLLIQNLIFDFANLVFVFDNVDQSSIKKPQKWNIKSIIPFAIFNGLTQVIISFINFMILYFGFNIKGLDAQSIELFQTCYFIECILTHIMIILVLRTDKLSFFKSIASKQMLISMLFFSIIPFVIVFISSSFNSLGFRLMVGNLNNINLSWWFLLLFSLEILAWIISEIIKKNYLKIFKNWL

SEQ ID NO: 107841 - DNA, 1935 bp, Mycoplasma mycoides
  CDS (1)..(1935): transl_table=4
atgtttttatttaaaaagagaaagttttctcctaaaaaaataacaagacacaaaaaaaagactcattttgcaaatgaaagattcataaaacaagttagtaatttagaacaaaacgaagtattagaaataatgcaattacaacattttggtttaactaatgaacaatatgaatcaagattaaaaaaatatggtactaatgaattaaaaaagaaaagattcaatttaatagctgaatttttgcacgctttttttggaccatttaatattgttctattactaatttctttatacaattttatttcatatgcaacaaatgggttttatcaagatacaagttcaagtgattctaaatttgaattagttggagcattaattattttagtaatggttttagctagtgggttagcttcatttattcaatctttaagatctcatttagttactaaaaaaattagttctattgttaaaagtactactaatattattagacataaaaatgatgaagatgttgaagattatttaaaaattactaaaagaaatcaattagatttaattagacttggtgaagaaattgatgttaaacaattagttccaggtgatttaatttatttatcaagtggtgatatgttaccagctgatgttagaatcattcaatcaactgatttatttattaatcaatcatctttaactggagaatcaataccagttgaaaaacatgcaaataataaaaaaaatacaaataatattttagatttagaaaatatttgctatacaggaactagtgtggtttctggtagtgctttagctgtagttttagcaactgcaaatgacacttacttttcaactattagtaaagccattttagaaaagcgtcctgattcaagttttactaaaggaattaaacaagtaacaagaatgttattaatttttatgtttgtaatggttccaactgtttatttagcaaaatcaataattggaactatttcaagtggtggaagttttgatagtattaaagataatccttgatttcaagcaatcttttttgctgtagctgttgcagttggattaactcctgaaatgttaccaatgatagtaactactaatttagcaaatggagcttctaaaatgtcaaaacaaaaagttgtagtaaaacaattagaagcaattcagtcacttggggctattgatgttttatgtactgataaaactggtacattaacaaatgataaaatagaacttgttgactatttaagagttgataaaaaagccgaccctttattattaaaatatttatatattaatagttattatcaaactgggttaaaaaatccaatggataaagcaattgttgattatgttaacaaacacaatcataacttttctattcaagatattactaaaattgatgaaataccttttgattttaatagaagaaaactaactattatttttgatgatgaaaacgaaaaacgttttatggttacaaaaggtagtgttgaagaaattttaaattcttgtacaagagttattcaagatgacaaagtcgttaatttaactgatacttttaaaagacaaattattgcttattatgaaactattaatcaacaaggtaaacgtctattaggtgttgcttataaaaaaattagagataatcaagctaaatttagtccaaaagatgaagaatcattaatctttatgggatttgcatcatttttagatacaccaaaaccatcaacaaaacaaactattaggttattaaaaaaatatggtgttgatttaaaaattttaactggagatagtgaacctataactagagctatttgtaaaatggttaatttagatattaaaggcttagtaactggtgaagaaattgatgctgctagtgaatatgaattaaaaaaattgttgaagataataatatttttgttaagttaa

SEQ ID NO: 107842 - protein, 644 aa, Mycoplasma mycoides
MFLFKKRKFSPKKITRHKKKTHFANERFIKQVSNLEQNEVLEIMQLQHFGLTNEQYESRLKKYGTNELKKKRFNLIAEFLHAFFGPFNIVLLLISLYNFISYATNGFYQDTSSSDSKFELVGALIILVMVLASGLASFIQSLRSHLVTKKISSIVKSTTNIIRHKNDEDVEDYLKITKRNQLDLIRLGEEIDVKQLVPGDLIYLSSGDMLPADVRIIQSTDLFINQSSLTGESIPVEKHANNKKNTNNILDLENICYTGTSVVSGSALAVVLATANDTYFSTISKAILEKRPDSSFTKGIKQVTRMLLIFMFVMVPTVYLAKSIIGTISSGGSFDSIKDNPWFQAIFFAVAVAVGLTPEMLPMIVTTNLANGASKMSKQKVVVKQLEAIQSLGAIDVLCTDKTGTLTNDKIELVDYLRVDKKADPLLLKYLYINSYYQTGLKNPMDKAIVDYVNKHNHNFSIQDITKIDEIPFDFNRRKLTIIFDDENEKRFMVTKGSVEEILNSCTRVIQDDKVVNLTDTFKRQIIAYYETINQQGKRLLGVAYKKIRDNQAKFSPKDEESLIFMGFASFLDTPKPSTKQTIRLLKKYGVDLKILTGDSEPITRAICKMVNLDIKGLVTGEEIDAASEYELKKLLKIIIFLLS

SEQ ID NO: 107843 - DNA, 2829 bp, Mycoplasma mycoides
  CDS (1)..(2829): transl_table=4
atgtttttatttaaaaagagaaagttttctcctaaaaaaataacaagacacaaaaaaaagactcattttgcaaatgaaagattcataaaacaagttagtaatttagaacaaaacgaagtattagaaataatgcaattacaacattttggtttaactaatgaacaatatgaatcaagattaaaaaaatatggtactaatgaattaaaaaagaaaagattcaatttaatagctgaatttttgcacgctttttttggaccatttaatattgttctattactaatttctttatacaattttatttcatatgcaacaaatgggttttatcaagatacaagttcaagtgattctaaatttgaattagttggagcattaattattttagtaatggttttagctagtgggttagcttcatttattcaatctttaagatctcatttagttactaaaaaaattagttctattgttaaaagtactactaatattattagacataaaaatgatgaagatgttgaagattatttaaaaattactaaaagaaatcaattagatttaattagacttggtgaagaaattgatgttaaacaattagttccaggtgatttaatttatttatcaagtggtgatatgttaccagctgatgttagaatcattcaatcaactgatttatttattaatcaatcatctttaactggagaatcaataccagttgaaaaacatgcaaataataaaaaaaatacaaataatattttagatttagaaaatatttgctatacaggaactagtgtggtttctggtagtgctttagctgtagttttagcaactgcaaatgacacttacttttcaactattagtaaagccattttagaaaagcgtcctgattcaagttttactaaaggaattaaacaagtaacaagaatgttattaatttttatgcttgcaatggttccaactgtttatttagcaaaatcaataattggaactatttcaagtggtggaagttttgatagtattaaagataatccttgatttcaagcaatcttttttgctgtagctgttgcagttggattaactcctgaaatgttaccaatgatagtaactactaatttagcaaatggagcttctaaaatgtcaaaacaaaaagttgtagtaaaacaattagaagcaattcagtcacttggggctattgatgttttatgtactgataaaactggtacattaacaaatgataaaatagaacttgttgactatttaagagttgataaaaaagccgaccctttattattaaaatatttatatattaatagttattatcaaactgggttaaaaaatccaatggataaagcaattgttgattatgttaacaaacacaatcataacttttctattcaagatattactaaaattgatgaaataccttttgattttaatagaagaaaactaactattatttttgatgatgaaaacgaaaaacgttttatggttacaaaaggtagtgttgaagaaattttaaattcttgtacaagagttattcaagatgacaaagtcgttaatttaactgatacttttaaaagacaaattattgcttattatgaaactattaatcaacaaggtaaacgtctattaggtgttgcttataaaaaaattagagataatcaagctaaatttagtccaaaagatgaagaatcattaatctttatgggatttgcatcatttttagatacaccaaaaccatcaacaaaacaaactattaggttattaaaaaaatatggtgttgatttaaaaattttaactggagatagtgaacctataactagagctatttgtaaaatggttaatttagatattaaaggcttagtaactggtgaagaaattgatgctgctagtgaatatgaattaaaaaaaattgttgaagataataatatttttgttaagttaaatccattacaaaaagtaaaaattattcaagttttaaaacaaaataatcacgtagttggttatatgggagatggtattaatgatgctcctgtattaagacaatctgatgttgctatttcagttaataatgcaacagaaattgcaaaagacgctagtgatattattttattagaaaaatcattattagttttagaaaaaggaattatccaaggaagaactatttttggaaatattttaaaatatattaagattacaactgcttctaattttggtaatgctttatcagttttaattggaacagtttgattgccattttcaccaatggcaccagctcaaattttattacaaaacttaatttatgacttttcacaatttggagtagcactagatagagttgatgctacgtttttaacatctcctcagcgatggcaatcaaaagacctcttaccatttacaacaattaatggaacaataagtacattttttgatttaataacatttgcaattgcgggttattattttggttatattaatagttataatagtgcaatagctcaaaatgatagtttattagcagctcaatcactagctagattccatgcttgttgatttattattggattattatctcaaacatttgttttccaaatattacgtactgaacaactaccagtaattcaatctcgttcaacttgaccagtttatgtaattggagcactagctacaataatggcgttttctattgtttatataagtcaaattggaagcttagttcaactacaaagccctggtttaatttatattccaatatctattgctattatatttagttattgtttaacagctcaattaactaaagtaggttataaaaaagtctttaaaaaatgattataa

SEQ ID NO: 107844 - protein, 942 aa, Mycoplasma mycoides
MFLFKKRKFSPKKITRHKKKTHFANERFIKQVSNLEQNEVLEIMQLQHFGLTNEQYESRLKKYGTNELKKKRFNLIAEFLHAFFGPFNIVLLLISLYNFISYATNGFYQDTSSSDSKFELVGALIILVMVLASGLASFIQSLRSHLVTKKISSIVKSTTNIIRHKNDEDVEDYLKITKRNQLDLIRLGEEIDVKQLVPGDLIYLSSGDMLPADVRIIQSTDLFINQSSLTGESIPVEKHANNKKNTNNILDLENICYTGTSVVSGSALAVVLATANDTYFSTISKAILEKRPDSSFTKGIKQVTRMLLIFMLAMVPTVYLAKSIIGTISSGGSFDSIKDNPWFQAIFFAVAVAVGLTPEMLPMIVTTNLANGASKMSKQKVVVKQLEAIQSLGAIDVLCTDKTGTLTNDKIELVDYLRVDKKADPLLLKYLYINSYYQTGLKNPMDKAIVDYVNKHNHNFSIQDITKIDEIPFDFNRRKLTIIFDDENEKRFMVTKGSVEEILNSCTRVIQDDKVVNLTDTFKRQIIAYYETINQQGKRLLGVAYKKIRDNQAKFSPKDEESLIFMGFASFLDTPKPSTKQTIRLLKKYGVDLKILTGDSEPITRAICKMVNLDIKGLVTGEEIDAASEYELKKIVEDNNIFVKLNPLQKVKIIQVLKQNNHVVGYMGDGINDAPVLRQSDVAISVNNATEIAKDASDIILLEKSLLVLEKGIIQGRTIFGNILKYIKITTASNFGNALSVLIGTVWLPFSPMAPAQILLQNLIYDFSQFGVALDRVDATFLTSPQRWQSKDLLPFTTINGTISTFFDLITFAIAGYYFGYINSYNSAIAQNDSLLAAQSLARFHACWFIIGLLSQTFVFQILRTEQLPVIQSRSTWPVYVIGALATIMAFSIVYISQIGSLVQLQSPGLIYIPISIAIIFSYCLTAQLTKVGYKKVFKKWL

SEQ ID NO: 107845 - DNA, 2559 bp, Rhodopseudomonas palustris
  CDS (1)..(2559)
atgtccgccgagctcgcctctgcctccgacaccatctccggcctcagcgagcgcgaggccgccgcccggctcgccagcgagggctacaacgagctgccaagccctgatcgccgcacgctgctcggcatcgtgctggaggtggtgcgcgagccgatgctggcgctgctgctcggcggcggcgtggtctacatggcgctcggcgatctgaaggaagcgatcatcctgctgatcttcgccacgctgtcggtggtgatcacggtggttcaggaagcacgcaccgaacgcgtgctggagacgctgcgcgatctcaccagcccgcgtgccctggtgatccgcgacggcatccgcaaacgcattgcggggcgcgaggtagcgcgcggagacgtcatggtgttgtcggagggtgaccgcgtcgccgccgacgcggtgttgctgcaggccgacgatctcttggtcgacgagtcgctgctcaccggcgagtcggtgccggtgcgcaagctctctcgcggcgaagccgacgccaccacactgcgccggcccggcggcgacgatcagccggcggtgtactccggctcgctggtggttcgcggcggcggcctcgccgaggtcgtcgccaccggcccccgcagcgagatcggcaagatcggccaggcgctcggctcgttgcaaaccgaagcgccgcgtctgcaaatccagacccgcgcggtggttcgcaccttcggcttcatcgccgccggcttcacggcgctggtcgtggtgctctacggcacgctgcgcgacggctggctcgacgccgtactggccggcatcaccgtcggcatgtcgatgctgccggaggagtttccggtggtgctgacggtgttcatggcgatgggcgcctggcggatctcgcaggcgcgggtgctgacccgccgcgccgccgcgatcgaggcactgggctccgcgaccgtgctgtgcaccgacaagaccggcacgctgaccgagaaccggatgtcggtcgccgaactgcgtctgacctccggcgaggtgttccggccgcgcgagggcggcgcgctgccggtcggatttgcgaccctgctcgagaccggcctgctcgcagctgcgccggatccgttcgatccgatggatcaggcgctgcaccgtttggccggcgatcatctgcccggaggtagcggcgaccgcaccctggtgcacagctatgggctgcgccgtgatcttctcgccatgacccaggtatggcgcgacaccgatgatcgttcagactacgtcgtcgcggccaaaggcgcgccagaagcgatcgcacggatgtgcgggctcgacgatgccacgttgggcgcgctgtcgggcgctgtcgacgcgatggcgaccgagggactgcgcgtactcggagtcgcgcgcacctcgcatcccgatcaggattggccggcaacccagctcggcttccgcttcgagtttcttgggctggtcggccttgccgatccgttgcgcgccgcggttcccgccgcggtcgccgattgccgcgcagctggcatccgtgtggtgatgatcaccggggactatcctgcgaccgcgcaggcgatcgcccgtcaagcggggatcgacgccgaaacatgcgtcaccggcgaggagatcgccgcacttgatgacgccgcactcgccgagcggctgcgccgcgccacagtgtttgcgcgaatcatgccggagcagaagctgcggatcgtccaggcgctcaaggccgacggcgaagtcgtggcaatgaccggcgacggcgtcaacgacgcaccgtcgctgaaggcggcgcatatcggcatcgcgatggggggacgtggcaccgacgtggcgcgcgaggcttccgcgatcgtgctgctcgacgacgacttcgcctcgatcgtcaaagcggtccggctcggccggcggatctacgacaatctggtcaaggcgatgggcttcatcttcgcggtccacgtgccgatcgccgggctggcgctgctgccgctgctgttcgggctgccgatcctgctcgggccgatccacatcgcgttcctggagatgatcatcgatccggtgtgctcgatcgtgttcgaagccgagaccgccgaggacgacgcgatgcgccgcccgccccgcgatcccgaacagccactgttcagccgggcgctgatcgtgtggggcatgttgcaagggctcttggtgttcctgctggtcgccggcgtgttcgtgattggccagatgcgcgcgatgccggataccgagctgcgcgcgctgacgttctttgcgctggtgctgagcttcgtcggactgatcttcgtcaaccgctcgttcagcgcctcgctgctgacggcgctgcggcgacccaacgctatgctggcggggatgctcggtatcgtcgcggtggtgctgatcgccagcctggcgtggccctggctgcgcgatctgttccgcttcggcccgctgcatccggacgatctcggcctcaccgcggccgcggcactgttggtgcttatcgtactggagctggtcaagccgctgtggcggaagatgatgcggcaaccgggatag

SEQ ID NO: 107846 - protein, 852 aa, Rhodopseudomonas palustris
MSAELASASDTISGLSEREAAARLASEGYNELPSPDRRTLLGIVLEVVREPMLALLLGGGVVYMALGDLKEAIILLIFATLSVVITVVQEARTERVLETLRDLTSPRALVIRDGIRKRIAGREVARGDVMVLSEGDRVAADAVLLQADDLLVDESLLTGESVPVRKLSRGEADATTLRRPGGDDQPAVYSGSLVVRGGGLAEVVATGPRSEIGKIGQALGSLQTEAPRLQIQTRAVVRTFGFIAAGFTALVVVLYGTLRDGWLDAVLAGITVGMSMLPEEFPVVLTVFMAMGAWRISQARVLTRRAAAIEALGSATVLCTDKTGTLTENRMSVAELRLTSGEVFRPREGGALPVGFATLLETGLLAAAPDPFDPMDQALHRLAGDHLPGGSGDRTLVHSYGLRRDLLAMTQVWRDTDDRSDYVVAAKGAPEAIARMCGLDDATLGALSGAVDAMATEGLRVLGVARTSHPDQDWPATQLGFRFEFLGLVGLADPLRAAVPAAVADCRAAGIRVVMITGDYPATAQAIARQAGIDAETCVTGEEIAALDDAALAERLRRATVFARIMPEQKLRIVQALKADGEVVAMTGDGVNDAPSLKAAHIGIAMGGRGTDVAREASAIVLLDDDFASIVKAVRLGRRIYDNLVKAMGFIFAVHVPIAGLALLPLLFGLPILLGPIHIAFLEMIIDPVCSIVFEAETAEDDAMRRPPRDPEQPLFSRALIVWGMLQGLLVFLLVAGVFVIGQMRAMPDTELRALTFFALVLSFVGLIFVNRSFSASLLTALRRPNAMLAGMLGIVAVVLIASLAWPWLRDLFRFGPLHPDDLGLTAAAALLVLIVLELVKPLWRKMMRQPG

SEQ ID NO: 107847 - DNA, 2745 bp, Rhodopseudomonas palustris
  CDS (1)..(2745)
atgaccgaactgctgcaagccgacatcaaaggcccgaacgatcaggcctccgacgagatgtggcacgcgatcgatgccgaccgcgttctcaccggcctcgccaccagccgaggcggcctcagcaccgaagaggccaaacgccggctgcagagctacggacccaatgcgctgccagagccgccccgccgctcggcgattctgcggtttctgtcacagttcaacaacacgctgatctacttcctgctcgccgccgcggtcgcagccgcattcctcggccaccagatcgatgccgcagtgatcgtcgcggtggtgacgatcaacgccatcgtcggctacattcaggaagacaaagccgaaaaggcgctggccgcgatcaagaagatgatctcgccgcgcgcgcatgcctggcgtgacggccaccgcgtcgtgttgccagctgaagaactggtgccgggcgacgtggtgatgatcgaggccggcgatcgcgtgccggcagatttgcggctgacgcgcgcccgcggcctgctgatcgacgaggcgatgctgaccggcgagtcggtggcatccgaaaagcacgaccagcccgcggcggtggatgtgccactcggcgaccggctgtgcatggggttctccggcacgctggtgtcggccgggcagggcttcggcgtcgtggtggcgaccggcgcacgcaccgagatcggccgcatcagcacgatgatccagggcgtcgagcaactggcgacgccgctgctcgcacagatcaacaagtttggtgagcgcttcacctgggtggcgatttcggcggcggcggcgatcttcgccttcgccacgctggtgcgcgactatgcctgggccgatgcgctgatcgctgtggtggcgctcgcggtcggcgtggtgccggaaggcttgccggcggtgatcaccatcacgctggcgatcggcgtgcagcggatggccaagcgcaacgccatcatccgccgcctgccggcggtggagacgctcggcgccacctcggtaatctgctccgacaagaccggcacgttgacgcgtaacgagatgaccgcgcgtcgcatcgtcaccgccgatcacaccattctggtcagcggctccggctacgtgccgaagggtgacctcaccgtcgacggtaaggataatcctgaagcggtgtcgtcggcgatgcagctcgttcgctccgcactgctgtgcaacgacgcgcagctgcgcccggtcgatggtcactacgtggtcgacggcgatccgatggagggcgcgctagtcgcactcgcaatcaaggccgggctcgatcccgacaccgagcgggccgcgtggaagcgctccgacgagatcccgttcgatgcgcagcatcgcttcatggcgacccgccacgccaccgattccggcgcgcaggtgatcttcgtcaagggcgcgccagagcggcttctggcgatgtgcgcaactcaagtcgggcccggaggcgcattgcatccgatagatcaagaattctggaccgcgcagatcgcgcgtgcggcggccgaaggcgagcgtgtgctcggctttgcgctccgttcgccggcgcggccgtccgaccagctcggatttgccgatctcgacgaggggctggcgttcatggggctggtcggcttcatcgatccgccgcgcgatgaggtgatccaggcgatcgccgaatgccgctcggccggcatcgtggtgaagatgatcaccggtgatcacgccgcgaccgcggaggcgatcgcgcggcagctgaacctgaccgaccatcccgacgtcgtcacaggggccgatctcgaccgcaccccggattccggcttcgtcgaactggcgcggcgcaccgatgtgttcgcccgcaccaacccggagcataagctgcgcatcgtgcaggcgctgcagtccaccggcgcagtggtggcgatgaccggcgacggcgtcaacgacgcgccggcgctgaagcaggccgatgtcggcatctcgatgggccacaagggcaccgagacagccaaggaagcctcgcaggtggtgctgctcgacgacaatttcgtctcgatcgtcgccgcggtgcaagaaggccgcacggtttacgacaacatccgcaaagtcatcgcctggacgatcccgaccaacggcggcgaggtgctcaccgtcatcgtcgcgatcctcttcggcttcaccatgccgatgacgccggtgcagatcctctggatcaacctgatcctcaccgtcacgctcggcctcgtgctggcgttcgagccgccggagcctggcgtgatgaagcggccgccacggccggcgcacgcgccgctgctgtcgcgcttcttggtgtggcggatctttttcgtctcgttcctgttcacggtcggcgcgctggcaatcttcttcttcgcgctcggcaagggactgtcgctcgacaccgcccgaaccatggtggtgaacgtgcttgtggtgttcgagatcttctacctgttcaacgtccgctatctgcacaccagctcgatctcgctgcgcggcgcgctcggcaccatgccggtgctggccgcgcttgtcgtggtgatcgccgcacagctcgccttcacctacgcgccgttcatgcacagcctgttcgccaccacgccgatctcgctggtcgacggcgccgtggtgatcggcgccggcgtggtgctgatgatcgtgctcgaactcgaaaaattggtgatgcgcaaaatcggcgcgctgcgcagtctcgagccgtaa

SEQ ID NO: 107848 - protein, 914 aa, Rhodopseudomonas palustris
MTELLQADIKGPNDQASDEMWHAIDADRVLTGLATSRGGLSTEEAKRRLQSYGPNALPEPPRRSAILRFLSQFNNTLIYFLLAAAVAAAFLGHQIDAAVIVAVVTINAIVGYIQEDKAEKALAAIKKMISPRAHAWRDGHRVVLPAEELVPGDVVMIEAGDRVPADLRLTRARGLLIDEAMLTGESVASEKHDQPAAVDVPLGDRLCMGFSGTLVSAGQGFGVVVATGARTEIGRISTMIQGVEQLATPLLAQINKFGERFTWVAISAAAAIFAFATLVRDYAWADALIAVVALAVGVVPEGLPAVITITLAIGVQRMAKRNAIIRRLPAVETLGATSVICSDKTGTLTRNEMTARRIVTADHTILVSGSGYVPKGDLTVDGKDNPEAVSSAMQLVRSALLCNDAQLRPVDGHYVVDGDPMEGALVALAIKAGLDPDTERAAWKRSDEIPFDAQHRFMATRHATDSGAQVIFVKGAPERLLAMCATQVGPGGALHPIDQEFWTAQIARAAAEGERVLGFALRSPARPSDQLGFADLDEGLAFMGLVGFIDPPRDEVIQAIAECRSAGIVVKMITGDHAATAEAIARQLNLTDHPDVVTGADLDRTPDSGFVELARRTDVFARTNPEHKLRIVQALQSTGAVVAMTGDGVNDAPALKQADVGISMGHKGTETAKEASQVVLLDDNFVSIVAAVQEGRTVYDNIRKVIAWTIPTNGGEVLTVIVAILFGFTMPMTPVQILWINLILTVTLGLVLAFEPPEPGVMKRPPRPAHAPLLSRFLVWRIFFVSFLFTVGALAIFFFALGKGLSLDTARTMVVNVLVVFEIFYLFNVRYLHTSSISLRGALGTMPVLAALVVVIAAQLAFTYAPFMHSLFATTPISLVDGAVVIGAGVVLMIVLELEKLVMRKIGALRSLEP

SEQ ID NO: 107849 - DNA, 5312 bp, Brachydanio rerio
  CDS (259)..(3330)
atcaaaagcagccacatgtgcttttaaaaaccaatgcagcttggcccattctttacgttttttctgtatgtagaccccctctaatacgttattacgcatggttactccaagtatctatagatttcatttatagacagagggtccttcaaacgctgcccgtcgttatccgtgcaagagcttcattttttcttgtgtccagcttgactgaaagcaaacgccgtttgacagactgaagaaacagcgactgacggctccaaaatggggtatggacggtcggacagctaccgcgtggcaaccacgcaggacaatgatgataaggaatctcccaaaaagggaaagggagggaaagaccttgatgacttgaagaaggaagtgccactgacagagcataagatgtcgattgaggaagtgtgccgaaagtacaacactgacatcgtacagggtctgactaatgccagggctgcagagtacctcgctcgggatggtcccaatgctctcacccctccacccaccaccccggagtgggtcaaattctgccgacagctcttcggaggtttctccatcctgctgtggatcggagcaatcctctgcttcctggcctacgccatccaggcggccactgaggacgagcccgccggagacaacttgtatctggggatcgtgctgtccgctgtggtcatcatcaccggctgcttctcctacttccaggaggccaagagctccaaaatcatggagtccttcaagaacatggttccccagcaagctttagtgatccgtgaaggtgagaagctccagattaacgctgaggaggtggtgggtggagatctggtggaggtgaagggaggagacaggattcctgctgacctcaggatcatctctgctcacggctgcaaggtggacaactcctctctgacgggtgaatcagagcctcagaccaggtctcctgactgcactcatgataaccctctggaaacccgcaacatcgccttcttctccaccaactgtgttgaaggtactgctcgcggtattgtggtctgcaccggtgaccgcaccgtcatgggccgcatcgccaccctgacctccggcctggagaccggaaagactcccatcgccaaagagatcgagcacttcatccacatcatcaccggcgtggccgtcttcctgggcgtcaccttcttcatcctgtccatcatcctgggctacagctggctggaggccgtcatcttcctcatcggcatcatcgtggccaacgtgcccgaggggctgctggccaccgtcactgtgtgtctgactctcacagccaagcgaatggcccgtaagaactgcctggtgaagaatctggaggctgtggagactctgggatccacttccactatctgctcggataaaaccggaacgctgacgcagaaccgcatgactgtcgctcacatgtggttcgacaatcagatccatgaggcagacaccactgaagatcagtctggtgcatcgtttgataagagctctggcacatggttggctctggcccgcgtggctgctctctgtaacagggccgtgtttaaagcgggacaggagtctctgcctatcctgaagagggatgtcgcaggggacgcctctgaatctgctcttctcaagtgtatcgagctctcctgcggctccgtcaaagccatgagggacaagaacaagaaagtggccgaaattcccttcaactccaccaacaaatatcagttgtcagtgcacgagttggacgagagtgaagaaaaccactacctgcttgtgatgaagggggcaccagagcgcatcttggaccgctgctccaccatcctgcagcagggcaaagagcagcccatggatgaagagttgaaggaggctttccagaacgcctacctggagctcggaggactgggagaaagagttctaggtttctgccacttggtgatgcctggtgacaagtaccccaaaggtttcgcgtttgacaccgacgacattaacttccagacagacaacctgtgctttgtgggcctgatgtccatgattgaccctccccgagccgccgtcccagacgctgtgggcaaatgccgctcagctggtatcaaagtcatcatggtgaccggcgaccatccaatcacagccaaggccatcgccaaaggtgtgggcatcatctctgagggcaacgagacagtcgaggacatcgccgctcgcctgaatatcccagtcagccaggtcaacccaagggatgctaaagcctgcgtgatccacggcacagatcttaaggatctctcgcaggaccagatggatgaagtgctgaagaatcacacagagatcgtgttcgccaggacgtccccccagcagaagctcatcatcgtggagggctgccagagacagggcgctatcgtggccgtgactggtgatggagtgaatgattctcccgctctgaagaaagcagatatcggcgtggccatggggatttctggatcagacgtctccaaacaggcagcagacatgatcctgctggatgacaactttgcatccattgttactggagtggaggaaggtcgcttgatttttgataacctgaagaagtccatcgcctacacgctgaccagcaacatccctgagatcactccattcctgttcttcatcctggtcaacattcctcttcctctgggcaccattaccatcctctgcattgacctgggcactgacatggtccctgcgatctcattggcttatgaagcagcagagagtgacatcatgaagcgccagccccgtaaccctctccgggacaagctggtgaacgagcgtctcatcagcattgcttacggacagatcggtatgattcaggcgctgggaggattcttcagttatttcgtgattctggctgagaatggttttctgcccagtgtgctggtgggcattcggctgaactgggacgatcgctccaacaatgacctggaggacagttacggacagcaatggacgtacgagcagaggaagatcgtggagttcacctgtcacacagctttcttcgtcagtattgtggtcgtacagtgggccgacgtcatcatctgcaagactcgccgcaactctgtgttccagcagggcatgaagaataagatcctgatcttcgggctgtttgaggagacggctctagctgcattcctctcctactgtcccgggatggacgtggctctcaggatgtaccctctcaagcccagttggtggttctgcgcgttcccttacagcttcttaatttttgtttatgatgagatccgaaaacttatcctgcgccgaaacccaggaggttgggttgaaaaggagacttactactgaattgtcaaatacttcactcatcgattctccctcactctctctttctctctctcttctctctttcttattcacgttctccccattcctaccgaaaaccaatacagaaacaaccatgttacaaatccacctccttccttccctccctttacccaattaaaaaaataacgcagaccaacaacaacagaccaacacaacaaacctcctgttattgtttttttttttgtacgtgtgtgtatgtgtgtgtttttctccagctgaatctgccagaaacacatcggtaaggtttaccgatactctcaaaacacactgttaggttgtgcgaacgcacagcttttgctaatggatgtcacgcatcgcgcagagactcctaaacaaacactgccacgccagattactgttacacatcgctctccagacacaaaatactaatcgtatagaggaaacaaacagtgttgtatttattaatcattcataatgatgttcttttatgttcgaagtgtgtctgagagctgcttgatttcgttttttgctcagacttgacaaaagcacactgccaccctctctcgctcgctgttataaatgaagttgctgccttacatttttaagttccgtcagttagtttaacttaacgctacattaaactgacttaaaacagaaagttgaagtctgcatgaaccgaaagttccacagacttttatttcagtatgattatgtgcttcttactgaaacggaatattgagtagggggcggagctttagctttgcgcatcattccattgggcaaactaacaataagaggcgtgtggtcaaactgacatcatcagagaagaactgccattccaaacacggaagcaaatgctcagaattcgattgaagattaccaaaacaaacttcatgtgaattaacataaatagaataatttttcttctaaatgaataaacaataggaggggcgtggccaaactgacatcatcagagaagaaccgctattccaaacacggaagcaaatgcttagaatttgattgaagattactaaaaacaaactttctacttcaaaaaatgaacatacgcagattaattgctctcttaaagaataacaatgtgtgctgggcgaataaacatttgatttcatgcacactttaaatcttaaaaaaaacaagttgaagcaaatttaactgattttattaagttcaaatgagtatttcaaaagttctggagacttttattattgtatgttgatgcagttctaactgaaactgaatattgagtaggggcgaagctttcattttgcgcatcattccttcgtacatgaaaacaatgagaggggcgtggacaaactgacatcatcagaaaaaaaacgccactccaaacacagaagcaaatgctcagaatttgattgaagattaccaaagcaaactttttatttcaataaatgaacatacacggattaagtattgcgatgtgttgtggacaaattaacagtaaaatttgatttcactcagactttaaatctttaaaaaattaagttggcgcatattgaactcattttattaagtatttgtaacataatgattgctaaagctgatttgattcaacttaaatttttcaggcagcaactcatttcttacagagctcttccttactctttctccttctatctttgtcttctatctctcgctctccgtccccttttatcctgcacttccctcctctttcttctgtccgtccgtctgtccgtccccgtctgtttgtctgtttgtgaacgatgtgaagacgctcctcctccctcttctatccggaccccgtttcccctgttacaactacaaaaaaagaaaaaagaaaagaaattacaatctttctgtgtcctaggaaaaagagatttcactctgatttcattgtttaaataagtgcagagaaaatcaaaacatggagtaaaagcaatgtaccaatacgtgaaacaaacagcaaaaaaaaaaaaaaaaaa

SEQ ID NO: 107850 - protein, 1023 aa, Brachydanio rerio
MGYGRSDSYRVATTQDNDDKESPKKGKGGKDLDDLKKEVPLTEHKMSIEEVCRKYNTDIVQGLTNARAAEYLARDGPNALTPPPTTPEWVKFCRQLFGGFSILLWIGAILCFLAYAIQAATEDEPAGDNLYLGIVLSAVVIITGCFSYFQEAKSSKIMESFKNMVPQQALVIREGEKLQINAEEVVGGDLVEVKGGDRIPADLRIISAHGCKVDNSSLTGESEPQTRSPDCTHDNPLETRNIAFFSTNCVEGTARGIVVCTGDRTVMGRIATLTSGLETGKTPIAKEIEHFIHIITGVAVFLGVTFFILSIILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGASFDKSSGTWLALARVAALCNRAVFKAGQESLPILKRDVAGDASESALLKCIELSCGSVKAMRDKNKKVAEIPFNSTNKYQLSVHELDESEENHYLLVMKGAPERILDRCSTILQQGKEQPMDEELKEAFQNAYLELGGLGERVLGFCHLVMPGDKYPKGFAFDTDDINFQTDNLCFVGLMSMIDPPRAAVPDAVGKCRSAGIKVIMVTGDHPITAKAIAKGVGIISEGNETVEDIAARLNIPVSQVNPRDAKACVIHGTDLKDLSQDQMDEVLKNHTEIVFARTSPQQKLIIVEGCQRQGAIVAVTGDGVNDSPALKKADIGVAMGISGSDVSKQAADMILLDDNFASIVTGVEEGRLIFDNLKKSIAYTLTSNIPEITPFLFFILVNIPLPLGTITILCIDLGTDMVPAISLAYEAAESDIMKRQPRNPLRDKLVNERLISIAYGQIGMIQALGGFFSYFVILAENGFLPSVLVGIRLNWDDRSNNDLEDSYGQQWTYEQRKIVEFTCHTAFFVSIVVVQWADVIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 107851 - DNA, 2670 bp, Aster yellows witches
  CDS (1)..(2670)
atgaaaaaagtaaatttgaaacgccaagaaacaattgattttttaaaaactatgagtcaaaaatcccaagaaaaaactttacaaacccttaattcttctttgaaaggattagatcaaaaacaagtaatgttgcatcaaagtttgtatggtaaaaatattttatcccaagaaactaaaaccagttttactaaacaattgctccaaattgcaattactccttttaatattgttttattaattttaactcttatttctttgtttaatgatgttcttactcccagtcaagaaaatagaagttattctaccgttataacaactattttaatgtttttgggttctgtaattgtccaatttagtcaagaaagcaaacatttaaaaattacttctcaattaaaaactttggtacaaaacacaactgcagtcaaacgcaataattttaaaatggaaattgctttagaagaagtagtaagaggagatattgttattctttcggcaggagatgttattccagctgatattaaattattagaaaccaaagatttttttgtaaaaacaacaacttttactggtgaatcagaaccggtagaaaaaatggcatgttcttttttacaaagtgaaacaattttagatgatcctaaattagttttggcaggttcaactgttatttctggttatgctacaggtattgttttagtcaccggcaaagacacttatttaggcaatatcagccaggaaattactaaaaaaaaatccctttcacacttagatcaaagcattaataccattgctaaattgcttatgatatgtatttgtttaatggcacctttagtatttttattcaatttttacaaacctcaaaatacttttttacaatcattcctttttgctcttaccattgcttttggacttactcccaaaatgcttcccttaattgttgctacttctttttctaaaggaattgttgctttatctaagcgcaaagtaattgttaaaaacctaaatgctatttctagttttggagcaatgaatattttatttactgacaaaacaggaacccttactgaagaccaaatctttttggaaaatttcttagaccttaacggcaacgaagatatacgcgttttgcgtcatgcctatctgaatagtttttttcaaacagggcttaaaagtttaattgataaagccatcattaccaaaacaaataatgccaaaactctacatccttctttacaaggaattactgcacaatttaccaaaattgatgaaattccttttgattttaaaagaagaaaaatgagtgtagtaatacaagatgcctcacaaaaacaacaaatgattactaaaggagcaattgaagaaatactttctatttgtgatcatgtagaacttgaaggcaaagttgttcctttgagtgaccaaagcaaacaaatagtccttcaacaaaccataacttacaatcaaaaaggttatcgcgtagttggagtagcccaaaaacttatctcaaatcccaagcaacaaccttgttttactcctggacaaattgaagaaaaatcaatggttctaatcggattgcttacttttttagatcccattaaagaaagttcaacccaaacaatttcttctttgcaacaaaaaggtattatcgttaaaatccttacaggagacaacgatattcttactaaagctattgcccaaaaattaaatattcaaacaacttattgtcttcaagggagtgttgttgataatttaagcgatgatgctctttacgaagcttctcaaaaaaccaatctctttactaaattatcccccgaacaaaaagcaagaattgtatctgttttcaaacaaaaaggcaatatcgttgcttttatgggagacggcattaatgatgcttctgccatgaagcaagctaatttaggtatttgtgtcgatagtggtgctgaaattactaaagaaattgcagatattattttattagaaaaacaacttaccgttttagaacaaggagttttagaaggaagaaaaacctatactaacgcccttaaatacattaaatttactctatcgtctaattttgccaattctctcagtattttacttgctagtttatgccttaattttcaacctatgatagttttacaagttttatttttagaccttatatatgatttgatttgttttgctattccttttgataatgttgatgatttttatttacaaaaaccatgtaaatgggattttgcaagcattaaaagttttatgttatggtttggtttttgttctttcttgttggattttgcttttttaattggaatgaaatttcttttaaaaaacttatcccaaaacgatcgattattccaaactagttggtttattttttcaatgtggtcacaaacattaaccattttcttactgagaactgacaaaattattgctaaaaacaatcaaaaaaaccttccctctttccttattatggtatgttgttgtctaggtttgataattactactttccttcctttaatacctattgtaagtcaagcgcttcatttagatcaatcaatttttgaaaaaactacaattttcccctttttgttatttttagtagttatttattcattagttatgatatgggctaaaaaaatatttattcaaaaacacaaacaattattataa

SEQ ID NO: 107852 - protein, 889 aa, Aster yellows witches
MKKVNLKRQETIDFLKTMSQKSQEKTLQTLNSSLKGLDQKQVMLHQSLYGKNILSQETKTSFTKQLLQIAITPFNIVLLILTLISLFNDVLTPSQENRSYSTVITTILMFLGSVIVQFSQESKHLKITSQLKTLVQNTTAVKRNNFKMEIALEEVVRGDIVILSAGDVIPADIKLLETKDFFVKTTTFTGESEPVEKMACSFLQSETILDDPKLVLAGSTVISGYATGIVLVTGKDTYLGNISQEITKKKSLSHLDQSINTIAKLLMICICLMAPLVFLFNFYKPQNTFLQSFLFALTIAFGLTPKMLPLIVATSFSKGIVALSKRKVIVKNLNAISSFGAMNILFTDKTGTLTEDQIFLENFLDLNGNEDIRVLRHAYLNSFFQTGLKSLIDKAIITKTNNAKTLHPSLQGITAQFTKIDEIPFDFKRRKMSVVIQDASQKQQMITKGAIEEILSICDHVELEGKVVPLSDQSKQIVLQQTITYNQKGYRVVGVAQKLISNPKQQPCFTPGQIEEKSMVLIGLLTFLDPIKESSTQTISSLQQKGIIVKILTGDNDILTKAIAQKLNIQTTYCLQGSVVDNLSDDALYEASQKTNLFTKLSPEQKARIVSVFKQKGNIVAFMGDGINDASAMKQANLGICVDSGAEITKEIADIILLEKQLTVLEQGVLEGRKTYTNALKYIKFTLSSNFANSLSILLASLCLNFQPMIVLQVLFLDLIYDLICFAIPFDNVDDFYLQKPCKWDFASIKSFMLWFGFCSFLLDFAFLIGMKFLLKNLSQNDRLFQTSWFIFSMWSQTLTIFLLRTDKIIAKNNQKNLPSFLIMVCCCLGLIITTFLPLIPIVSQALHLDQSIFEKTTIFPFLLFLVVIYSLVMIWAKKIFIQKHKQLL

SEQ ID NO: 107853 - DNA, 3205 bp, Juglans regia
  CDS (1)..(2871)
atggcggagaagcctgaagtattggatgctgttttgaaggaagttgtggatttggaaaacatacccattgaagaagtgtttgagaatctgagatgtagcaaggagggtctcaccacggtggctgccgaggagaggctggccattttcgggcacaacaagcttgaagagaaaaaagatagcaaattcctgaagtttttggggttcatgtggaaccctttgtcttgggtgatggaagctgctgctatcatggcgattgcgcttgcgaatggaggagggaagcccccagactggcaagattttgtgggtatcatagtcctactttttatcaattcaacaattagtttcattgaggaaaacaatgctggtaatgctgcggcggctctcatggctcgtctagctccaaaagcgaaggttcttcgagatggaaagtggagtgagtatgatgctgcggtactagttcctggtgacattgtcagtattaaactgggagatattataccggctgatgctcgacttcttgatggagatccattgaaaattgaccagtctgcacttactggtgagtcgcttcctgtgacgaaaggtcctggagatggtgtctactctggttcaacttgcaaacagggagaaattgaagctgtggtcattgccactggggtccatacattctttgggaaggctgctcaccttgttgacaccaccaaccaagtgggccacttccaaaaggtcttgactgcaattggcaatttctgtatatgttcaattgctgtgggtatgattatagagataattgtcatgtatcctattcaagaccggaagtatcgccctggaattgacaatcttctagttcttctcattggaggaattccgattgccatgcctacagttctctctgttacaatggctattggttctcataggttatctcagcagggagctatcacaaagaggatgacagcaattgaagagatggcaggcatggacgtactttgcagtgacaagactggaacattgacactgaacaagcttagtgttgacaaggctcttattgaggttttcaccaaaggagttgatgcggatgctgttgtcctgatggctgctcgagcctctagagtggagaatcaagatgcaattgattcggctatagttgggatgttggctgatccaaaggaggcacgtgctggaattcaagaagtgcatttcctcccttttaatcctactgataagcgaacagccttgacttatattgaccgtgatggtaaaatgcacagagtcagcaaaggtgcaccagaacagattctgaaccttgcacataataagtcagacattgagcgtagagttcatgctgtgatcgataagtttgcagagcgaggtttacgatctcttgctgtcgcataccaggaagttccggaaggaaggaaagagagtgctggaggaccgtggcagtttatcggtctaatgcctctctttgacccgcctagacatgacagtgctgagacaataaggagggctttaaaccttggagtgaatgtgaaaatgattacaggtgatcaacttgcaataggaaaggaaaccggacgtcggttgggaatgggtacaaacatgtatccttcatctgctttgctaggacagaacaaggatgagtctattgctgctttaccaattgatgagctgatagagaaagctgatggctttgctggggttttccctgagcacaaatacgagattgtgaagcgcttgcaagcaaggaaacatatatgtggcatgactggtgatggagtgaatgatgcacctgctctcaaaaaagctgacattgggatagctgttgctgatgcaacagatgcagctcgcagtgcttctgacattgtcctcacagaacctggtcttagtgttatcattagtgctgtcttgaccagtcgggcaatctttcagaggatgaaaaactacacaatttatgcggtttccattactatccgtattgtgcttggcttcatgttgctcgcactaatatgggagtttgactttccgccctttatggtgcttatcattgccatcctcaatgatggtaccatcatgaccatatcaaaagatagggtgaaaccatctcctttaccggatagttggaagctgtctgagatttttacgacaggcattattcttggtagttacctggcaatgatgacagttatatttttctgggctgcatacaagacagacttcttcccgcgcatatttggggtgccgacccttgagaaaacagctcatgatgatatccgaaagcttgcttcagctatatatctgcaagtgagcatcattagtcaggccctcatatttgtgacacgatctagaagttggtccttcattgaacgtccggggtttttgcttgtagtggcttttattattgctcaactgattgccactttgattgctgtctatgctagctggagctttgctgcgattgaagggattggatggggttgggctggcgtgatctggctttataacataatcttctatttccctctcgatttcatcaagttttttatacgctatgctctaagtgggagggcttgggatcttgtcattgaacagaggattgctttcacgagacaaaaggactttgggaaggaacaacgggagctccaatgggcacatgcgcagagaacattgcatgggttgcagccacctgactccaagatgtttaccgaacgaacacatttcacagaactcaatcaaatagccgaagaagctaaaagaagagctgaaattgcaaggctgagagaactcaatacactgaaagggcatgtggaatctgtggtgagactgaagggccttgacatagacacaattcagcaatcatacacagtctgagggggacctcatttatcatctttactcagtactgtgaaagatgcttcaactagtgctgaagagtaaaaagcttcgatcaacagccttgtgagtttacccccaaacaactttttgatattgtgatatgctaaaatgcccatttccagattttatgtacttttgtgtttttggacccctttgtaatgcacaataatagtgagtgctttataatattgatgtggcatatgttctgttgttatgggtaaaactagtgaatttacccagaacttagacaaccagagtataagaacagcaattcagagaaaaaaaaaaaaaaaaaaaaaaaaaaaaaaaa

SEQ ID NO: 107854 - protein, 956 aa, Juglans regia
MAEKPEVLDAVLKEVVDLENIPIEEVFENLRCSKEGLTTVAAEERLAIFGHNKLEEKKDSKFLKFLGFMWNPLSWVMEAAAIMAIALANGGGKPPDWQDFVGIIVLLFINSTISFIEENNAGNAAAALMARLAPKAKVLRDGKWSEYDAAVLVPGDIVSIKLGDIIPADARLLDGDPLKIDQSALTGESLPVTKGPGDGVYSGSTCKQGEIEAVVIATGVHTFFGKAAHLVDTTNQVGHFQKVLTAIGNFCICSIAVGMIIEIIVMYPIQDRKYRPGIDNLLVLLIGGIPIAMPTVLSVTMAIGSHRLSQQGAITKRMTAIEEMAGMDVLCSDKTGTLTLNKLSVDKALIEVFTKGVDADAVVLMAARASRVENQDAIDSAIVGMLADPKEARAGIQEVHFLPFNPTDKRTALTYIDRDGKMHRVSKGAPEQILNLAHNKSDIERRVHAVIDKFAERGLRSLAVAYQEVPEGRKESAGGPWQFIGLMPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWEFDFPPFMVLIIAILNDGTIMTISKDRVKPSPLPDSWKLSEIFTTGIILGSYLAMMTVIFFWAAYKTDFFPRIFGVPTLEKTAHDDIRKLASAIYLQVSIISQALIFVTRSRSWSFIERPGFLLVVAFIIAQLIATLIAVYASWSFAAIEGIGWGWAGVIWLYNIIFYFPLDFIKFFIRYALSGRAWDLVIEQRIAFTRQKDFGKEQRELQWAHAQRTLHGLQPPDSKMFTERTHFTELNQIAEEAKRRAEIARLRELNTLKGHVESVVRLKGLDIDTIQQSYTV

SEQ ID NO: 107855 - DNA, 3882 bp, Oncorhynchus mykiss
  CDS (22)..(3060)
gagagttgaaacgctgcaagcatggggaaagggagtggtgctgaatatggagacggaaagaagaagaagaagaaggagcaggaactggatgagctcaagaaggaggtgtccatggatgatcacaagatatcattggacgatctgggaagacgctacggagtcgacctggctcggggtctgaccaatgccaaggctctggaggtgctggccagggaggggcccaacgtgttgactcctcctcccaccaccccagagtgggtgaagttctgccgtcagctgttcgggggtttctccttgctcctctggatcggtgccatcctctgcttcctggcctacagtattcaggtggccacagaggacgagccagccaatgacaacttgtacctgggtgtggtcttgtcagctgtggtcatcataactggctgtttctcctactaccaagaggccaagagctcacgcatcatggactccttcaagaacatggttcctcagcaagccctagtgatcagggaaggagagaagatgacgatcaatgcagagctagtggtgaggggagacctggtggagatcaaaggaggagacaggatccctgccgacctccgagtcgtctcagccgcgggctgcaaggtggataactcctctctgactggagaatcagagcctcagacacgcacaccggagttcacccatgagaaccccctggagactcgaaacatcgccttcttctcaaccaactgtgtggagggtacagcccatggcgtagtagtagggactggagaccacacagtgatgggtcgtattgccaccctggcctctgggctggagacgggccagactcccatcaatatggagattgaacacttcattcaactgatcacggccgtggctgtattcctgggggtcagctttttcatcctggccatcatcctggggtacacctggctggaggccgtcatcttcctcattggcatcatcgtcgccaacgtccccgagggcctgctggccacagtcactgtatgtctcaccctcactgccaagcgtatggccaagaagaactgcctggtcaagaatctggaggctgtggagaccctgggttctacatccaccatctgttccgacaagacaggcaccctgacccagaaccgcatgaccgtggcccacatgtggttcgacaacatgatccatgaggccgacactacggaggaccagtctggtgctacctttgacaagagctcggctacatggcatgctctgtcccgcgtggctggactctgtaaccgtgctgagttcaaagccgggcaggaaaccctccccattctgaagagggacactgcgggcgatgcgtcggaatctgctctgttgaaatgtattcagctctcctgtgggtgtgtccgctccatgagagaaagaaacgccaaagtgggagagatacccttcaactcaaccaacaagtaccagctatccattcatgaacaagaggacaatgaaaatggccacctactcgttatgaagggagcacctgaaagaatattggacaggtgcagcaccatcttgatccacggccaggaggttccaatggacgccaactggaacgaagctttccagagtgcctacatggagctgggagggctgggagagagagttctagggttctgccacttgccactgtctccggcccagttccctcggggcttctcctttgactgtgaggaagtcaacttccctataaaagggctgtgtttcgtcggtctcatgtccatgattgaccctcctcgcgccgccgtccccgatgctgtgggaaaatgccgctccgcagggattaaggtcatcatggtgactggcgaccatcccatcactgccaaagccatcgctaaaggcgtgggtatcatctccgagggcaacgagactgtggaggacatcgctgaaagactaaatattcccctgagtcaagtcaaccccagggatgcaaaggcctgtgtggtacatggaggggacctgaaggacatgagtgcagagtacctggatgacctactcaggaaccacactgagatagtgttcgcccgcacatcacctcagcagaaactcatcatcgtagagggctgccagagaacgggggcaatcgtggcggttactggggacggagtgaacgactcgcctgccctgaagaaggctgacattggggttgctatggggattgctgggtctgacgtctccaagcaggctgcagacatgatcctcctggatgacaatttcgcctctattgtcactggagtggaggaaggtcgtctgatctttgataacttgaagaagtctatcgcctacacactgacaagtaacattccagagatcagccccttcctcctcttcatcattgccagcattcccctgcccctgggcaccgtcaccatcctctgtatcgacttgggcacagacatggttcctgctatctcattggcctatgagacggctgagagtgacattatgaagcgtcagcccaggtgcccaaagacagacaagctggtgaacgacagactgatcagcatggcctacggacagataggtatgattcaggctctggctggctttttcacctactttgtgatcctggctgagaatggcttttggccagagaccctgctgggcatccgtctgaactgggacgaccgtgccaacaacgaggtggaggacagctatggacagcagtggacctacgaacagcggaagattattgagttcacgtgtcacacctcgttcttcgtgagcatcgtggtggtgcaatgggccgacgtgattatctgcaagaccaggaggaactctgtctttcagcagggcatgaagaatcgtatcctgatctttggcctgtttgctgagactgctttggctgcatttttatcctactgcccaggaatggacatcgccctccgcatgtatcccctgaaggtctcctggtggttctgtgccctcccctacagtctactcatcttcatctacgatgaggtccgcaagctcatcatcaggaggtatcctggaggttgggtggaactggagacatattactaacgttcacaaatgtgttattgttaagattgaatttctgtgtgtgtgtgaatgagtgagtacgtgtgtatgcaaggtctagctaagcaaagaacagcaaaactaccttacaatttgtattttgtctttgaaaataacaaacaagcctacgtaatcagtaaatcagaaaatcagcctacattatcactgaaaataaacgtacattaccactgtaactgctgccagtgtgtgtgtgtgtgtgtgtgtgtgtgtgcgtgtgcgtgtgtacactaagtgtacaaaacattaggaacaccttcctaatattgagttgcacccccttttgccctcagtacagcctcaatttgtcagggtcatggactctacaaggtgtcgaacgcgttccacagggatgctggcccatgttgactccaatgcttcccacagttgtgtcaagttggctggatgtcctttgggtggtggaacattcttgatacacgcgggaaactgttgagcgtgaaaaacccagcagcgttgcagttcttgacacaaaccggtggacctggcacctactaccataccctgtttaaaggaacctagatattttgtcttgaccattcaccctctgaatggcacatacgccatccatgtctcaaatgtctcaaggcttaacaatcgttctttaaccggtctcctccccttcatctacacggattgaagtcaattcaacaagtgacattaataagggatcatagctttaacatggattcacctcgtcattctatgtcatggaaagagcaggtgttcataatgttttgtatactcagagatgtgtgtttttacaga

SEQ ID NO: 107856 - protein, 1012 aa, Oncorhynchus mykiss
MGKGSGAEYGDGKKKKKKEQELDELKKEVSMDDHKISLDDLGRRYGVDLARGLTNAKALEVLAREGPNVLTPPPTTPEWVKFCRQLFGGFSLLLWIGAILCFLAYSIQVATEDEPANDNLYLGVVLSAVVIITGCFSYYQEAKSSRIMDSFKNMVPQQALVIREGEKMTINAELVVRGDLVEIKGGDRIPADLRVVSAAGCKVDNSSLTGESEPQTRTPEFTHENPLETRNIAFFSTNCVEGTAHGVVVGTGDHTVMGRIATLASGLETGQTPINMEIEHFIQLITAVAVFLGVSFFILAIILGYTWLEAVIFLIGIIVANVPEGLLATVTVCLTLTAKRMAKKNCLVKNLEAVETLGSTSTICSDKTGTLTQNRMTVAHMWFDNMIHEADTTEDQSGATFDKSSATWHALSRVAGLCNRAEFKAGQETLPILKRDTAGDASESALLKCIQLSCGCVRSMRERNAKVGEIPFNSTNKYQLSIHEQEDNENGHLLVMKGAPERILDRCSTILIHGQEVPMDANWNEAFQSAYMELGGLGERVLGFCHLPLSPAQFPRGFSFDCEEVNFPIKGLCFVGLMSMIDPPRAAVPDAVGKCRSAGIKVIMVTGDHPITAKAIAKGVGIISEGNETVEDIAERLNIPLSQVNPRDAKACVVHGGDLKDMSAEYLDDLLRNHTEIVFARTSPQQKLIIVEGCQRTGAIVAVTGDGVNDSPALKKADIGVAMGIAGSDVSKQAADMILLDDNFASIVTGVEEGRLIFDNLKKSIAYTLTSNIPEISPFLLFIIASIPLPLGTVTILCIDLGTDMVPAISLAYETAESDIMKRQPRCPKTDKLVNDRLISMAYGQIGMIQALAGFFTYFVILAENGFWPETLLGIRLNWDDRANNEVEDSYGQQWTYEQRKIIEFTCHTSFFVSIVVVQWADVIICKTRRNSVFQQGMKNRILIFGLFAETALAAFLSYCPGMDIALRMYPLKVSWWFCALPYSLLIFIYDEVRKLIIRRYPGGWVELETYY

SEQ ID NO: 107857 - DNA, 3631 bp, Trypanosoma brucei
  CDS (78)..(2840)
aacgctattattagaacagtttctgtactatattgacttgtaacatctaaggtagtaaaggtcaaaggaatatacaaatgggggatactggaccaaagggtgttccgggaaccaacgacgccggtgaagtgcacaagccacagaaaccgcaacgccgccaatctgtgctatcaaaggctatcagtgagcaccgtgagggtgatgatggcagtgtaccgctgcttccgccctcgaagggattgacatccgcggaagcagaggagttgttgcttaaatacggtcgtaacgagctgccggaaaagaaaacacccagttggctgatatttttgcggaatctatggggccctatgccgattgttttgtggattgtcataataatccagtttgcgttacagcactttgctgatggtgccgtcctgctcggcattcagctcgctaacgctctcattgggtggtatgagacgataaaagctggtgatgcggtcgctgcactgaagaactctttgaaacctattgcgaccgcttaccgtgacggtacctggcagcagatagacgccgcattactggttcccggtgaccttgtgaagcttgggtctggttccgccgttcccgctgactgcacgattaacgaaggtgtgattgacgttgacgaagcagcactgaccggtgagtcacttcctgtgacgatgggaacggaacacatgccgaagatggggtcgaatgtcgtacgtggtgaagttgaggcgacggtgcaatacacaggtcagagcaccttttttggcaagacggcaacgctacttcagtctgtggaggctgacattggcagtatccgtataattctcatgcgcgtgatggtcatcttgtcgagtttctcgttcgtactttgcttggcttgcttcatctatctgatggtaaatttcaagcaaaagttccgtgatgccttgcagttcgctgttgtagtgcttgtggtatccattcctattgctttggagattgttgtgacgaccactctcgctgtgggttcaaagaagctgtcgaagcacaaaatcattgtgacgagactgacagccattgagacaatgtctggtgtgaacatgctttgctctgacaaaaccggtactctgacgttgaacaagatggagattcaggaacagtgcttcacatttgagaagggtcacgatctgcgttcactgcttgtactttccgcgcttgcagcaaagtggcgtgagcctccccgtgatgcactggacacgatggtacttggtgctgcagatctggacgagtgcgacaactacgagcagcttgagttcgtgccatttgatccaacgacgaaacgaacggccgctacattggttgataagcgaagtggtgagaagttcagtgtgacgaaaggcgcaccacacgtgatactacaaatggtgtacaatcaagatgagatcaatgactctgtggtcgatatcattgacaaattggcgtcgcgcggtatccgatgcctctctgtggcgaaaacagactccgcgggtcgttggcatctctgtggaatcctgacgttcctcgatcccccgcgcccggacacgaaggagacaattcgccgtagtaggcagtatggcgtggatgtaaagatgatcactggtgaccatgtgctcattgcgaaggaaatgtgccgcatgctggaccttgatccgaacatcctaaccgttgagaagcttcccaaggtggatgtcaataatatgcccagcgaccttggcgagaagtacggtgacatgatgctgagtgtcggcgggttcgcacaggtcttccccgagcacaagtttttgatcgttgaggcgcttcggcagcgcgggtacacgtgcgcgatgactggtgatggtgtgaacgacgcgcctgccctgaaacgtgcggacgtcggtattgctgtacacggcgcgacagacgccgctcgtgccgcggcagacatggtgctgacagaccctggtttgagtgttgttgttgatgcgatgtttgtatcgcgccaggtgttccaacgtatgttgtcttttctaacataccgtatttccgccacgctgcagttggtgtgcttcttttttatcgcctgcttctcgttgacacctcacgactatggaattgaggaccccaaattccaggttttctacctcccagtgatgatgttcatgctgatcacgctcctgaacgacgggtgcctgatgaccattggatatgaccgtgtggtgccctcgaagcttccgcagcgttggaacattcctgttgtgttcacaagcgctataattatgtctgttgttgcctgtgcctcgtctctactactgctgtggatggctcttgatgcttatgatgagaaaaggtaccccaactcttggtttggcaaactcaacattccttccttgaaggagggcaaaatagttactctcctgtacctcaagatatcgatttctgacttcttgactctattctcctcacgtactggtggaaggttctttttctcgatggctccgggcactatactgctggtcggtgcggtgatctcactggtaatctcgacgatcgccgcctcggtttggaagaaatcaagttctgatggtgtgccgacggagggtcttgcggttggaggagataccgcagcgaagctgttgccgctttgggtttggatatattgcattttgtggtggatcgtccaagatgtcgtgaaggttcttgctcacatgctaatggaggccttcgacatatttggctgtgtgtcgcgttctgggagaggggccgatgttgagtgtggcagcgtgtgtaaagatggtgagggtggtgcacctaaagaacctacgctataatgaatctaaagtaacatgacgtgacaatgatgttcctccgtctgacgtgccctagtttgtttcctgctcgttgtgagtggaatgttcctctgcgatctcggtagcaacggactggagtgggaaaggaagaacttcgcgtgctgcacttgtgtggcacgcaaagtggatgctttaccgagtttataggccgtgtcatggattcagtcaattacacgtccatgtgtttctcatttcagatgtgcttttgatgcgttgcgtactgcagagcgtttaactctttaccttccctcttctccggttgtttgagttgggtgattggatgctgtgcgacaactcagcgtgtgtgcagagggacccgcaacgcagcagggacatttggtggagaacccgcgacgaatggcctgtggggggatggagggacacaagaagtggatgtgtacggggtaatgtaaacaacatcgcataagtgatgtataactttgcatgatgggtggggggaaagtatgggaaagtgcagtaagggggggcagggtattggtgccaccaacaccgaataatgtatccaacattaataagagaataattgcaagcaaaagtaagaaaaatactgaaaagaaagggaattggatggagagtgtaaaggcgtttttgtgatgttgctcattgcagctctaatgtgcatgtggctacttgtatgtacactttcaatgcgggagggtcgagtttaccaacaacttccggacctatagttcattaatacctttgataaccattgaaaaaaaaaaaaaaaa

SEQ ID NO: 107858 - protein, 920 aa, Trypanosoma brucei
MGDTGPKGVPGTNDAGEVHKPQKPQRRQSVLSKAISEHREGDDGSVPLLPPSKGLTSAEAEELLLKYGRNELPEKKTPSWLIFLRNLWGPMPIVLWIVIIIQFALQHFADGAVLLGIQLANALIGWYETIKAGDAVAALKNSLKPIATAYRDGTWQQIDAALLVPGDLVKLGSGSAVPADCTINEGVIDVDEAALTGESLPVTMGTEHMPKMGSNVVRGEVEATVQYTGQSTFFGKTATLLQSVEADIGSIRIILMRVMVILSSFSFVLCLACFIYLMVNFKQKFRDALQFAVVVLVVSIPIALEIVVTTTLAVGSKKLSKHKIIVTRLTAIETMSGVNMLCSDKTGTLTLNKMEIQEQCFTFEKGHDLRSLLVLSALAAKWREPPRDALDTMVLGAADLDECDNYEQLEFVPFDPTTKRTAATLVDKRSGEKFSVTKGAPHVILQMVYNQDEINDSVVDIIDKLASRGIRCLSVAKTDSAGRWHLCGILTFLDPPRPDTKETIRRSRQYGVDVKMITGDHVLIAKEMCRMLDLDPNILTVEKLPKVDVNNMPSDLGEKYGDMMLSVGGFAQVFPEHKFLIVEALRQRGYTCAMTGDGVNDAPALKRADVGIAVHGATDAARAAADMVLTDPGLSVVVDAMFVSRQVFQRMLSFLTYRISATLQLVCFFFIACFSLTPHDYGIEDPKFQVFYLPVMMFMLITLLNDGCLMTIGYDRVVPSKLPQRWNIPVVFTSAIIMSVVACASSLLLLWMALDAYDEKRYPNSWFGKLNIPSLKEGKIVTLLYLKISISDFLTLFSSRTGGRFFFSMAPGTILLVGAVISLVISTIAASVWKKSSSDGVPTEGLAVGGDTAAKLLPLWVWIYCILWWIVQDVVKVLAHMLMEAFDIFGCVSRSGRGADVECGSVCKDGEGGAPKEPTL

SEQ ID NO: 107859 - DNA, 2679 bp, Onion yellows phytoplasma
  CDS (1)..(2679)
atgattaatatgaaaaaagtaaatttaaaacgccaagaaacaattgattttttaaaaactatgagtcaaaaatcccaagaacaaactctacaaacccttaattcttcttttcaaggattagatcaaaatcaagtaatgttgcatcaaagtttgtatggtaaaaatattttatcccaagaaatcaaaaccatttttactaaacaattactccaaattgcaattactccttttaatattgttttattaattttaactcttatttctttggttaatgatgttcttactcccagtccagaaaatagaagttatgctactattataactactattttaatgtttttgggttctgtcattgtccaatttagtcaagaaagtaaacatttaaaaattacttctcaattaaaaactttggtacaaaatacaactgcagttaaacgaaataattctaaattggaaatcgctttagaagaagtagtaagaggagatattgttattctttcggcaggagatattattccagctgatattaaattattagaaactaaagatttttttgtaaaaactactacttttactggtgaatcagaaccagtagaaaaaatggcgtgtgcttttttacaaagtgaaactattttagacgatcctaaattagttttagcaggttcaactgttatttctggttatgctacaggtattgttttagtcaccggaaaagatacttatttaggtaatatcagccaggaaattactaaaaaaaaatccctttcacacttagatcaaagtattaataccattgctaaattacttatgatatgtatttgtttaatggcgcctttagtatttttattcaactttaaaaaacctcaaaatactttattacaatcatttctttttgctcttactattgcctttggacttactcctaaaatgcttcccttaattgttgctacttctttttctaaaggaattgttgctttatccaagcgcaaagtaattgttaaaaacctaaatgctatttctagttttggagcaatgaatattttatttactgacaaaacaggaacccttaccgaagaccaaatctttttggaaaatttcttagaccttaatggcaacgaagatatccgcgttttgcgtcatgcctatctgaatagtttttttcaaacagggcttaaaagtttaattgataaagccattattaccaaaacaaataatgcccaaactctacatccttttttacaaggaatcaccgagcaatttaccaaaattgatgaaattccttttgattttaaaagaagaaaaatgagtgtagtaatacaagatgtttcccaaaaacaacaaatgattactaaaggagcaattgaagaaatacttgctatttgtgatcatgtagaacttgaaggcaaagttgttcctttaagtgaccaaagcaaacaaatagtcctgcaacaaaccataacttataatcaaaaaggttatcgcgtagttggagtagcccaaaaacttatctcaaatcccaaacaacaaccctgttttactcctggacaaattgaagaaaaatcaatggttctaatcggattgcttacttttttagaccctattaaagaaagttcaacccaaactattgcctctttgcaacaaaaaggtattattgttaaaatccttacaggagacaacgatattcttaccaaagctattgcccaaaaattaaatattcaaacaacttattgtcttcaaggaagtatcatcgataatttaagtgatgatgctctttacgaagcttctcaaaaaactaatctttttactaaattatcccccgaacaaaaagcaagaattgtatctgtttttaaacaaaaaggcaatatcgttgcttttatgggtgacggaattaacgatgcttctgctatgaaacaagctaatttaggtatttgtgttgatagtggtgctgaaattactaaagaaattgcagatattattttgttagaaaaacaacttatcgttttagaacaaggagttgtagaaggaagaaaaacctatactaacgcccttaaatacattaaatttactctatcttctaattttgccaattccctcagtattttgcttgctagtttatgtcttaattttcaacctatgatagttttacaagttttatttttagaccttatctatgatttgatttgttttgctattccttttgataatgttgatgatatttatttacaaaaaccacgcaaatgggattttgcaagtattaaaagttttatgttatggtttggttttttttctttcttattggatgtggcttttttaattggaatgaaatttattttaaaaaacttatcccaaagtccacaattatttcaaactagttggtttattttttcaatgtggtcacaaacattaacccttttcttactgcgaactgacaaaattattgctaaaaacaatcaaaaaaaccttccttctttccttattatgtcatgttgttgtttaggtttggtaattactactttccttcctttaatgcctattgtaagtcaagcccttaatttagataaatcaatttttgaaaaacctacaattttttcctttttgttatttttagtagttatttattcattagttatgatatgggctaaaaaaatctttattcaaaaacacaaacaattattataa

SEQ ID NO: 107860 - protein, 892 aa, Onion yellows phytoplasma
MINMKKVNLKRQETIDFLKTMSQKSQEQTLQTLNSSFQGLDQNQVMLHQSLYGKNILSQEIKTIFTKQLLQIAITPFNIVLLILTLISLVNDVLTPSPENRSYATIITTILMFLGSVIVQFSQESKHLKITSQLKTLVQNTTAVKRNNSKLEIALEEVVRGDIVILSAGDIIPADIKLLETKDFFVKTTTFTGESEPVEKMACAFLQSETILDDPKLVLAGSTVISGYATGIVLVTGKDTYLGNISQEITKKKSLSHLDQSINTIAKLLMICICLMAPLVFLFNFKKPQNTLLQSFLFALTIAFGLTPKMLPLIVATSFSKGIVALSKRKVIVKNLNAISSFGAMNILFTDKTGTLTEDQIFLENFLDLNGNEDIRVLRHAYLNSFFQTGLKSLIDKAIITKTNNAQTLHPFLQGITEQFTKIDEIPFDFKRRKMSVVIQDVSQKQQMITKGAIEEILAICDHVELEGKVVPLSDQSKQIVLQQTITYNQKGYRVVGVAQKLISNPKQQPCFTPGQIEEKSMVLIGLLTFLDPIKESSTQTIASLQQKGIIVKILTGDNDILTKAIAQKLNIQTTYCLQGSIIDNLSDDALYEASQKTNLFTKLSPEQKARIVSVFKQKGNIVAFMGDGINDASAMKQANLGICVDSGAEITKEIADIILLEKQLIVLEQGVVEGRKTYTNALKYIKFTLSSNFANSLSILLASLCLNFQPMIVLQVLFLDLIYDLICFAIPFDNVDDIYLQKPRKWDFASIKSFMLWFGFFSFLLDVAFLIGMKFILKNLSQSPQLFQTSWFIFSMWSQTLTLFLLRTDKIIAKNNQKNLPSFLIMSCCCLGLVITTFLPLMPIVSQALNLDKSIFEKPTIFSFLLFLVVIYSLVMIWAKKIFIQKHKQLL

SEQ ID NO: 107861 - DNA, 2763 bp, Onion yellows phytoplasma
  CDS (1)..(2763)
atgaataaaaaagaagaaattttgcaaatcagtcgtcttgataaagatgctgttgtcaaacatctaaacaccgatgcttgcggacttactgacaaacaagcccaagaaagacaaactctctacggtaaaaatattatcaaacaaggcgactcttttccgttttggcgacaattcataaaacaatttacctcggtaatggctattttattatggatagcagcattaatgatttttgtaattaatcccaaagaagcagccatcggtatttctattattttagttatcattgtaaatggcttattttctttttcccaagaatacaaagctgataaaatgttgtcttccttaggtaaaatgattcctaaaaaagttcaagtttaccgcaacaaaaaaatagaattaatggatgttattgaacttaccattggagatgtcatctttttagaaacaggaacccaagttccagtagatgcacgtattattcaatctaatagcttttttgttgacaactcaatgttatcaggcgaaaccattcctttaaaccgtactgaaatgccaaacctcgaagataatcattccattgctgaaatgcctaatttagtttatgcaggtactacagttactcaaggtagttgttttgcagttgtttatgctattggaaacaacacccaaattggagaagtttcaagcattgctcaaagcattgaaaaaggcaaaagccttctagaccaagaaatgaaccacattgttaaaaaagtaagtattattgcttcttgtgcagctttatttgtctttatgatttgttttttcaaagcagaaaaatataatatagattcttttagagcagcaattgtttgtgcagttggtatgttagttgcaaacattcctgaaggcttacttcctaccgttaatctaagtttagcagttggttctcaaagaatggctaaacaaaacgctttagttaaaaaaatctcttccctagaaaccctcagttctactactgttatttgtactgataaaacaggaactctaactcaaaaccaacttacagtaagaaaaattgtaactcctgatggcactatcaaattaaaaggttctggctataacgacgaacaaacatttagtgtttgcccaaacaatactgtctccaaaaaaggaattgaaaaattcttaattgcatcagttctatgctctgaggctaaattagttcctacgccaactaaaccccaccaatttgaattaatcggtaatcctactgaaggagctttattaattgctgctaaaaaatacggttacaacattgaagaagtaaaaaacaacttagaaatcatccaattaaacccatttacttccgaacgtaaaaaaatgagtgtcttagttaaaaacaaccaagaacctgcatatgacaccaattcacaatatctctttattaaaggagctcctaatattgtccttgaacaatgtcaaatgcaatacaaaggttctcaagtaagtccttttagccctcatgaaaaagaatctttccttaaacaaaacgaccaatttgcaagccaaggataccgcgttcttgctcttgcttacaaaaaaattgaacaaaatcctcccctagaagaagatatggttttcttaggttttgcagttaattacgacccaccaagagaagaagttaaagaagcagttaaaaacttaactcaagcaggactaaaaattactattattacaggagattacagtcttactgctgctgccattggtaaacaagtaggaatcatccaagacaagttcgttggtttagacggctgtgaccttgacaaaatgtctttagaacaattacaagaagtcctcaaaagccctcatccagttgtcttttcacgcactactcccaaacataaattaaaaattgttcaagcataccgcaacaatggagaagtagtaggagttactggcgacggagttaatgacattttagcccttaaagcagctcacataggaattgctatgggaaaagcaggcactgatgttgctcgtaatgctgctgatatgattttattagatgataattttgcaactatttccaaagctgttttagaaggacgttgtatttatgaaaacatcaaaaaattcataacttatgtctttgcttctaatatccctcaaatctttcctttcatcgctattgcttttttaggagttacagaaccttacttatatgttttacaaattttagcaattgatcttttaactgacttaattcctgctattgctctaggagctgaagaaactgacccaagtttattagtccaaaaaccacgtactaaaaacgaccatctaatggacgctaaagtattaaaacgtagttatggctttttaggaatagttgaaggtttaatgtctttagcatttttttgtgcagtttacaattttaatacaaaagacaacttcttcctagcttctactatggcatttggagctgttatctttgctcaagtaggaaacgcatttgcttgtcgttctaacaaactttacttttggcaaactatcaaaaaacctaataaaatattgtactatggtattataattgaagtattattctttgtattaattactaaatttagttctttaagtgatatattccatactaaggatattaatatatctcattatttatgtttattattatgtcctttagttatgttattatttgatactatctggaaaaaagtatttgcatttaagaaccaaaaacaatcaaaaataaactaa

SEQ ID NO: 107862 - protein, 920 aa, Onion yellows phytoplasma
MNKKEEILQISRLDKDAVVKHLNTDACGLTDKQAQERQTLYGKNIIKQGDSFPFWRQFIKQFTSVMAILLWIAALMIFVINPKEAAIGISIILVIIVNGLFSFSQEYKADKMLSSLGKMIPKKVQVYRNKKIELMDVIELTIGDVIFLETGTQVPVDARIIQSNSFFVDNSMLSGETIPLNRTEMPNLEDNHSIAEMPNLVYAGTTVTQGSCFAVVYAIGNNTQIGEVSSIAQSIEKGKSLLDQEMNHIVKKVSIIASCAALFVFMICFFKAEKYNIDSFRAAIVCAVGMLVANIPEGLLPTVNLSLAVGSQRMAKQNALVKKISSLETLSSTTVICTDKTGTLTQNQLTVRKIVTPDGTIKLKGSGYNDEQTFSVCPNNTVSKKGIEKFLIASVLCSEAKLVPTPTKPHQFELIGNPTEGALLIAAKKYGYNIEEVKNNLEIIQLNPFTSERKKMSVLVKNNQEPAYDTNSQYLFIKGAPNIVLEQCQMQYKGSQVSPFSPHEKESFLKQNDQFASQGYRVLALAYKKIEQNPPLEEDMVFLGFAVNYDPPREEVKEAVKNLTQAGLKITIITGDYSLTAAAIGKQVGIIQDKFVGLDGCDLDKMSLEQLQEVLKSPHPVVFSRTTPKHKLKIVQAYRNNGEVVGVTGDGVNDILALKAAHIGIAMGKAGTDVARNAADMILLDDNFATISKAVLEGRCIYENIKKFITYVFASNIPQIFPFIAIAFLGVTEPYLYVLQILAIDLLTDLIPAIALGAEETDPSLLVQKPRTKNDHLMDAKVLKRSYGFLGIVEGLMSLAFFCAVYNFNTKDNFFLASTMAFGAVIFAQVGNAFACRSNKLYFWQTIKKPNKILYYGIIIEVLFFVLITKFSSLSDIFHTKDINISHYLCLLLCPLVMLLFDTIWKKVFAFKNQKQSKIN

SEQ ID NO: 107863 - DNA, 2631 bp, Listeria monocytogenes
  CDS (1)..(2631)
atgctttgggtaaaagagtcaattgagcaacttctcagcaaactacacacgaatttagacacagggttaacgaaagaacaagtgaaacaaaaacatgcagagttcgggacgaatgaatttgaagaggggaagaaagaatcacttcttcaaaaaattggtcaccatttagttgaaattacgacgattgtgttgctttttgcagcggcgatttccgcttatttagcgattacgactggttatggttgggcgaaagtggttgttattttaggaattgtcgtgttgaatatggtgctcggaatttaccaggaaaacagcgccgagaaagcacttgcggcacttcaaagtatgaatgcgcatttaacgacggtcgttcgtgatggtgtgcggatgcaagtggacgcaacggaattagtaccaggggatattattgaaattgttgcaggagatatgattccagcagatgcacggattatttctagtagcagtttgcaagtcgaggaatctgcgttaactggtgagagtgttccagttgaaaaagacgcaaatgcggttgtttcggaaaaagcgccaattggcgaccgtctgaatatgctttactcaggctgccttgtaacgaatgggcgcgccacggcggttgtcgtagaaattgggatggaaacagagatggggaaaattgctggacttttaaacagcacctcaaaactgatgacgcctttacaacttcgcttaaaagaattagcaaaacgacttagtattgtagcacttttagcaggtattttaatttttataattgatgtatatgtttacggtgaaacgattattgaaacgttgatgatcgcgatttctctagctgtagcagcagttcctgagacattgccagttattgtgacattgacacttgcttacggcgttcaaaatatggtgcggaaaaatacgattatccgccgaattcctgcagtagaaacaattggaaatacttcagttatttgttctgataaaacaggaacattaacgcaaaataaaatgattatccaacaaatttgggcagcagaccacgcaccgataaaagcaacagctgaatttgatactgcagaacaaaaagtattagaaatgttgagcctttccagtaacgcgacgattgatgttacagacggcgaagaaaccatcattggtgacccaaccgaaagcgcgattatccgtttactagaagaaaaaggaacaacgaaaaaagcattggaagccaaatatccacgcgtgttcgaacttccttttgactcagatagaaagctaatgacgacaattcaccaagtagaagacggatttctttccattacaaaaggtgcttttgaccgcattcccgtaaacttttccgaggcgtttttagcggaagcggagcgggtgcatgacagttttgcggaggatgcacttcgggtgttagttgttgcctataaaaaatatccggaaatgccgacagacttgtctagtgaggcgcttgagacagacttaacgttcgcggggatggttgggatgattgacccaccgagaccggaaagtaaagcggctgtgttagcggcgaaaaaagcgggtattaagactgtaatgattactggtgaccatattgtaacggcatcagcaattgcaaaagaaattggtattctaacggatggggacaaagcgattactggagcagaactggctgaaatgtcagaagctgatttggagaaaaacattcgagattatgcggtatatgcgcgtgttagtccagaagataaaattcgaatcgttaaagcttggcagaaaaatggtgaaattgtcacgatgacaggtgatggtgtaaatgatgcaccggctctaaaagcagcggatgttggtgctgcaatgggaattaccggaacagatgtatctaaaaacgctgcagatatggttataacagacgataattttgcaacgattgtagatgcagtcaaagaagggcgtacagcctatgagaatatccgcaaaacgatttactttttactaagtacaaacttttctcaaattttcattatgttaattgcgattattcttggctggggcgcgccggttgtagctgttcagttgctattaatcaacgttgtgtctgatgggattccaggcttcttcttaagtcgtgaaaaggcagatgactcgattatggagcgtaagccaattccaaaaaatgcagggatctttgcgaatggacttggcaagaaaatggcgacacaagcggttgtctttacgattgtgacacttgcaggattttatatcgggcagtttgtaacgattaataattcgattggtgcaagctatgaagttggaatgacaatggcattcgttattctagcatggtcatctgtcgcgcatattttcaatgtaagaagtgataaatcgattttcactatcggatttttatctaaccgtggtttgttctttagcgcgatttgttcgatgttgattattttaggacttgcgattattccaccacttgcgaacatgttcttcttagtagaaatgagcttaacgcactggattctcgcattcattctctcgatgttcccactcctattcgtagaaattcaaaagcttattcagcgaaaaagagcaaaagcttga

SEQ ID NO: 107864 - protein, 876 aa, Listeria monocytogenes
MLWVKESIEQLLSKLHTNLDTGLTKEQVKQKHAEFGTNEFEEGKKESLLQKIGHHLVEITTIVLLFAAAISAYLAITTGYGWAKVVVILGIVVLNMVLGIYQENSAEKALAALQSMNAHLTTVVRDGVRMQVDATELVPGDIIEIVAGDMIPADARIISSSSLQVEESALTGESVPVEKDANAVVSEKAPIGDRLNMLYSGCLVTNGRATAVVVEIGMETEMGKIAGLLNSTSKLMTPLQLRLKELAKRLSIVALLAGILIFIIDVYVYGETIIETLMIAISLAVAAVPETLPVIVTLTLAYGVQNMVRKNTIIRRIPAVETIGNTSVICSDKTGTLTQNKMIIQQIWAADHAPIKATAEFDTAEQKVLEMLSLSSNATIDVTDGEETIIGDPTESAIIRLLEEKGTTKKALEAKYPRVFELPFDSDRKLMTTIHQVEDGFLSITKGAFDRIPVNFSEAFLAEAERVHDSFAEDALRVLVVAYKKYPEMPTDLSSEALETDLTFAGMVGMIDPPRPESKAAVLAAKKAGIKTVMITGDHIVTASAIAKEIGILTDGDKAITGAELAEMSEADLEKNIRDYAVYARVSPEDKIRIVKAWQKNGEIVTMTGDGVNDAPALKAADVGAAMGITGTDVSKNAADMVITDDNFATIVDAVKEGRTAYENIRKTIYFLLSTNFSQIFIMLIAIILGWGAPVVAVQLLLINVVSDGIPGFFLSREKADDSIMERKPIPKNAGIFANGLGKKMATQAVVFTIVTLAGFYIGQFVTINNSIGASYEVGMTMAFVILAWSSVAHIFNVRSDKSIFTIGFLSNRGLFFSAICSMLIILGLAIIPPLANMFFLVEMSLTHWILAFILSMFPLLFVEIQKLIQRKRAKA

SEQ ID NO: 107865 - DNA, 2754 bp, Desulfovibrio vulgaris
  CDS (1)..(2754)
atggattctctgacaggaaagctctggcaccatctcagtgctgaaaaggctacggaagccctgcagaccgacccgcagaaggggctggacaccttcgaggtgcagcggcgggcggtagagttcggccccaacgctctcacaggacgtcgaggaaagacgcccctggagcggttcctgttgcaattccatcagccgctcatctatgtgctgctgctttccgggctcatcacggctgtgctgggcgaggtcgtcgactcttccgtcatcatcggtgtggtgctggtcaacgccatcgtcggctacattcaggaggccaaggctgccggtgcgctagaggcactggcccgttcgatggtggcagaggccgaggtcgtccggtcaggtggtgtccggcgtatcggcgccgtggacctcgtgcccggagacgtggtgctgttgcgcagcggcgataaagttcccgctgacttgcgtctcgtcactgtcaaagacctgcgggtcgacgaatcggcccttacgggagaatccgtacctgtctccaaggcggtgggcactctgccacgggagaccgttctcgcagaccgcaccaacatggcctacgcttcggcgctggtcacctacggcactgccacgggggtggtggtcgccacgggcgaccataccgaaatcgggcgtatctcgaccatggtgcatgaggccgacacactggcaacacccctcacccgccgtatcgagaagttcagtcacctgttgttgtgggccatcatggctcttgcggtgctgaccttcgtcgccggagtggcacgcggcgagaaggcagcggagatgttcatggcagcggtcgcgcttgcggtgggtgccatccccgagggccttccggcagccgtgacggtcattctggccattggcgtgtcgcgcatggcgtcgcgcggggccatcatccgtaaccttccggccgttgagactcttggcggggcttccgtcatctgttccgacaagaccggaacgctcaccgagaacaggatgaccgtcaccgccctctatgcggcgggcagacggtatgccgtaaccgggacaggctatcggcccaccggggacatcatgcccagtggcgagggatatgcgcctgccggtgatgatgcgcatcgtggacttgccatggctgaactttcgggccggaaggccctgttcgccacgttgctgggtggtgcgctttgcaatgatacccgcatcgaagcaacccccgaaggcgacaaggtcgagggcgaccccaccgaggccgcattgctggttgtggctgcgaaggcgggcattcatgtcgccgacgcgttgaggactgcgccccgcgcggatgccttgccgttcgagtccgagcatcagtacatggcgacgctgcatcatggcgaggctggcccggtggtctacgtgaagggttcggtcgaggccgtcctgtcacgcgcagaccggatgctgctggacgatggcacgctcgttccgcttgatgtcgcggcatttcgcgaagaggtcgaacgcatggcggtgcagggattgcgtgtgcttgcgttggcccagcgcgtggacggtgtgggtgtggcgcatctgacacatgatgatgtcgcgtccggacttgtcgtggtcgggttgcagggcatgatcgacccgcccagggccgaggcggtggcggctgtcgccgcattccatggtgcgggcgtgaaggtcaagatgataacaggcgaccatgccgtgacagccgccgccatcggcaagcagatcggccttggcgatgccggatgccccggcgaccccgcctgcaaggtgctcacgggtgcgcaacttgcgggactgaccgacgatgaactggtgcgtcatgccgctgagacatccatcttcgcgcgtgtcgcgccggaacagaagttgcgactggtcatggcgttgcagagcaggggcgaggtcgtcgccatgacgggggacggcgtcaacgacgcccccgcactcaagcaggcggacatcggcgttgccatggggcacggagggacagaggccgccaaggaagcttcggacatggtgctcaccgacgacaatttcgcgaccatcaaggctgccgtcgaagaggggcgcggcgtgtacgacaacctgctcaagttcatcgtgtggacgttgccgaccaaccttggcgaagggctggtcattctggtggcggtgctgcttggcatggcactgcccatccttcccgtgcagatattgtggatcaatatgacaaccgccagcatcctgggcatcatgctggcctttgagcccatggaaccgggcctcatgcagcgcaagccgcgcgacccggcgcaccccattctcgaccgtgagctcttccggcgcatcgttcttgtgggctcgctgcttctggtgtctgccttcggactctacaagttcgaactggcgcaggggcacacgcaggaggcggcacgtaccgttgcggtgaacgtgttcgttctggtgcagaccttctatctgttcaatagccggtctttcacccggtctcccttcgagcttggtatcatgagcaacccgtggacgttgctcggggcggcgtgcatgatcgtcttgcaggtggcgttcacctatgtgcctgtcatgaacgggctgttcggtagcgcccccataggactgggggcatggttgcgtatccttggtgtctcggtcctcgcctatggcgttgtcgaggcggacaagaagcttcgggccaggggtgcattgaagtaa

SEQ ID NO: 107866 - protein, 917 aa, Desulfovibrio vulgaris
MDSLTGKLWHHLSAEKATEALQTDPQKGLDTFEVQRRAVEFGPNALTGRRGKTPLERFLLQFHQPLIYVLLLSGLITAVLGEVVDSSVIIGVVLVNAIVGYIQEAKAAGALEALARSMVAEAEVVRSGGVRRIGAVDLVPGDVVLLRSGDKVPADLRLVTVKDLRVDESALTGESVPVSKAVGTLPRETVLADRTNMAYASALVTYGTATGVVVATGDHTEIGRISTMVHEADTLATPLTRRIEKFSHLLLWAIMALAVLTFVAGVARGEKAAEMFMAAVALAVGAIPEGLPAAVTVILAIGVSRMASRGAIIRNLPAVETLGGASVICSDKTGTLTENRMTVTALYAAGRRYAVTGTGYRPTGDIMPSGEGYAPAGDDAHRGLAMAELSGRKALFATLLGGALCNDTRIEATPEGDKVEGDPTEAALLVVAAKAGIHVADALRTAPRADALPFESEHQYMATLHHGEAGPVVYVKGSVEAVLSRADRMLLDDGTLVPLDVAAFREEVERMAVQGLRVLALAQRVDGVGVAHLTHDDVASGLVVVGLQGMIDPPRAEAVAAVAAFHGAGVKVKMITGDHAVTAAAIGKQIGLGDAGCPGDPACKVLTGAQLAGLTDDELVRHAAETSIFARVAPEQKLRLVMALQSRGEVVAMTGDGVNDAPALKQADIGVAMGHGGTEAAKEASDMVLTDDNFATIKAAVEEGRGVYDNLLKFIVWTLPTNLGEGLVILVAVLLGMALPILPVQILWINMTTASILGIMLAFEPMEPGLMQRKPRDPAHPILDRELFRRIVLVGSLLLVSAFGLYKFELAQGHTQEAARTVAVNVFVLVQTFYLFNSRSFTRSPFELGIMSNPWTLLGAACMIVLQVAFTYVPVMNGLFGSAPIGLGAWLRILGVSVLAYGVVEADKKLRARGALK

SEQ ID NO: 107867 - DNA, 2430 bp, Thermus thermophilus
  CDS (1)..(2430)
atgcttggcctcacttcagaagaagcgaagaaaaggctcagggagtacgggccaaacgccttgcccgagcgtcctgccgagcctttttcccgcaagcttctgcgccagttccaaagccctctcgtctacatccttctcctcgccctcctggtggacctcctcttatggctttatgagggggcgcggggcgttcccttggagtccttggtcatcctggccatcctgctcctcaacgccctcctcggcgccttccaggagaagcgctccgaggaggccttgaagcgcctcaaggccctggccgagccttccgtctgggtccttagggacggaaggtttcagcgcctttccgcccgcgggctcgtccctggggacgtggtgcgcctcgaggccggcgaccgcgtccccgcagacggcgtcctcctggaggggagcggcctcttggtggacgagagcgtcctcaccggggagagcgtccccgtggagaagggggtaggggaggaggtcttcgccgggacccttctcgtccggggccgggccctcttagaggtgacccgcacgggggcgcaaagcgccatgggccggatcgcccatctcctcgccgagatggaggaggagaagactcccctggagcgccgcctccacgcctttgggcaccgggtggcccgcctggtcttgcttcttgccttgggcctccttcttctggggttcctggtggagggggtttccgccaaggtggtcctcttcgccgtggccctggcggtggcggccgtccccgaggggcttcccgccgtcctcaccctggctttggccctgggggtggagaggatggcccggcgcaaggcggtggtgcggcgtctttcggcggtggaggccctggggagcgtcaccgtcatcgccaccgacaagacgggcaccctcacggaaaaccgcatggaggtccaggagctcctgagccccgacccggagaaggcccttttggccatggtcctctgcaacgacgccgacctcgccacgggggcgggggatccgctggagctcggcctcctccgctacgccagccgttttctggacgtggaaagggtgcggcgggaacacccccgcctttccgagcgcccctttgacagcgcgtggaagttcatgcgggtcaccactcccctagggagcttcctaaagggagcaccggaggccctcatcccccgcctggccctgccccaggaggagcaggcgaggctttttgaggaggccggggcccacgccgccaagggctttcgcgtcctggccctggctttcggggagggggagagggaggaggggctccgcttcttgggcttcgtcctcctgctggaccccccccgccccgaggtgcccgaggccgtggccagggtcttgaaggcgggggtgcgggtggtgatggtcaccggggaccacccggccaccgcccgcgccatcgcccggagggtggggatgccggcggaggtggtggccaccggggaggacctggagacgctttccgacgaggagcttttaaaggtggacgtcttcgcccgggtgaggcccgagcagaagctcaggatcgtggaggccctgcagaaggcgggggaggtggtggccatgaccggggacggggtgaacgacgccccggccctcaagcgggcggacgtgggcgtggccatgggccagaggggctcggacgtgagccgggaggtggcggacctggtgcttctggacgacaacttcgccaccatcgtggccgccatagaggaggggcggagcatctacgagaacatccagaagttcctgcgcttcctcttctccaccaacctctccgaggtcctggtggtggccctggggatggtcctcgccgccctcttgggcctccgcgacgaggccgggcaccttctcctccccctcaccgccgtgcagatcctctggatcaacctggtcaccgacgggcttcccgccctggccctgtccctggaccggaaccccggggtcctggaccgcccccccaggcccaaggaaagccctctcctggacgggccttccctccgcttcgtcctcctcaccggggccctgaaggcggggcttgccctggggcttttggggttccttcccggtgcggtgggcctcgaggccgcccagagcgccaccttccacttcatggccatcggccagctcttcttcgcctacgccgcccggcacaccgacctgaggccccttcccaacccttacctgcacggggccgtggggctcagcgccctggcccaggtggcgcttggggtggggttgcccggggcgttggaggcggtgcccctgcccttaggggtgtggcttctggttttcgggatggccctcctggccttcgccctggcggaagcggtggaccgggcggtgtggaaacggggggcggcctacgcgcccccccggtag

SEQ ID NO: 107868 - protein, 809 aa, Thermus thermophilus
MLGLTSEEAKKRLREYGPNALPERPAEPFSRKLLRQFQSPLVYILLLALLVDLLLWLYEGARGVPLESLVILAILLLNALLGAFQEKRSEEALKRLKALAEPSVWVLRDGRFQRLSARGLVPGDVVRLEAGDRVPADGVLLEGSGLLVDESVLTGESVPVEKGVGEEVFAGTLLVRGRALLEVTRTGAQSAMGRIAHLLAEMEEEKTPLERRLHAFGHRVARLVLLLALGLLLLGFLVEGVSAKVVLFAVALAVAAVPEGLPAVLTLALALGVERMARRKAVVRRLSAVEALGSVTVIATDKTGTLTENRMEVQELLSPDPEKALLAMVLCNDADLATGAGDPLELGLLRYASRFLDVERVRREHPRLSERPFDSAWKFMRVTTPLGSFLKGAPEALIPRLALPQEEQARLFEEAGAHAAKGFRVLALAFGEGEREEGLRFLGFVLLLDPPRPEVPEAVARVLKAGVRVVMVTGDHPATARAIARRVGMPAEVVATGEDLETLSDEELLKVDVFARVRPEQKLRIVEALQKAGEVVAMTGDGVNDAPALKRADVGVAMGQRGSDVSREVADLVLLDDNFATIVAAIEEGRSIYENIQKFLRFLFSTNLSEVLVVALGMVLAALLGLRDEAGHLLLPLTAVQILWINLVTDGLPALALSLDRNPGVLDRPPRPKESPLLDGPSLRFVLLTGALKAGLALGLLGFLPGAVGLEAAQSATFHFMAIGQLFFAYAARHTDLRPLPNPYLHGAVGLSALAQVALGVGLPGALEAVPLPLGVWLLVFGMALLAFALAEAVDRAVWKRGAAYAPPR

SEQ ID NO: 107869 - DNA, 2532 bp, Leptospira interrogans
  CDS (1)..(2532)
atggaaattgaaaaagacaaactttctcatttttggagtttaacttccaacgaatgtctaacacttacccaatccaatcgaaatggtttatccgaagaagaagcaaaaaaacgtcttcttcaatttggtgaaaataaactttcttctaaaaaagaaactaccgcaattggtttatttttttctcaatttaaaagtccgatcgttttacttctgttattcgccgctggattatccgtaatcgttcaggactctgtagacgctacaatcattttagggattgtttttttaagcggtttactaggcttttggcaagaaaaaggagctataaatgcggttcgcaaacttcttgcaatggtacagattcgagtttccgtaatgcgtaattcttccattcgagaaattccatcagaagaagtagtacctggagacattttaaaattgagcgcaggagatatgattccagcggattgtatcctacttgagtccaaagatttatttgtcaatgaagctacccttaccggagaaacctttcccatagaaaaattcatagaaacaatttccaaaaattcttctctttctcaaaggaccaattccctctggatgggaactcacgtagtcagcggagaagcgattgcacttgtaatccaaactggaaaaaaaacagaatttggaaaaatatctgaaagattaaaactacgtcccatggaaaccgaatttgaagtaggagttcgtaagttcggattttttttgcttcacgttactcttcttttagtcataactattttcatagcgaacgtatttcttcataaatcagttttagaatcttttttattttctttagccctatcagttggactaacccctcaacttcttcctgcgattataagcgttaatctttctcacggcgcaagaaaaatggcagaaaaaaaggtaattgttaaacgacttgcggctatagaaaattttggaaacatgaacattatttgttctgataaaaccgggaccttgaccgaaggaactgtaaaactacaatcttctttagatatatacggaaatgaaaatcaagaagttgcattgagcgcttttttaaatgcttcttttgaaactggatttgtaaatgcaatcgatcaatccattcgagagaatttaaacttcaatctttccggttttgaaaaaaaagacgaaataccctatgactttcaacgaaaaagactcagtattttagtctctcattctggtggacatagaattataaccaaaggagctcttataaacatattagaaatctgtaacacggcaaaatctcaagacggatctcaaattgaaatcgaaaaagtaagagatcaaatcctacaaagatacgagactttaggagcaaaaggatatagaattttaggaatcgcagtcaaagaaatcggagaacaatcaaaaattgaaaaattagaagaaaagaatatggtatttttaggaatgttatctttttatgatcctcctaaaacaaaaatcaaagaaacgattacgaatttaaaaaatttaggagttactctcaaagtaattaccggcgataatcgttttgtagccatgaatttgtcttctcaaattggattagaaaatccaaatattctttccggacatgaacttgaaaaaatgagtaacgaagctttgatccatcaagttggtaaggtaaacgtatttgcagaaatagaaccaaacgggaaagaaaggatcataattgctctgaaaaaagcaggcaatgtagtaggttatattggagacggaatcaatgacgtttctgctctacactcttcagatgttggaatttccgtagaaaaggcggtggacgttgcaaaaaacgcagccgatttggttttacttgaaaaggatctagaagttcttgtggacggtgttaaagaaggtagaaatacatttgcaaatactctaaaatacgtgttcatggcgacaagtgcaaacttcggaaacatgtttagtatggcgggggtttctatgtttcttccttttttaccccttttgcccaaacaaattttactcactaattttttgaccgattttccagaaatgacgatcgcaacagatcgtgtagattcagaaatgatttcttctccgaaacgttgggatatttccgcaattcgtaaatttatggtagtttttgggatggtaagttcgtttttcgattatcttacatttggagttttacactggttattaaaagtaaatcaagatcagtttcgaactggctggtttatagaatctatcgtctccgcttctttgatcgtacttataattagaaccagaaatgtattttttgtgagtaaacccagtagatctctttttttaacaactctttgtgtaatttgttttaccatatccattccctatagccctatcgcggattggtttggtctggttcctcttcctctttcgtttttgggaatgttggttgggattgtgcttatttacggaatggctgcagaaataacaaaacggattttttataaattggttccaatttga

SEQ ID NO: 107870 - protein, 843 aa, Leptospira interrogans
MEIEKDKLSHFWSLTSNECLTLTQSNRNGLSEEEAKKRLLQFGENKLSSKKETTAIGLFFSQFKSPIVLLLLFAAGLSVIVQDSVDATIILGIVFLSGLLGFWQEKGAINAVRKLLAMVQIRVSVMRNSSIREIPSEEVVPGDILKLSAGDMIPADCILLESKDLFVNEATLTGETFPIEKFIETISKNSSLSQRTNSLWMGTHVVSGEAIALVIQTGKKTEFGKISERLKLRPMETEFEVGVRKFGFFLLHVTLLLVITIFIANVFLHKSVLESFLFSLALSVGLTPQLLPAIISVNLSHGARKMAEKKVIVKRLAAIENFGNMNIICSDKTGTLTEGTVKLQSSLDIYGNENQEVALSAFLNASFETGFVNAIDQSIRENLNFNLSGFEKKDEIPYDFQRKRLSILVSHSGGHRIITKGALINILEICNTAKSQDGSQIEIEKVRDQILQRYETLGAKGYRILGIAVKEIGEQSKIEKLEEKNMVFLGMLSFYDPPKTKIKETITNLKNLGVTLKVITGDNRFVAMNLSSQIGLENPNILSGHELEKMSNEALIHQVGKVNVFAEIEPNGKERIIIALKKAGNVVGYIGDGINDVSALHSSDVGISVEKAVDVAKNAADLVLLEKDLEVLVDGVKEGRNTFANTLKYVFMATSANFGNMFSMAGVSMFLPFLPLLPKQILLTNFLTDFPEMTIATDRVDSEMISSPKRWDISAIRKFMVVFGMVSSFFDYLTFGVLHWLLKVNQDQFRTGWFIESIVSASLIVLIIRTRNVFFVSKPSRSLFLTTLCVICFTISIPYSPIADWFGLVPLPLSFLGMLVGIVLIYGMAAEITKRIFYKLVPI

SEQ ID NO: 107871 - DNA, 2706 bp, Bacillus cereus
  CDS (1)..(2706)
atgttaaatttactaagacaagaaacgaaacattcatacgatcaagattgtatgaaaacaaatcacaaattattagtggaagtcgcaacgcaggatgcaaacaaagcgttacgacttttagaaacaacagaaaatggactctctaaagaagaagcgtctcgtagactttctttatatggccttaatgaaatagctcataataaaacatcaccgtggtacattcaatttctgctggcatttaaaaatccatttatttttgttttattagctctcggcgcactttcttttttcacagatgacatacaaggaactattgtcgtatctgtaatggtaatgctaagtgcaacgattcgctttttacaagaatttcgttctcaaaaagctgcggatcagttaaaggctatggtccgaacaacggcgagtgtctttagaatagatggatttgtacacgaaacaaaaaatttaaaaattttgaatagaattgatacaaaggaaattccaattgaggaacttgtacctggcgatattatttcactttcagccggagacattgttccagctgatgtgcgtattttatcggctaaagatttatttgtgaaccaatcttctttaacaggagaagcacttcctgtagaaaaatacgaaaactgctaccatacagaaaataaacatctattaccgaaaagcacgaaaaaaaattacaatccactcgatatggaaaatctttgcttcatggggacaaatattgtaagtggtagcgcaagagcggttgtcatctccacaagtaccgatacgtatttcggctctttagcaaataaagtaatcggtaagcgcgtagaaacaagctttgataaaggtgtaaacaaagtaagctggcttttaattacattcatgcttattatggcacctatcgttcttctcattaacggattcacaaaaggggattggcaagaagctttcttcttcgctattgcaatcgcagttggtctaacacctgaaatgttaccaatgattgtgactgctaatttagctaaaggtgccgttaacatgtctaaacagaaagtaattgtaaaacagctgaattctattcaaaatttaggtgctatgaacattctttgtaccgataaaacaggaactttaacagaagataaagttgtacttgttcggcacttagatcctagtggtaatacatgtaatcgtgtattacactttgcctatttaaatagcttctatcaaacaggattgaaaaatttaatagataaagctgttataaaacatacagaagaaaatcaaaaatttgatccatccgtttttcaaaaactagatgaaattccatttgactttgctcgtcggcgtatgtccgtcattgtaaaaaacaattcaggtgagcatacaatggtctgtaaaggggctgtagaagaaattttatctatttgcaactacactgaaatagatggcaaaattgcttctcttaccgatgacatgcgcttacatgtaaaacaactaagtgagactttgaatagtgaaggtatgcgcgttattgctgtagcttataaaaaaaatagaccaacaaataataaagagtacgccgtacaagatgaaaatgatatgattctcgctggatatattggctttttagatccaccgaaaccatctgccgctactgccattcaagcattacaaaaacatggtgtacaagtaaaaattttaactggtgataacgaaatcgtgacaaaaaaggtatgtaaagaagttggattaaatattggcgagcctatccttggttacgaaatcgatgctttacctgataaagcattagcaaagctagccgaagaaacaactgtttttgctaaactaaatccaatgcaaaaatctcgcattatacgagtattacaaggaaacggacacactgtaggttatatgggagatggcattaacgacgccgtagcgttacgggaagctgacgttggtatatctgttgatactgcaactgatattgcaaaagagtcttccgatattattctacttgaaaaaagcttaatgatattagaagcaggtattttagaaggacgcactacattcggtaatattttgaaatacattaaaatgacagcgagctctaacttcggaaatgtatttagtgtgttagtagcaagtgccttcattcctttcttgccgatgcttgccattcaccttttaattcaaaacttactttatgatatttcacaactgtctatcccatgggacaaaatggataaagaatttttagaaaaaccaagaaaatgggatactgcaaatttacggaacttcattatttgcatcggtcccattagttccatatttgatatcatcacctatgtggtcatgtggaacgtcttcggtgcaaatacagctagcgaacaatcattattccaatctggttggtttgtcgttggattgctaacacaaactttaattgttcacatgataagaacacagaagattccgtttattcaaagtactgcatcagtaccggttcttttattaaccgcttgtattatggtaatcggaatttatattccattctcgccacttggagcagccgttggattacaagcattaccacttagctatttcccttggttagtaggaatactattaggctatgctttcttaacacagttcctaaaaaaaatttatattaaaaagtttcatagctggttataa

SEQ ID NO: 107872 - protein, 901 aa, Bacillus cereus
MLNLLRQETKHSYDQDCMKTNHKLLVEVATQDANKALRLLETTENGLSKEEASRRLSLYGLNEIAHNKTSPWYIQFLLAFKNPFIFVLLALGALSFFTDDIQGTIVVSVMVMLSATIRFLQEFRSQKAADQLKAMVRTTASVFRIDGFVHETKNLKILNRIDTKEIPIEELVPGDIISLSAGDIVPADVRILSAKDLFVNQSSLTGEALPVEKYENCYHTENKHLLPKSTKKNYNPLDMENLCFMGTNIVSGSARAVVISTSTDTYFGSLANKVIGKRVETSFDKGVNKVSWLLITFMLIMAPIVLLINGFTKGDWQEAFFFAIAIAVGLTPEMLPMIVTANLAKGAVNMSKQKVIVKQLNSIQNLGAMNILCTDKTGTLTEDKVVLVRHLDPSGNTCNRVLHFAYLNSFYQTGLKNLIDKAVIKHTEENQKFDPSVFQKLDEIPFDFARRRMSVIVKNNSGEHTMVCKGAVEEILSICNYTEIDGKIASLTDDMRLHVKQLSETLNSEGMRVIAVAYKKNRPTNNKEYAVQDENDMILAGYIGFLDPPKPSAATAIQALQKHGVQVKILTGDNEIVTKKVCKEVGLNIGEPILGYEIDALPDKALAKLAEETTVFAKLNPMQKSRIIRVLQGNGHTVGYMGDGINDAVALREADVGISVDTATDIAKESSDIILLEKSLMILEAGILEGRTTFGNILKYIKMTASSNFGNVFSVLVASAFIPFLPMLAIHLLIQNLLYDISQLSIPWDKMDKEFLEKPRKWDTANLRNFIICIGPISSIFDIITYVVMWNVFGANTASEQSLFQSGWFVVGLLTQTLIVHMIRTQKIPFIQSTASVPVLLLTACIMVIGIYIPFSPLGAAVGLQALPLSYFPWLVGILLGYAFLTQFLKKIYIKKFHSWL

SEQ ID NO: 107873 - DNA, 2724 bp, Bacillus cereus
  CDS (1)..(2724)
atgaactggtatggaatgcgtgcacatgaagtggaagaaagaacgaatacaaatgtgaaggttggacttacagagaaagaagcagaagggcgaataaaaaaatttggtacaaatgaactagatgaagcgaaaaggccttctgcactaatggtatttttggcgcaatttaaagattttatggtgcttgttttgtttggtgcaacaatcgtttcggcttttttaggggaatacattgattctattgcgattgtggcaattgttattatcaatggtattctcggattttttcaagaaagaaaggctgaaaagtcattggaagctttaaaagagctagccgccccgcaagtaactgtactgcgaaatggaaagtgggtaaaggcaccgtctaaagcactcgttttaggtgatattattaaattttctagtggcgatcgtgttggagctgatgtacgtcttgttgaggcgtcgagtttatatattgaagaatcggctttgacaggagagtcagtacccgtgcagaagaaagtagaagcattgcaagggcaagatgtttcaattggtgatcaaaaaaatatggcttttatgggtacgatgattacacgagggtctggaacaggagtcgttgtagcaacgggtatgaatacagcgatgggacaaattgcaaatatgttacaaaatgcagagcagatggaaacaccactgcaaagaagattagagcaactcggaaaaatattaattattgtggctcttgttttgacagcgcttgtcgtgttagctggtgtgtatcaagggaatgaagtgtatcatatgtttttagcgggtgtgtcgctagctgttgctgctattccagaaggattgccagcaattgttacagtagccttatcacttggtgtacagcgtatgataaaaaagagagcaattgtaagaaagttaccagcagtagaaacgttaggttgcgcttctgttatatgctctgataaaacaggaacgatgacgcaaaacaaaatgatggtaacacatatgtggtcaggtggagagttgtggaaagtgacaggccaaggatatgaacctaatggctcgtttatgaaaggtgaaaaagaaattaatccagctaagacgaaatcactttatcaactacttacatttggttcgttatgcaataacgcaaatattattcaaaagaaaaaggcgtatgtattagatggagatccaactgagggagcgcttgtagctgtagcaatgaaagcggggataacgcgtgaggcgctgaaagggaaatttgaaattatccgtgaatttccgtttgattcaactcgaaaaatgatgagtgttattgtacgagatcgagagggtaaaaagtttgtcgttacgaagggagcaccagatgtccttctgcaaatgagtcaaacgattttatggggggataagcagcaaccattaagtgagttgtatagaaaagaagtacaggcggctattcatagcttaggtagtcaagcacttcgaacaattgcagttgcttttaagcctttaaaagtaacagactcaattgaacatgaaagagacgttgaaaaagattttatgttagttggaatacaaggaatgattgatccgccaagaccagaagtagagcaggcagtaaaagagtgcagagaagctggtattcgaacggtgatgattacaggtgatcataaagtgactgcaatggcgattgcagaacaattaagcattttaccaccaggtggacgcgttgttgaaggggtagaactcgcaactatggatgtagaagaattagaaaatgttgtagaagatacgtatgtatttgctcgtgtatcaccagaacataaattaaaaattgttaaggcgttgcaaaataaaggacatatagtggcgatgacaggtgatggagtaaacgatgctccggctataaaaactgcggatattgggatagcgatgggaattacagggacagatgttgcaaaagaagcttcttctctcgtattgctggacgataatttcgctacgataaaatcagcaattaaagaaggtagaaatatatacgagaacatacgtaagtttattcgttatttattagcatcgaacgttggagaaattttggtcatgttatttgcaatgttacttgcactaccgctgccgatggttccaattcaaattttatgggtgaatttagttactgacggtttaccggcgatggcgttaggtttggataaggccgagggagacgtgatgaagagaacgccgcgtcatccgaaagaaggggtatttgctagagggcttgcctggaaaattataagtcgtggctttctaattggggcagtgacgctagtagcatttattattgcgtataatcaacatccaaatgaactgaaatatgcacaaactgtagcgtttgcaacattggtacttgctcagctgattcatgtatttgattgccgaagtgagcattctgttttccaccgcaatccgtttggaaatgtgtatttagtaggagcggttatcatttcattactactcatgctagtcgttatatattatccaccgttacaaccgatttttagcacgatgccaatacaagcgagagattggttgttaattggaggtttatcgtcaattccgaccttcttattagtaggctctttattaacagggaaaaaagggaagaaggaaaagccaatattatataagaagggattaaacttgaaatag

SEQ ID NO: 107874 - protein, 907 aa, Bacillus cereus
MNWYGMRAHEVEERTNTNVKVGLTEKEAEGRIKKFGTNELDEAKRPSALMVFLAQFKDFMVLVLFGATIVSAFLGEYIDSIAIVAIVIINGILGFFQERKAEKSLEALKELAAPQVTVLRNGKWVKAPSKALVLGDIIKFSSGDRVGADVRLVEASSLYIEESALTGESVPVQKKVEALQGQDVSIGDQKNMAFMGTMITRGSGTGVVVATGMNTAMGQIANMLQNAEQMETPLQRRLEQLGKILIIVALVLTALVVLAGVYQGNEVYHMFLAGVSLAVAAIPEGLPAIVTVALSLGVQRMIKKRAIVRKLPAVETLGCASVICSDKTGTMTQNKMMVTHMWSGGELWKVTGQGYEPNGSFMKGEKEINPAKTKSLYQLLTFGSLCNNANIIQKKKAYVLDGDPTEGALVAVAMKAGITREALKGKFEIIREFPFDSTRKMMSVIVRDREGKKFVVTKGAPDVLLQMSQTILWGDKQQPLSELYRKEVQAAIHSLGSQALRTIAVAFKPLKVTDSIEHERDVEKDFMLVGIQGMIDPPRPEVEQAVKECREAGIRTVMITGDHKVTAMAIAEQLSILPPGGRVVEGVELATMDVEELENVVEDTYVFARVSPEHKLKIVKALQNKGHIVAMTGDGVNDAPAIKTADIGIAMGITGTDVAKEASSLVLLDDNFATIKSAIKEGRNIYENIRKFIRYLLASNVGEILVMLFAMLLALPLPMVPIQILWVNLVTDGLPAMALGLDKAEGDVMKRTPRHPKEGVFARGLAWKIISRGFLIGAVTLVAFIIAYNQHPNELKYAQTVAFATLVLAQLIHVFDCRSEHSVFHRNPFGNVYLVGAVIISLLLMLVVIYYPPLQPIFSTMPIQARDWLLIGGLSSIPTFLLVGSLLTGKKGKKEKPILYKKGLNLK

SEQ ID NO: 107875 - DNA, 4539 bp, Bacillus cereus
  CDS (1)..(4539)
atgcagagtaaatcattgaaaacgagatttatacgatcgttacctggaagaattcgaattgaaatatataaactgaaatacaatacaaatatggcgaacttgatagtagaacgttttcgtgacgtggaaggtatttatcaagtaagtccctctatttctacgggaagagcccttattacttacgatatcaacaagacctctctacatacaatttgtgaaataattaaactcctagaagaacaaattacaaaaaataataaccttaataatatggaagaaacgaagaaagtagaagattcttcatctagtgtaatttcttacgagaaaaaaggtgaaggtgtcccgttaccgttagcgctttctgtcgctggattaggtgcatttggtataaagcaattatttatgggaaggtcagctttagctagaagtccagggcttttttatgtatcgggtgctttatccgttgtaacaggatatccgtttcttaaacgaggattcaaaaaaatggttgctagcaaaaaagtgaattctgatttagtgcttggcataggaacgctagcgctagcacttgcgcgagaaaatattatcgtattagcgggacttagtctattaaactatttaaattggaagcgtagtcaggcgaatataaatgaagaaacagattcgtacaaagaaaggattttatccccggagattaaagcatacagtgaaagacaatcgaaatggggtatgctttttggcggagcaacatgggcatttacgagaaatccgttacgcggaatggcggttttattagctgcgaatccaaaacctgctgtttcatctgctgagtatgcgtggcgacaaggggatctcgttgcgcgagaaagaggatacgttattccaaatgaagggtcattatctcaattgtctcgaacgagaacggtcgtatttgacgatgtgtctcgtatattccgtaatgaagaagcggagattagctgcgtttcagaagatgaagggcaagttttgtgcacggcagcttcgttactagagaaaagtgagcatgattggaaagatgaggttgtgcaacgagcgaagcaaacaagaagaacgttaaggaaagcttttgaagttgaagctgatgatgaagggataaaaggtgaaatacaaggtatgccatcttttgtcggtagtaaagaatttgcagaacgaaatggtgtagatataagcctatatgagttagaagcgaagagactaagcaaagaagggtttaacattcagtttgtagcaaagggtcaaaaatgcctcggattgttagttggatcaaaaataacaattgttcctgagtttgcacatatctttcataagttaaacgaaaataaatgggcaatagctgttatgggaaatagtttaaatataaatgaggatgttcttacgcaatacggtatagatacaagctggcgacatagcgatgttgtagaacgtgtagagcgtatccgtttgaatggggaagaagtgttatttgtatgtgaggaaaagattgaatttccgtcagtagctcactatgaaatgaaaaatattttccaatcaatagcgtatgcaaaacgaatagatatgctagtgaaggaacattttcgagtagcaaaaatgtggaatattgctggagagatgttggctgtttggtctatatttactgcacctgtcatcgctttaatggcgaatgctctatctttaacatttttatctagagcaaagcgggtgagtgagaagattttttctaataaagagatagtaaataagaacgactcgtcagtgagagaaccttctactaaatggtatacactctcgcaagaagatgtaataaatgatttacaagtggagaaacagcgaggattaagtgagcaagaagtgcaagtgcgacaagaaaagtatggggtgaatacaattgaaccgaagcagtctgtttcttggattgtttcatttatgggccaatttaaagagtttacatcgcttattttacttggagcagctggattgtctgtattatcaggcggtgtgtttgacgggttagcaatgggcataatcctcgttgtcaatgcggtaattggaactcttcaagagcggaaggccgaaaaagtagtggaagctttaaatcaattccgtgtgccgaattgtatagtacttcgagaaggggaagaagtagaaatagcaagtagtgagcttgttcccggtgatattgtttgcctgcaggctggagaccgtgtacctgctgatcttcgtactatacattcttggaatttggaagtgaatgaagcaatgttaacaggggagtctctacctgttgagaagaaagtggatgctataggagaagaatgttcgttagcggagcggaataatatgctctttatgggtacgtctgtaacgcgcggtaaggcgaaagctatagtagtggaaacagggatgaatacagaaatgggctatatgatttccttgatgaaaggagaagaaacagaacctacaccactccagcaaaaggtgacgtctattagtaaaacgttcattaaaggggcttttgtagctggtggtattgtacttgtagcggggttactacgtggtttaccaattacgcaaatgattacaacatcggttgctcttacagcatcagctgttccagaaggtttgccgattatgattacaatcgctttaagcgcagggatattccgtatgcagaagcaaaatgcgctcgttcggaagctttccagtttagaaacgttgggtagaacaacggttatttgctctgataaaacaggtactcttacgaagaacgaaatgacggttaaagtgatcgctacgccaaatcgtgtatggagtgtatctggtgacggatatgaaccagttggtaagatttcggatgtaacgtcatctaaagtcgctgctgctgtagagatggaagtagaagaagtgacttatcatgaaagtgaaaacacaccattagaacatccagatttagttcgcgttctgcaaattagtgttctttgtaataatagtaaattagaacaagaggaggatcagtggattgtgaaaggtgacccgactgaaggagctttgttaagtttggcctctaaagtgggggtgtcacatgaagatatgaaatcatttgaacgacatcatgaagaaccgtttgactctgagacgaaaattatgagtgtcgtttgtaaggaaaatgaatcaatctataagttttcgaaagggtctgtagaggcgattcttactagatgtaaatggtatcaatataatggcgaaatctatccgttatgtgatgaggaaaaagaagtgattttacaacaaaatgaaggttttgcagaacaggcgctgcgagtattagcgtttgcgtatagtaatggtgaaaatgatgaccttatttttgttggattagttggtatgattgatccgccgaaacctgaagtggaagagagtattcgtgaagcgattgaacttggtgtaaaaccagtcatgattactggggatcatcctactacggcgatctctattgcgaagcagactggcatttggaatcgtgatgatcgtgttttaacagggatagaaattgataatttaacagatgaagagttggaaaatatcgtgaaaaacacgtctgtgtttgcgcgagtaacaccagcccataaattacgcatagtaactgcatatcaagctgacggtcaaattgttgcgatgactggagatggtgtgaatgatacgcctgctataaagaaagcgaacatcggtattgcaatggggcaaacgggaacagaagtaacgaaagaggctgccgatcttatattgaaaaaagatcatttcggttccattgtggaaggggtaaaagaaggtagaacgatcattggtaatattcgaaaagcggttgggtgtttattaacgggaaatttagctgaagtattagtgacaagtgcagcagttattgcaggaatgcccattccgttagtgccaattcaaattttattaatgaatcttattacagatgctttaccagcgatgattttagctgtaaatcctggaaacaaaacgaagcaaacgaaacgtcaagatattgttgataaagagctatacaaaaaggttgtaacgcgaggcatactgcttggagcgggttcacttgctttattcggtatgagcttagcagctggcgtgcctcttgcggtaacgcaaacatcagcatttgctgcattagttgcaggtcaacttattcaaacattttcttggagacaagaagggtcagatgaaacgatgcgtgattggtcaaaagatcgtttctttgtaacagcattaggaacgtcttggcttgtattattatcagctatatatgttccgccgtttgctcgtatattccataccgttccattgacatttatgcaatgggtacctgttcttcttgtagcaggcacagtatctcaaatttcaaaacctattattaatttagtttcatataagaatgatgattcgaaaaaattggcagttaatgaactagcattattaaaaacagtgtaa

SEQ ID NO: 107876 - protein, 1512 aa, Bacillus cereus
MQSKSLKTRFIRSLPGRIRIEIYKLKYNTNMANLIVERFRDVEGIYQVSPSISTGRALITYDINKTSLHTICEIIKLLEEQITKNNNLNNMEETKKVEDSSSSVISYEKKGEGVPLPLALSVAGLGAFGIKQLFMGRSALARSPGLFYVSGALSVVTGYPFLKRGFKKMVASKKVNSDLVLGIGTLALALARENIIVLAGLSLLNYLNWKRSQANINEETDSYKERILSPEIKAYSERQSKWGMLFGGATWAFTRNPLRGMAVLLAANPKPAVSSAEYAWRQGDLVARERGYVIPNEGSLSQLSRTRTVVFDDVSRIFRNEEAEISCVSEDEGQVLCTAASLLEKSEHDWKDEVVQRAKQTRRTLRKAFEVEADDEGIKGEIQGMPSFVGSKEFAERNGVDISLYELEAKRLSKEGFNIQFVAKGQKCLGLLVGSKITIVPEFAHIFHKLNENKWAIAVMGNSLNINEDVLTQYGIDTSWRHSDVVERVERIRLNGEEVLFVCEEKIEFPSVAHYEMKNIFQSIAYAKRIDMLVKEHFRVAKMWNIAGEMLAVWSIFTAPVIALMANALSLTFLSRAKRVSEKIFSNKEIVNKNDSSVREPSTKWYTLSQEDVINDLQVEKQRGLSEQEVQVRQEKYGVNTIEPKQSVSWIVSFMGQFKEFTSLILLGAAGLSVLSGGVFDGLAMGIILVVNAVIGTLQERKAEKVVEALNQFRVPNCIVLREGEEVEIASSELVPGDIVCLQAGDRVPADLRTIHSWNLEVNEAMLTGESLPVEKKVDAIGEECSLAERNNMLFMGTSVTRGKAKAIVVETGMNTEMGYMISLMKGEETEPTPLQQKVTSISKTFIKGAFVAGGIVLVAGLLRGLPITQMITTSVALTASAVPEGLPIMITIALSAGIFRMQKQNALVRKLSSLETLGRTTVICSDKTGTLTKNEMTVKVIATPNRVWSVSGDGYEPVGKISDVTSSKVAAAVEMEVEEVTYHESENTPLEHPDLVRVLQISVLCNNSKLEQEEDQWIVKGDPTEGALLSLASKVGVSHEDMKSFERHHEEPFDSETKIMSVVCKENESIYKFSKGSVEAILTRCKWYQYNGEIYPLCDEEKEVILQQNEGFAEQALRVLAFAYSNGENDDLIFVGLVGMIDPPKPEVEESIREAIELGVKPVMITGDHPTTAISIAKQTGIWNRDDRVLTGIEIDNLTDEELENIVKNTSVFARVTPAHKLRIVTAYQADGQIVAMTGDGVNDTPAIKKANIGIAMGQTGTEVTKEAADLILKKDHFGSIVEGVKEGRTIIGNIRKAVGCLLTGNLAEVLVTSAAVIAGMPIPLVPIQILLMNLITDALPAMILAVNPGNKTKQTKRQDIVDKELYKKVVTRGILLGAGSLALFGMSLAAGVPLAVTQTSAFAALVAGQLIQTFSWRQEGSDETMRDWSKDRFFVTALGTSWLVLLSAIYVPPFARIFHTVPLTFMQWVPVLLVAGTVSQISKPIINLVSYKNDDSKKLAVNELALLKTV

SEQ ID NO: 107877 - DNA, 2667 bp, Bacillus cereus
  CDS (1)..(2667)
atgagcaattggtacagtaagacgaaagatcaaacattaatcgacttagaaacaaatgaacaacacggtttaacagaagaaattgcaagtgaacgtttaaagcaatacggttctaatgaattagctacaaaacaaaaacgcactttatggcaacgtattttcgcccaaattaatgacgtcctcgtatatgtccttattattgctgctcttatttcagcctttgtaggtgaatgggctgatgcaagtattattgcactcgttgtagttttaaatgctgttatcggtgtcgtccaagaatcgaaagcagaacaagctttagaggcattgaaaaagatggcgacacctaaagctatcgtcaagcgagatggtgaactaaaagaaattccatctgagcacgtcgttccaggtgatatcgttatgctcgacgccggacgatatatcccatgcgatttacgccttatcgaaaccgcaaatttaaaagttgaagaatctgctctaactggtgaatctgtccctgttgataaagatgcaatctaccacccttccatgcaaagtgatgaacaagtaccactcggtgatcaaaaaaacatggccttcatgtctacccttgtaacatacggaagaggcgtcggtgttgctgttgaaactggaatgaactcacaaattggtaagattgctaccctgttgcatgaagcagacgatgatatgacaccacttcaaaaaagcttagcacaagtcggaaagtatttaggctttgttgctgtagcgatttgtatcgttatgtttctcatcggctttttacaaagacgagatacactagaaatgtttatgactgctattagtttagccgttgcagctattccagaaggtttgccagctatcgtttccatcgttcttgcaattggtgtgcagcgtatgattaaacaaaatgttatcattcggaaactaccagctgtcgaagctctcggttctgtcacaattatttgttcagataaaacaggtacgttaacacaaaataaaatgaccgttactcacttttatagtgataacacatacgatcaattagaaaatttaaatgtaaataatgatgtgcaacgtctattgttagaaaatatggtgctatgtaacgatgcgtcttacaacaatgaatcacaaacgggagacccgactgaaattgctcttctcgttgccggaagcacttttaatatgcaaaaagattatttagaaaaaatacatgaacgtattaatgagctacctttcgattcagatcgtaaaatgatgtcaactgtacatacatacgatgaaagctactatagcatgacgaaaggtgctatcgataagctcttacctcggtgtacccacatattgaaaaacggtaaaatcgaagttctaacagaggctgataaaaatcaaatattagaagctgccagggcaatgtcccgagaagctttaagagtactttcattcgcatttaaacaatacaattcaagcaatgtggatatagatcatctcgaagaaaacctcatctttattggtcttgtcggtatgattgatccaccgcgaactgaagtaaaagattccattacagaatgtaaaaaagccggtattcgcacagttatgattactggtgaccataaagataccgccttcgccattgccaaagaacttggcattgctgaagacatatgtgaaattatgattggaactgaattagataacatttcagatacagaactagcaagcaaaattgatcacttacatgtattcgctagagtctctccagaacataaagtaaagatcgtaaaagcattacgtgcaaaaggcaatatcgtttctatgactggtgatggcgtcaatgacgctccatctttaaaacaagcagatgttggcgtagcgatgggcattacaggaacagacgttgcaaaaggggcagcggatgtcgtattaacagatgataatttctcatctatcgtgaaagctgttgaggaaggtagaaacatttatcgtaacataaaaaaatcaattctcttcctactctcttgtaacttcggagaaattatcactttatttttagccattttactcggctgggcaacaccactacgacctattcacattttgtgggtaaatttaattacagatacgctgcctgcattatcacttggggtggatcctgaagatcctgatgtgatgaaggaaaaaccacgacatgcgaaagaaagcttatttagcggtagcgttcctttccttattttcaatggggttgtcattggacttttaacgctaatagcctttatcgccggagcaaagttctatactggagatacaaatttattccctcttttcccagagcgaattgatgaggatgctctattacacgctcaaacgatggcatttgtcgttcttagtttttctcagctcgttcattcatttaacttgcgttcaagaacgaaatcaattttttcaattgggatttttacaaataaatatttagtcttctcccttcttatcggtgttcttatgcaagtttgtatcatctccattccgccccttgcaaatatattcggtgtgcatgcattaacgctgcgagattggggatttgttctcttattaagtatcattccgctcgttgtgaatgaaatcattaaattagcgaagaaaaactaa

SEQ ID NO: 107878 - protein, 888 aa, Bacillus cereus
MSNWYSKTKDQTLIDLETNEQHGLTEEIASERLKQYGSNELATKQKRTLWQRIFAQINDVLVYVLIIAALISAFVGEWADASIIALVVVLNAVIGVVQESKAEQALEALKKMATPKAIVKRDGELKEIPSEHVVPGDIVMLDAGRYIPCDLRLIETANLKVEESALTGESVPVDKDAIYHPSMQSDEQVPLGDQKNMAFMSTLVTYGRGVGVAVETGMNSQIGKIATLLHEADDDMTPLQKSLAQVGKYLGFVAVAICIVMFLIGFLQRRDTLEMFMTAISLAVAAIPEGLPAIVSIVLAIGVQRMIKQNVIIRKLPAVEALGSVTIICSDKTGTLTQNKMTVTHFYSDNTYDQLENLNVNNDVQRLLLENMVLCNDASYNNESQTGDPTEIALLVAGSTFNMQKDYLEKIHERINELPFDSDRKMMSTVHTYDESYYSMTKGAIDKLLPRCTHILKNGKIEVLTEADKNQILEAARAMSREALRVLSFAFKQYNSSNVDIDHLEENLIFIGLVGMIDPPRTEVKDSITECKKAGIRTVMITGDHKDTAFAIAKELGIAEDICEIMIGTELDNISDTELASKIDHLHVFARVSPEHKVKIVKALRAKGNIVSMTGDGVNDAPSLKQADVGVAMGITGTDVAKGAADVVLTDDNFSSIVKAVEEGRNIYRNIKKSILFLLSCNFGEIITLFLAILLGWATPLRPIHILWVNLITDTLPALSLGVDPEDPDVMKEKPRHAKESLFSGSVPFLIFNGVVIGLLTLIAFIAGAKFYTGDTNLFPLFPERIDEDALLHAQTMAFVVLSFSQLVHSFNLRSRTKSIFSIGIFTNKYLVFSLLIGVLMQVCIISIPPLANIFGVHALTLRDWGFVLLLSIIPLVVNEIIKLAKKN

SEQ ID NO: 107879 - DNA, 2607 bp, Geobacter sulfurreducens
  CDS (1)..(2607)
atggcaactgcacacgcggactacggaaaactgtcggtcgaggaaacgctggaggctctggggaccagcagagagcgcgggctgccccaggaggagatcgcggcgcggctgaaggaatacggccccaacgaaatcccgaaaaaggaagagtcgctgtttcagcgaatctcaaggcgcttctgggggcccattccgtggatgatcgaagcggcggcgctgctctccgccctgctccggaagtgggacgatttcacgatcatagcggttctcctgcttaccaacgcagcccttgacttctggcaggaatccaaggcactgaacgccctcaaggtattgaaaaacaagctcgcaaaacaagccctggttctgcgcgacgggaagttcacgtcgctggacgccaggaacctggtccccggcgatatcatcaaggtaaagatcggggacatgatcccggccgatatcaaactcattgacggcgaattcctgcaggccgaccaatcggccctgacgggagaatccctgccggttgccaaaaaggcgggggatatcgcctactcaaactccatcgtcaaacagggagaaatgattggcgtggttaccgcgacggcgcttggaaccttcttcggcaggacggtcgcgctggtggccaaggcccaaaaggaggaaaagagtcacttccagaaggcagtggtccatatcggcaattacctgatcctcatcaccctgttcctggcggcgatcatcctgatcacggccatgttcaggcacgagaacatgctcgaaatcctgaggttcaccctggtgctcacggttgcggcaatcccggttgccctgccggcagtgctgaccgtgaccatgacggtcggggccatgaacctggccaggaagcaggccatcgtaagccggctggtcgccatagaagaactggccggagtcgatgtcctctgctctgacaagacgggaacgctgacccagaaccggatgaccgtctccgaaccgaaggcgtttgccggacatacggtcgaagaactgatgcgcgcggctgcctttgcctcgaaggaggaaaacagcgatccgatcgagattcccatcttcgagtatctgcggaaaacgggagggctcgacgatatgcccgcctatcgccacctaaagttcaccccctttgaccctgtgagcaagaggaccgaagcaacggttcagctcgcggacacaacgcttctcgtcaccaaaggggcgccccaggtgatcctggagctctgcggagagcgggtcgaccggcaggcaatcctggacgcggtcgaagagctggccgagaagggctaccggacgctcggcgtcgcgtcgaaacgcccggaagacggaatgttcgacttcctcggcctgattcccctcttcgatccccctcgtgaggactcgaagtccaccattgaagaagccgtgaaactcgggctgcaggtcaagatgatcacgggggacaacctggccatagcaaaacagattgccgccgtcctgggaatcggcaccacgatcttcgacgcccgggacctgaggggcgccagtacccgcgaacttgtccagctgggagcaatcgtcgccagggccgtttatctgaagatgtcggacgggataaccgaagaggaggcgcagcactttgccaggggagtcgtgaaggaactggagcgggagttcgagcggatcgagctcccggaaggatacgttaaacggcacgaatcggaaatcatcggggtcattgaaagcgcctccgggtttgcccaggtattccccgaagacaagtacctcatagtcgaaaaactccagaaatccgaccatatcgtcggcatgaccggtgacggggtgaacgatgcgccggcgctaaagaaggcggatgccggcatcgcggtttccggggcgacggacgccgccagggcggcggccgacctcgttctgctggctccggggctctccgtgatcgtggatgcggtcaagggggcacgggtgacattcgagcggatgaagggctacagcatcttccgggttgctgaaacgatcagggtcatcctgttcatgaccgcctccattgtcgtcttcaacttttacccggtcaccgccatcatgatcatcatcctggcattcctcaacgacatccctatcctgaccatcgcctacgacaacacgaaagtggataacaggccggtgcgctggaacatgaccgaggtcctcacgctggccacggttctcggggtttccggggtcatctcgagtttcgggattttctacctcgccgaggaatacatgcacctctcgccggcggtggttcagagcttcatcttcctgaagctcgtcgtcgccggccattcgacgatctatgtaaccagaactgaaaagcatttctggcagaagcccttcccctcgcccctgctcttttccgcaacgactctgaccgaaatccttgggacgctctttgcggtctacggggtctttctggcgtcgatcggctggggaaatgccctgctggtctggggatacgccctggcctggtttgtcctgaacgatttcatcaaagtctggacctacaggtacctgcggcgcgatgcaaactcggtctag

SEQ ID NO: 107880 - protein, 868 aa, Geobacter sulfurreducens
MATAHADYGKLSVEETLEALGTSRERGLPQEEIAARLKEYGPNEIPKKEESLFQRISRRFWGPIPWMIEAAALLSALLRKWDDFTIIAVLLLTNAALDFWQESKALNALKVLKNKLAKQALVLRDGKFTSLDARNLVPGDIIKVKIGDMIPADIKLIDGEFLQADQSALTGESLPVAKKAGDIAYSNSIVKQGEMIGVVTATALGTFFGRTVALVAKAQKEEKSHFQKAVVHIGNYLILITLFLAAIILITAMFRHENMLEILRFTLVLTVAAIPVALPAVLTVTMTVGAMNLARKQAIVSRLVAIEELAGVDVLCSDKTGTLTQNRMTVSEPKAFAGHTVEELMRAAAFASKEENSDPIEIPIFEYLRKTGGLDDMPAYRHLKFTPFDPVSKRTEATVQLADTTLLVTKGAPQVILELCGERVDRQAILDAVEELAEKGYRTLGVASKRPEDGMFDFLGLIPLFDPPREDSKSTIEEAVKLGLQVKMITGDNLAIAKQIAAVLGIGTTIFDARDLRGASTRELVQLGAIVARAVYLKMSDGITEEEAQHFARGVVKELEREFERIELPEGYVKRHESEIIGVIESASGFAQVFPEDKYLIVEKLQKSDHIVGMTGDGVNDAPALKKADAGIAVSGATDAARAAADLVLLAPGLSVIVDAVKGARVTFERMKGYSIFRVAETIRVILFMTASIVVFNFYPVTAIMIIILAFLNDIPILTIAYDNTKVDNRPVRWNMTEVLTLATVLGVSGVISSFGIFYLAEEYMHLSPAVVQSFIFLKLVVAGHSTIYVTRTEKHFWQKPFPSPLLFSATTLTEILGTLFAVYGVFLASIGWGNALLVWGYALAWFVLNDFIKVWTYRYLRRDANSV

SEQ ID NO: 107881 - DNA, 2751 bp, Geobacter sulfurreducens
  CDS (1)..(2751)
atgaatgactcgtcgaatagcaccacaaccaacccgggcaagcttccctggcatacagcgccggagcgggaggtcttggcacgccttgagacaggccccgacgggctgacgtctgccgaggcggcggagcggctccggcgtcacggccccaacaccctgctccggaaagggggagacggccccttgctcctcttctggcgccagatcaacaaccccatcggctggctcctcatcgccgccggcgccctggccctcgccctgcggaagcccaccgatgccgccgtggtcttcggcgccgtgatcatcaacgccataatcggctttatccaggaataccgagcaggcaaggccatcgaggccctgtcggcaatgatccccgaggggacgacggccctgcgggaggggcgcgccgtgacggtccccgccgacctgctggtcccgggggatctggtgacgctccagagcggcgacaaggtgccggccgacctgcgcctcatcagggtcaagaacctgctggtggaggaggcggctctcaccggcgagtccctgccggtggcaaagcaatccgatccggtgtcgcccgacgcccccctgggggaccgggtctgcatggcctacagcgggacgctggtggtgcagggggcagccacgggagtggtggtggccacggggaacggcacggaacttggacggatcaatgccctcctcaaccagacgagccagctggaaacccccctcacccggcagctggccaaggtgagcagcgggatcaccattgcagtggtggtcgtggtgacggtgttgattgccttcggtatctggatcaaggatgcgccggtgggggaagccctgatggtggctgtttccctcgcggtggccgccatccccgaggggctgccggcggtcatcactatctgcatggcaatcggcgtacggcgcatggccgaccgccacgccgttgtccgccacctgccggcggtggagaccctgggctccacctcggtcatctgctcggacaagaccggcaccctcacccgcaacgagatgacggtgcaggtggcatggctcgacggccacgagtaccgcttctccggcatcggctacgggccggcgggggagatcgagcatgacggcacccgcttggcggagatgccgccccccctggagaaactgcttatcatcgccctgctttgcaacgatgccgccctgcgccccgaaggggacggctgggccatcaccggcgaccccacggaggcggccctggtggtcgccggacgcaaagggggactggacgaccacgaactgcgcagccgccacgggcgcctggatgtgatccccttcgagtcggacaccaaattcatggccaccctgaaccggatggaagggggacaccggattctcctcaagggggcgccggaaatcgtcctcgatcgttgcgtcctgtcggagccggagcggcgccggattcacgaggccatggagatctacgcccgccaggggatgcgggtgatcgcctgcgcttccaaagaagcggaccgcgctgaggagatctccccggaggacgtggccggggggctcacctttgcggggcttctctgcatgatcgaccccccccgcaccgaggccatggacgctatccgggaatgccacggcgccggtatcaccgtgaagatgattaccggcgaccaccccgtcacggccgaggccatcggccgccagctgggcctgctgcaggaggggcagacccccgtggaggggcgccggctggacgggctctctgatgcggaactgcaggaggtggcactggccaccaacgtcttcgcccgggtggccccggagcacaagatccggctggtggaggccctccaggcccgggggtacgtggttgccatgactggcgacggggtcaacgacgctccggccctcaagcgggccgacatcggtgtggccatggggatcacggggacggcggtttccaaggaagcggccaaggtggtcctcatggacgacaacttcgcctccatcgctgcggcggttgaggagggacgccgggtgtacgacaacctggtcaggtccctggccttcgtccttcccaccaacctggggctcgcctgcaccctgtccgtcgccatgttcttcttccccacggtgcgggtcgagggagtcaacgagctcctcatggccatgtcccccagccagactctctggatcaacctggtggcgagcgtcaccctgtcgattcccctggcctttgaggttttggagcccaacgccatgcgccgccccccccgctcccccggggagccggtcttttccggcttcatcgtggcgcggctcgttgtagtggcgctcctgatggccgccggcgggtgcggcctcttcctctgggaatacttccggatcgtgggtcctgaaccggttacggcggcccgccatgccctggccctggccgaggcccagaccatgtgcgtgaccagcatcaccttcacccaggtcttttatctcctcaattgccggtcgctccgggattccctgctctcccagggggttttcagcaacccggccatcttcataggcatcggcattcttctgctgctgcaggcgtgtttcatctacctgccgccgctccaggcggtcttcggaactgcccccctcgacggcatggcatggctctatgcgatgctggtgggagccgtggtgctgccggtcatatcgctggacaagtgggtcaggaggcatcgtcatgaatga

SEQ ID NO: 107882 - protein, 916 aa, Geobacter sulfurreducens
MNDSSNSTTTNPGKLPWHTAPEREVLARLETGPDGLTSAEAAERLRRHGPNTLLRKGGDGPLLLFWRQINNPIGWLLIAAGALALALRKPTDAAVVFGAVIINAIIGFIQEYRAGKAIEALSAMIPEGTTALREGRAVTVPADLLVPGDLVTLQSGDKVPADLRLIRVKNLLVEEAALTGESLPVAKQSDPVSPDAPLGDRVCMAYSGTLVVQGAATGVVVATGNGTELGRINALLNQTSQLETPLTRQLAKVSSGITIAVVVVVTVLIAFGIWIKDAPVGEALMVAVSLAVAAIPEGLPAVITICMAIGVRRMADRHAVVRHLPAVETLGSTSVICSDKTGTLTRNEMTVQVAWLDGHEYRFSGIGYGPAGEIEHDGTRLAEMPPPLEKLLIIALLCNDAALRPEGDGWAITGDPTEAALVVAGRKGGLDDHELRSRHGRLDVIPFESDTKFMATLNRMEGGHRILLKGAPEIVLDRCVLSEPERRRIHEAMEIYARQGMRVIACASKEADRAEEISPEDVAGGLTFAGLLCMIDPPRTEAMDAIRECHGAGITVKMITGDHPVTAEAIGRQLGLLQEGQTPVEGRRLDGLSDAELQEVALATNVFARVAPEHKIRLVEALQARGYVVAMTGDGVNDAPALKRADIGVAMGITGTAVSKEAAKVVLMDDNFASIAAAVEEGRRVYDNLVRSLAFVLPTNLGLACTLSVAMFFFPTVRVEGVNELLMAMSPSQTLWINLVASVTLSIPLAFEVLEPNAMRRPPRSPGEPVFSGFIVARLVVVALLMAAGGCGLFLWEYFRIVGPEPVTAARHALALAEAQTMCVTSITFTQVFYLLNCRSLRDSLLSQGVFSNPAIFIGIGILLLLQACFIYLPPLQAVFGTAPLDGMAWLYAMLVGAVVLPVISLDKWVRRHRHE

SEQ ID NO: 107883 - DNA, 2616 bp, Geobacter sulfurreducens
  CDS (1)..(2616)
atgacggaatggcaccacatatccattgaagatgctctgaccagactcgaaacctccctcaccgggcttgatagtgatgaggtccgccggcgcctggcggcatacggtccgaatgaactggaggaaaaggcccggcggacgccccttgttatgttccttggccagtttaccgatttcatgatcattgtgctgatcggcgcggcagtggtggccggcatcatcggcgagccgggggacgctgcgcccatcatcaccattgtcgtgctcaacgccgttatcggctttgctcaggaatatcgcgccgagcgcgccatggccgcccttcgggagatgtccggcaactacgctgcggtgctgcgcagcggcgagcatctgagcgtgcccgcccgagagatcgtccctggcgatctggtccttctggaggcgggaaacgtggtgccggccgacgtacgccttgcggaagcggtgcatctgaagaccgtggaagcggctcttaccggggaatcgcttcccgctgagaaactctcggaacagcttttcgattcggatttgccgttgggcgatcggcgcaatatggcctacaagggaacggtggtcgcctacggccgcggcatcggcatcgcagtcgccacggggatgggaaccgagctcggccggattgccgcgatgctgcaacaggaggcaggaacaaaaaccccgctccagcggcgtctcgccgatttcggcaagcgccttgcgctggcggtgctcgccatttgcgcggtggtattcacactggggctgctgcggggagagcctctcctcctcatgctgctaacctccatatccctggcagttgccgctatcccggaggctctgccggcagtggtgaccatcactcttgccttgggtgcgcgcaagatggtccgccagaatgcccttatccgcagacttcccgccgtggagaccctcggttcggtcacctatgtctgctccgacaagaccggcaccctgacccttaacaagatgaccgtggagaacgtctggccgggcgatcttgagggtaccgacgccggctcatccggcgtatcagccgcaacacttttcacgacggctctggtcctgtgtaacgatgcgcgtgaagactcggaaggaggtcttgtcggcgaccccaccgaaacggctcttcttgcctacgggcgtgcctgcggcgtgatccgcaccgaaatcgaggccctccacccgcgggtggccgaacttccctttgattctgaacgcaaatgtatgactacctttcaccgggatggcgataccgtcctggcctttaccaagggtgcggtcgaagtgctcacggcccggtcggtggcgatgcttaccaacaacggggaggtccccctggaccggcaagagatcgagcgcgtaacggttgaaatggccgcccgtggcctccgggtgcttgccctggccatgcgccgctggccgtatctgcccgaccggctggaaagtgatgaggttgagagcgatctgatttttctcggtcttgccggcatgatggatcccccccgcgaggaggctgccgaggcggttgcccagtgccggaacgcgggcatcaccccagtgatgataaccggcgaccacccgctcacggcccgtatcattgcccggcgattggcaatccttgaagatgacggcgacgcggtgctgaccggacgggatctggcggaactgagcccggaagagtttgaggcgcgggtggagcagatccgggtctatgcgcgggtggcccccgagcagaagctcacgatcgtcaaggcgctccagaaccgggggcatttcgtggccatgaccggcgatggggtcaacgacgcgccggcgctcaagcgcgcggatatcggtattgccatgggaataaccggcacggatgtctcaaaagaggcatcggccatggtgctgctggacgataatttcgccactattgtcagggccgtacgggaggggcgccggatctacgccaatatcctcaagtttattacctactcgatcacctcgaacatcgggactctcgtggccataacgcttgcaccgtttttcgggttgccgctgccgttgctccccattcagatactctggctgaaccttctttgcgacagcctgccggggcttgccctggcaggagaacccgctgagcgggatgtgatgagtcgaccgcccgtcgacccgaaggaaggggtttttgctggagggagaggatattacgcggccggctatggcttggtgatcggggccgcggcattggcatttcaggctattgccctgcggatgaggctgccgtggcagacaatggtcttcacgtttttggttttgaaccgcatggcagtggtgcttgcggtccgctccgaccggacttcgctgctgcgcatcggcattatgtccaaccggcccctcgtcggtgccatcgttattacgttctgtcttcagcttgccgtcgtttttaccccggccctcaatcccctgtttcacacggaaccgttatcggtccgagcacttgtcgctacggttgtgctggcgatggggatggttcttttgtccgagctccagaaaggggtgttgaggtggcggcgaggtagttcgcggtaa

SEQ ID NO: 107884 - protein, 871 aa, Geobacter sulfurreducens
MTEWHHISIEDALTRLETSLTGLDSDEVRRRLAAYGPNELEEKARRTPLVMFLGQFTDFMIIVLIGAAVVAGIIGEPGDAAPIITIVVLNAVIGFAQEYRAERAMAALREMSGNYAAVLRSGEHLSVPAREIVPGDLVLLEAGNVVPADVRLAEAVHLKTVEAALTGESLPAEKLSEQLFDSDLPLGDRRNMAYKGTVVAYGRGIGIAVATGMGTELGRIAAMLQQEAGTKTPLQRRLADFGKRLALAVLAICAVVFTLGLLRGEPLLLMLLTSISLAVAAIPEALPAVVTITLALGARKMVRQNALIRRLPAVETLGSVTYVCSDKTGTLTLNKMTVENVWPGDLEGTDAGSSGVSAATLFTTALVLCNDAREDSEGGLVGDPTETALLAYGRACGVIRTEIEALHPRVAELPFDSERKCMTTFHRDGDTVLAFTKGAVEVLTARSVAMLTNNGEVPLDRQEIERVTVEMAARGLRVLALAMRRWPYLPDRLESDEVESDLIFLGLAGMMDPPREEAAEAVAQCRNAGITPVMITGDHPLTARIIARRLAILEDDGDAVLTGRDLAELSPEEFEARVEQIRVYARVAPEQKLTIVKALQNRGHFVAMTGDGVNDAPALKRADIGIAMGITGTDVSKEASAMVLLDDNFATIVRAVREGRRIYANILKFITYSITSNIGTLVAITLAPFFGLPLPLLPIQILWLNLLCDSLPGLALAGEPAERDVMSRPPVDPKEGVFAGGRGYYAAGYGLVIGAAALAFQAIALRMRLPWQTMVFTFLVLNRMAVVLAVRSDRTSLLRIGIMSNRPLVGAIVITFCLQLAVVFTPALNPLFHTEPLSVRALVATVVLAMGMVLLSELQKGVLRWRRGSSR

SEQ ID NO: 107885 - DNA, 2694 bp, Lactobacillus johnsonii
  CDS (1)..(2694)
atgggaggatgttttacggtgaaagagaaatactatgctcaagagatttctcaaattgagaaagagctgaacacatcgttagacaatgggttgtctgataatgaggctaagaagagattagcttcagatgggcccaattctttagcatcaaagaaaaagcgtagtatgtttatgcgctttatcgatcaatttaaggactttatgattattgtcttaattgtggctgccattttatctggtgtagttgctaatgaatggactgatgctgcaattattatgattgttgttttgctgaatgcaattttaggagtaattcaggaagctagatcagaagctgcgattgatgctttaaaggagatgtcaacaccaaatgcccatgtaagacgtggaggtgcaattttagaaattccaagtacagatattgtgcctggtgatattgtcttgcttgaagcaggggacgttgttccagctgatatgcggctagctaagactgcaagtttaaaagttgaagagtcagctttgacaggtgagtcagtacctgttgaaaaggatagtgacgtgttaaaagctgatgatgtagcactaggtgaccgtgttaacatggcttacgcaaatactaatgtaacttacggacgagcagaaggtattgttgttggcactggtatgaataccgaagttggtaagattgctacaatgcttaataatgcagatgaaacagctactccattaaaggaaaacttgaatcagcttggtaagactttaacgattatgattttggcaatttgtgtgattgtctttatcgtcggaatgtttaccaaacagggaagcgagccgactaataaattaattatcgatatgtttctagtggctgtttctttagctgtagctgcaatcccagaaggattaccagctattgtaactattattttggctttaggaacacaaacaatggctaagcataaggcaatcgttagaaaattgccagctgttgagaccttaggagctaccgatattatttgttctgataagactggtactttgacacagaaccaaatgactgttgaaaaaatttactataacggcgaacttcataatgatgaagcaccaattaatagtgataatccggctatgatgtcgatgatattagctaatgacacaaagattgaagatggtggtcggcttttaggggacccaactgaaacagccttgattcaatatgcttttgatcaaaatattaaagttgaagatcttcttaagaaagacagccgcgttcaagaagttccatttgattcagaaagaaaattaatgtctacggttaaccattatggcgataagttctttgtggctgtaaagggagcgccagatgaattattaaagcgagtaacaaaaattgaaaaagatggtcaagtaacgccaatttcagataatgaaaaagaaacaattcttgcatcaaataaagggatggctgaacaagctttacgtgtattaggactggcttacaagattgtagataaagcttatgatgatccaacgactaataatgttgagcaagatctaatctttgctggtttagtaggaatgattgacccagaaagaccagaagcaaaagctgctgttgccgaagcaaaaagtgccggtattagaacagtaatgattactggtgaccatcaaattacagctgctgcaattgcatctcgtttaggcattttagaagaaagtccagataaaaataaggctgtaattactggtgcagaacttgataaactttctgacgagtacttcaatgagcatgttcaagactacagtgtctatgctcgtgtttcaccagaaaacaaggttagaattgttaaagcctggcaagcaaataataagattgttgctatgactggggatggtgttaacgatgcacctagtctaaaacaagctgatatcggtattggtatgggaattactggtactgaagtttcaaaaggtgcagctgatatggttttggcagatgataactttgcgacaattgttgaagctattaaacaaggacgtaaggtatttgctaatatccaaaaggcaattctttatctgatgagttgtaacgttggtgaagttttaactgtctttatgatgacaatgcttggttgggatatcttaatgccagtgcaattgttgtggattaacttagttactgatactttgccagctatcgctttaggtgttgaacctgttgagccaggtattatgaagaataagccacgtggtagaaagtcaaacttcttcagtggaggcgttgcaagctcgattatttatcaaggtatcttagagggtattttggtcttaggtgcatatcaacttggtttacatgttggtccacatgttggaagtgcagctatgcaacacgcagatgccttaacgatggccttccttaccttaggattaatccaattattccatgcctttaactctaaatttattcataaatcaatctttagagcacaaacatttgagaataagtggtttaatggagcaattcttatttctgccttagttatggcggcagtagaaattccatttttaactaagatttttgatgtaactgagttagatgggatgcaatggcttgtagttattgttgctggatttttgatgataattattgtcgaaattgttaaattctttgaaagaaaagctgctagaaagtga

SEQ ID NO: 107886 - protein, 897 aa, Lactobacillus johnsonii
MGGCFTVKEKYYAQEISQIEKELNTSLDNGLSDNEAKKRLASDGPNSLASKKKRSMFMRFIDQFKDFMIIVLIVAAILSGVVANEWTDAAIIMIVVLLNAILGVIQEARSEAAIDALKEMSTPNAHVRRGGAILEIPSTDIVPGDIVLLEAGDVVPADMRLAKTASLKVEESALTGESVPVEKDSDVLKADDVALGDRVNMAYANTNVTYGRAEGIVVGTGMNTEVGKIATMLNNADETATPLKENLNQLGKTLTIMILAICVIVFIVGMFTKQGSEPTNKLIIDMFLVAVSLAVAAIPEGLPAIVTIILALGTQTMAKHKAIVRKLPAVETLGATDIICSDKTGTLTQNQMTVEKIYYNGELHNDEAPINSDNPAMMSMILANDTKIEDGGRLLGDPTETALIQYAFDQNIKVEDLLKKDSRVQEVPFDSERKLMSTVNHYGDKFFVAVKGAPDELLKRVTKIEKDGQVTPISDNEKETILASNKGMAEQALRVLGLAYKIVDKAYDDPTTNNVEQDLIFAGLVGMIDPERPEAKAAVAEAKSAGIRTVMITGDHQITAAAIASRLGILEESPDKNKAVITGAELDKLSDEYFNEHVQDYSVYARVSPENKVRIVKAWQANNKIVAMTGDGVNDAPSLKQADIGIGMGITGTEVSKGAADMVLADDNFATIVEAIKQGRKVFANIQKAILYLMSCNVGEVLTVFMMTMLGWDILMPVQLLWINLVTDTLPAIALGVEPVEPGIMKNKPRGRKSNFFSGGVASSIIYQGILEGILVLGAYQLGLHVGPHVGSAAMQHADALTMAFLTLGLIQLFHAFNSKFIHKSIFRAQTFENKWFNGAILISALVMAAVEIPFLTKIFDVTELDGMQWLVVIVAGFLMIIIVEIVKFFERKAARK

SEQ ID NO: 107887 - DNA, 2739 bp, Lactobacillus johnsonii
  CDS (1)..(2739)
atgcagtttttgcgttggtctttttgtttgtttgccgattttttagagggagagattactatgttaaaattcaactctaaagatcgtgtagtaactgatgcgactttagctaagcaaattgctggaaaagaaaagagtgaagtattaaagcaattagatacgtcaattaatgggttaaaccctgcgcaagcaaaaaagcgtttagagcgcgatgggttaaatgaagtatcaaataaagagtgtcatccaaaattgcattttttatttgatgctttcatgactccatttacaggagtattactgtttttagctcttttatcttttttgactaactatctttttgttcctgcagatcaaaaggatctcagtacagtcattattatgattacaatggttttaatttctggaataactagttttatccaaaacgttaaaaccagtgacgcagttgattcactattaaatatggtatctgtaactacgaatatcaaacgagatggaaaagatcaggaattgccaactaaagatgttgtagttggtgatatcatcaatctaactgctggagatctagtaccagcagatctgtatttattaaaaagtaaggatctcttttgttcagcaagttcattaaatggtgaatctagtcctgttgaaaaactagcagatgaaaagccaaaggaaaatgataactatctagattatccgaatattttatatgagggaacaaatattgtttcaggctctgcaatgggtgttgtatttgctacaggtgatgagacagtttttggtaatttagcacgtactcttagcaagaataaaaataaagaaacaacttttgatattggaatcaaaaatgtttcaaagattttattgattatgaccgctgtaattgcacctcttgtgtttttaattaatggtctgaccaaaggtgattggcttaatgcattgatttttgctattgctacagctgtgggactaactccagaaatgcttcctgtaattgttacaagcaatctagttaagggatcagttgaaatggcaaggcacgaaaccattgttaaaagaatgaattcaattcaaaactttggctccgctgatattctttgcacagataaaactggaactttaacacaagacaaagtagttttagagcgtcactatgatttgaatttagaagaaaaatcaaaagtcttagaactatcatatttgaacagttactatcaaacagggatgaaagacttaattgataaggcgatcattgatgcagctaaaggtgaattagatacaaatgacattaatcaaaattatcaaaaaattgatgagattccctttgactttaaaagaagacgaatgagtgtagtggtaatgaataagaagcatgaacacttattagtaacaaaaggggctgctgaagaaatgcttgcttgttctaaccggttagaaattaatggtgaaattagggctcttaatcaagagcaaagacaagaaattttaaataagatcaatcaaatgaaccaagatgggttacgggtggtattgctagcctataagaaaaatcctgctcctgttggtgaattcagtgttgatgatgagaaagaactaattttaactggatttttagcatttttagatccaccaaaggatagtgctaaagctgcattaactgctttaaagagggatggaattactgtaaaaatcttaactggagataatgaagctgtcactagaaatgttggcaaacaagttgggttagatattgcttgcgtgtatcagggaaaggacttagaaaataaaagttcagctgaattgaagaaaatggttgaagaatgtgatgtttttgtaaaactatctcctcaacaaaaggcacaaattattcaattattaagagaaaataaccatactgttgcttatatgggagacggaattaatgatgcgccggctatgaaagcggctgatgttgctatttccgttgatacagccatagacattgctaaaaaatctgctgatataattttgttacacaaagacctaatgattttagagaaaggtgttcaaattggtcggcaagtctttggaaatacgatgaaatatattaaaattacgctttcatctaattttggtaatattttatcaattttagtagcatcctcatttcttccttttcttccaatgcttccagttcaacttctcattttagatttaatgtacggtaccagctgtctatcaattccattcgatacaatgaacaaacattatttatctgaaccaagaaagtggagtactaagaagcttcctaagtttatgttctattttggtcctacatcttcgatttttgacatcataacttttgcattactgttctttatagtttgtccacaaattatcggaagtagctatgcaggagcaactgcttcacaaaaattacttttttcagctgtcttttgtactggctggtttattgaatcgctttggacccaagaaatggttattcatgcacttagagatccaggcctcccatttattaaacagcatgctacagcaattgttacatgggcaacgattggtatggctgcaattgggactatgttaccatttattattcctgtcgcaaaagcagtgaaatttggtccaattccagtatattttttaggaattgtatttattttattgattttatacattgctttaacgatgttagtaaagaaatggtatctaaaatcagagaaatatttaatctaa

SEQ ID NO: 107888 - protein, 912 aa, Lactobacillus johnsonii
MQFLRWSFCLFADFLEGEITMLKFNSKDRVVTDATLAKQIAGKEKSEVLKQLDTSINGLNPAQAKKRLERDGLNEVSNKECHPKLHFLFDAFMTPFTGVLLFLALLSFLTNYLFVPADQKDLSTVIIMITMVLISGITSFIQNVKTSDAVDSLLNMVSVTTNIKRDGKDQELPTKDVVVGDIINLTAGDLVPADLYLLKSKDLFCSASSLNGESSPVEKLADEKPKENDNYLDYPNILYEGTNIVSGSAMGVVFATGDETVFGNLARTLSKNKNKETTFDIGIKNVSKILLIMTAVIAPLVFLINGLTKGDWLNALIFAIATAVGLTPEMLPVIVTSNLVKGSVEMARHETIVKRMNSIQNFGSADILCTDKTGTLTQDKVVLERHYDLNLEEKSKVLELSYLNSYYQTGMKDLIDKAIIDAAKGELDTNDINQNYQKIDEIPFDFKRRRMSVVVMNKKHEHLLVTKGAAEEMLACSNRLEINGEIRALNQEQRQEILNKINQMNQDGLRVVLLAYKKNPAPVGEFSVDDEKELILTGFLAFLDPPKDSAKAALTALKRDGITVKILTGDNEAVTRNVGKQVGLDIACVYQGKDLENKSSAELKKMVEECDVFVKLSPQQKAQIIQLLRENNHTVAYMGDGINDAPAMKAADVAISVDTAIDIAKKSADIILLHKDLMILEKGVQIGRQVFGNTMKYIKITLSSNFGNILSILVASSFLPFLPMLPVQLLILDLMYGTSCLSIPFDTMNKHYLSEPRKWSTKKLPKFMFYFGPTSSIFDIITFALLFFIVCPQIIGSSYAGATASQKLLFSAVFCTGWFIESLWTQEMVIHALRDPGLPFIKQHATAIVTWATIGMAAIGTMLPFIIPVAKAVKFGPIPVYFLGIVFILLILYIALTMLVKKWYLKSEKYLI

SEQ ID NO: 107889 - DNA, 2628 bp, Lactobacillus johnsonii
  CDS (1)..(2628)
atgaaagcatattatcgtgagagtaaagaggaagttctaaaacagcttggagctaacgaacaacaaggtttaactagtaaagctgctcaagaaaaattagctcaagtaggacccaatgctttagtagaaggtaagaaaaaaagtgttgtagaagtctttttagaacaatttaaagacctaatggttattattttgattgttgcagctgtgatttctgcatttactggtaacttagaaagtacagcagttattattgttgttttgattctaaatgctattttaggaacagtgcaacatgttaaggcggaaaagtcgctagaagccttgaagtccctatctgcccctgccgctaaggttttaagagatggtaagaaacaagaaattgccgcaaaagatgttgttcctggcgatatactcttacttgaagcaggggatttagtcactgcggatggtagaattttagataatttttcattgcaggtaaatgaaagttccttaacaggtgagtcaactaatattgacaaattagacacgacttttgaaaaagaagttcctttggctgatcgtgtaaacatggtatattctagttctcttgtaacttatggacgtgcaaatgttttagttacagcaactggtatggatactgaaattggtaaaattgctaccttaatgaatgaaactaaggagcgcagaacaccattacaagtttcacttgatcaattttcatctcgtcttgcaactgcaattttgattttctgtgccttgatcttaggattgcaaatgtggcgtggtcaacctttactagatgcattactatttgcagtagcattagccgtagcagctattcctgaagctttaagctcaattgtaactattgtgcaggctatgggaactcaaaaaatggctaaagaacatgcaattatcaaaaatttagctgcggttgaatcattagggtcagtttcagtaatttgttctgataaaactggaactttaacgcaaaataagatgactgttgaagacatttatattggcggtaaagttcttaagccggaagagttgaacttaagtaatcagttgcatcggtatttactatatgatgtagttttaaacaatgatgcaagtttatctgatggtaaaaaaattggtgatccaacagaatcagccttattagaaatgtaccgtaaagttccaggaattgatcttggtgacggaaaattaggcttatctgaaagtgagttaagagaacatttagatcgtttagaggaagtgccttttgactctgatagaaaattaatgagtactaagcacttaattcacactgttcctacaatttttgtaaaaggagcaatcgatgttttacttaaacgttgtgtgaatattcgttttggtgatgatgtccgcccaatgactgaacaagatcgaaaagatattttggctcaaaataatcacttttcagaaaatggactaagagtgttggcatttgcctataaggaaagtgatgaagagttatctactgatagtgaaaaagacttaactttcattggtttagtttccgaaatggatccacctagaaaagaaagtgttgcagctgttgcacgtgctaaagaagccgggattagaactgtgatgatcactggtgaccacaaagtaactgcagtagcaattgcgaaaaagattggtgttttcactgatggtgatcttgcattaacaggtttagagttagatgcattaagtgataaagaattagaccaacaaattgaaaaagtagcagtttatgctcgagtttcaccagaaaacaaaattagaattgttaatgcctggcaaagaaagaatcatattgtatcaatgacaggtgacggagttaacgatgcacctgcattaaagaaggcagacgttggtgttgcaatgggtattactggtactgaagtatcaaaagatgctgcaagtatgatcttgactgatgacaactttgcgacaattattaaagctgttgcaaatggtagaacagtttatgaaaatatccgtaatgcgattggatatttattatcgggtaacttatcagctatcattactgttttatttgcttcaatcgctgcattgccagttccatttgttgcagttcaacttttattcattaacttagttactgactctcttccagctttagctattgggatggagccaggaaatcctgatattttaaaacgtaaaccacgtgatcctaaagctagtttgttagataaaaaattcgttacacaaattagtattcaaggttttttaatttcactaagtgttattgctgctttcttacttggcttaagagatacaccagcaattgcatgtactatggccttttcaactttaacgtttgcacgtttactacatgggttcaattgccgttcacaacacagtatttttaagattggatttaaaaataattggtacagtttggcagcctttgcattaggtaccgtacttttagccttaattctttttgtaccagcattacatggactatttgcagttcaaccattaactgctcaagaagtatggttaattgtaattttggcaattattccaactatcttaattcaaatagtgaaagtgattagagaaaatagagattaa

SEQ ID NO: 107890 - protein, 875 aa, Lactobacillus johnsonii
MKAYYRESKEEVLKQLGANEQQGLTSKAAQEKLAQVGPNALVEGKKKSVVEVFLEQFKDLMVIILIVAAVISAFTGNLESTAVIIVVLILNAILGTVQHVKAEKSLEALKSLSAPAAKVLRDGKKQEIAAKDVVPGDILLLEAGDLVTADGRILDNFSLQVNESSLTGESTNIDKLDTTFEKEVPLADRVNMVYSSSLVTYGRANVLVTATGMDTEIGKIATLMNETKERRTPLQVSLDQFSSRLATAILIFCALILGLQMWRGQPLLDALLFAVALAVAAIPEALSSIVTIVQAMGTQKMAKEHAIIKNLAAVESLGSVSVICSDKTGTLTQNKMTVEDIYIGGKVLKPEELNLSNQLHRYLLYDVVLNNDASLSDGKKIGDPTESALLEMYRKVPGIDLGDGKLGLSESELREHLDRLEEVPFDSDRKLMSTKHLIHTVPTIFVKGAIDVLLKRCVNIRFGDDVRPMTEQDRKDILAQNNHFSENGLRVLAFAYKESDEELSTDSEKDLTFIGLVSEMDPPRKESVAAVARAKEAGIRTVMITGDHKVTAVAIAKKIGVFTDGDLALTGLELDALSDKELDQQIEKVAVYARVSPENKIRIVNAWQRKNHIVSMTGDGVNDAPALKKADVGVAMGITGTEVSKDAASMILTDDNFATIIKAVANGRTVYENIRNAIGYLLSGNLSAIITVLFASIAALPVPFVAVQLLFINLVTDSLPALAIGMEPGNPDILKRKPRDPKASLLDKKFVTQISIQGFLISLSVIAAFLLGLRDTPAIACTMAFSTLTFARLLHGFNCRSQHSIFKIGFKNNWYSLAAFALGTVLLALILFVPALHGLFAVQPLTAQEVWLIVILAIIPTILIQIVKVIRENRD

SEQ ID NO: 107891 - DNA, 2730 bp, Ashbya gossypii
  CDS (1)..(2730)
atgtcaggcgcagtaatggagcctaagagggaggaggtggtcaaaccggtgatgtcggacgacgaggaggaggacatcgaccagctgatcgaggacctgcagtcaaaccaaggtctggacgaggaggacgaggatgaggacctggcaccggggtctgcgcggccggtgccggaggagctgctgcagaccgacccgtcgtatgggctgaccagcgacgaggtgtcgcggcggcgcaagaagtacgggctgaaccagatgtccgaggcgaacgagtcgatgatcctcaagttcgtgatgttcttcgtggggcccatccagtttgtcatggaggccgcggccatcttggccgctggtctggaggagtggattgacttcggtattatctgtgcgctgctgctattgaacgccgcggttggtttcattcaggagttccaggccggctccattgtcgaggagctaaagaagacccttgccaactctgccgttgtgatcagagacggctccttggtcgagatccctgccaacgaggttgtccctggtgacatcctgcagttggaggacggtgttatcatccctgccgacggtcgtattgtgactgagggctgcttcgtgcagatcgaccagtccgccatcaccggtgagtccctggctgttgacaagagatacggtgacgccaccttctcctcctcgaccgtcaagagaggcgagggcttcatgatcgtgactgccaccggtgacagcacctttgtcggtagagctgccgctctggtcaacaaggcctccgctggctctggtcacttcaccgaagtgttgaacggtatcggtacgattcttttgattttggttatcttgactttgcttgttgtttatgtggcatgcttctacagaagtattgacattgttaccatcctaagatacactttggccatcaccgttgttggtgtgccagttggtctgccagctgtcgtcaccaccaccatggctgttggtgctgcatacttggcgaagaagaaggctatcgtccagaagctttctgccattgagtctttggctggtgttgagatcttgtgttccgacaagaccggtaccttgactaagaacaagttgtctctgcacgagccatacactgtcgagggcgtcgaggctgatgacttgatgttgaccgcgtgcttggctgcttccagaaagaagaagggtttggacgctatcgacaaggccttcttgaagtctttgatcaactacccaagagccaaggctgctttgaccaagtacaaggttttggagttccacccattcgaccctgtctctaagaaggtcactgctattgtcgagtccccagagggcgagagaatcgtctgtgttaagggtgctccattgtttgtcttgaagactgtcgaggagaaccacttgattccagaggacgttaaggagaactacgagaacaaggttgctgaattggcttctagaggttacagagctctaggtgttgctagaaagagaggcgagggccactgggaaatcttgggtgtcatgccatgcatggaccctccaagagatgacactgcccaaaccgttaacgaggctagacacttgggtttgagagttaagatgttgactggtgatgccgtcggtattgctaaggaaacctgtagacaattgggcttgggtaccaacatctataacgctgaacgtctaggtcttggtggcggcggtgacatgcctggttccgagctggctgacttcgtggagaacgctgatggttttgctgaggttttcccacagcacaagtacaatgtcgttgagattttgcagcagagaggctacttggttgcgatgactggtgacggtgtcaacgatgctccttccttgaagaaggctgacactggtattgctgttgaaggcgctaccgatgccgccagatctgctgctgacattgtgttcttggctcctggtttgtctgccatcattgatgcattgaagacttccagacagattttccacagaatgtactcctacgttgtctaccgtatcgctttgtctttgcacttggaaatcttcctgggtctatggatcgcgatcttgaaccagtctctaaacgtccacttggttgttttcatcgccatcttcgccgacgtcgccaccttggccatcgcctacgacaacgcgccatacgacccacagcctgtcaaatggaacctacctagactatggggtatgtccattgtcatgggtatcctgttggccatcggcagttggatcaccttgacgaccatgttcatgaagaagggtggtatcatccagaactacggtgctattgaccacattatgttcttggagatctccttgaccgagaactggctgatcttcatcaccagagcctcgggtcctttctggtcctccattccatcgtggcagctatccggcgccgtcttcatcgtcgacgtcatcgccactctcttctgtgtcttcggctggctgcacgagaaaaacgtcgttgacgctggtgtcttgagaccacgtacccacatcgtcactgtcgtcagagtctggatcttctctttcggtgtcttctgcatcatgggcggcgcctactatttgatgttcacttccaagtcctttgaccgcttcatgaacggtaagccgctcagggaaaagccttctggcagatccgtcgaggacttcttggtggccatgcagagagtatcgactcagcacgagaaggagaattga

SEQ ID NO: 107892 - protein, 909 aa, Ashbya gossypii
MSGAVMEPKREEVVKPVMSDDEEEDIDQLIEDLQSNQGLDEEDEDEDLAPGSARPVPEELLQTDPSYGLTSDEVSRRRKKYGLNQMSEANESMILKFVMFFVGPIQFVMEAAAILAAGLEEWIDFGIICALLLLNAAVGFIQEFQAGSIVEELKKTLANSAVVIRDGSLVEIPANEVVPGDILQLEDGVIIPADGRIVTEGCFVQIDQSAITGESLAVDKRYGDATFSSSTVKRGEGFMIVTATGDSTFVGRAAALVNKASAGSGHFTEVLNGIGTILLILVILTLLVVYVACFYRSIDIVTILRYTLAITVVGVPVGLPAVVTTTMAVGAAYLAKKKAIVQKLSAIESLAGVEILCSDKTGTLTKNKLSLHEPYTVEGVEADDLMLTACLAASRKKKGLDAIDKAFLKSLINYPRAKAALTKYKVLEFHPFDPVSKKVTAIVESPEGERIVCVKGAPLFVLKTVEENHLIPEDVKENYENKVAELASRGYRALGVARKRGEGHWEILGVMPCMDPPRDDTAQTVNEARHLGLRVKMLTGDAVGIAKETCRQLGLGTNIYNAERLGLGGGGDMPGSELADFVENADGFAEVFPQHKYNVVEILQQRGYLVAMTGDGVNDAPSLKKADTGIAVEGATDAARSAADIVFLAPGLSAIIDALKTSRQIFHRMYSYVVYRIALSLHLEIFLGLWIAILNQSLNVHLVVFIAIFADVATLAIAYDNAPYDPQPVKWNLPRLWGMSIVMGILLAIGSWITLTTMFMKKGGIIQNYGAIDHIMFLEISLTENWLIFITRASGPFWSSIPSWQLSGAVFIVDVIATLFCVFGWLHEKNVVDAGVLRPRTHIVTVVRVWIFSFGVFCIMGGAYYLMFTSKSFDRFMNGKPLREKPSGRSVEDFLVAMQRVSTQHEKEN

SEQ ID NO: 107893 - DNA, 2874 bp, Ashbya gossypii
  CDS (1)..(2874)
atggggtcagtcggtaaaatgagcgataatccgtttgattcgtacttgaatcgttccaaggatgacagcagcatggagacgaaatcgctggcatctgaggcgtttctgaagccgaacgcgtcgctggagtactgcacgatgactgtggacgagacgctgcggcaattgaacacagacagcgcgaagggcctgtgtgaccaacagcaagtgcgtgccagcgagcaggagtggggcactaacgaggtcacggtagacggcgaggatcctgtgtggaagcggttcatgtccacattcgtggaggacccgctgatcctgttgctgatcgggtctgcggtgctgagtttcctgatgggcaacattgacgatgctgtgagtattacgctggcggtggtgatcgttgtgtcagtagggttcgtgcaagagtaccggtcggagaagtcgctcgaggcgctacacaagcttgttcccgcgagctgccaccttatccgattcggtgctgagacacatgtgctggcctcatgcctggtgcccggagaccttgtgtactttaaggtgggtgaccggattcctgccgatgtcaggatcattgagagcaccgacttatcgctcgacgagagcacactgacaggggagacagagcctgtgcacaagtcttgcacccccgtgaacagtgctacatacagcgacgtaccgggcgggatcatccctattggcgagcggacctccatcgcatatatgggtaccttggtgagggaaggacacgggaaaggtatcgtggtagcaactggcaagcacacgatgtttggcgcggtatttgaaatgatgaacagtattgaaaagcccaagactcctttgcagatggccatggacacactccgtagagatctctcatacgttaggttcgttctcagtgggatcattttcctgcttggggttattcaaggtaggtcttggcttgagatgttccagatatctgtgtcgttggcagttgctgcgattcctgagggtcttcctatcattgttactgtcactctggctctcggcgttcttcgaatggcgaacaggaaggctattgtgcgccgtctccctagtgtggagacattgggttcggttaatgttatatgttcggataaaaccggtactctcactgcaaatcatatgacagcgtccaaaatctggtgcctgggaagcatggctaacaaaaacaacgtcttgtcgctagaagccaagtctagtggcggtctacccggaaaacttcctaatctgaaaaactatttgtcagatgatgtcaaggctaccctaagaataggttccatctgtaacaatgcaagtttctcccatgagcatggcaaatacctcggtaatccaaccgatattgcactcctagaagtcttacaaaagtttgaccttgttgacgaaaggcctactacgacaagggtggatgagcttacatttaactccaagagaaaatatatggcagtgaaggttgattctccggcaaacagcggcaaacacatcatctatgtgaaaggtgcttttgagcggatacttgaaagatccgcgagcttcattggcggtgcaggaaaagttgagaagttatcggactcacataaatcccttatcaatgactgcgcaaaatcacttgcgtctgaaggtctcagaactcttgcttttgctcagctagagtgttctacaaataaaccgatgaatgatagtacgattcagaatctgacatttgtgggtctgattggcatgaaagatcctccgagatccactgttcgccccgccattgaggagctactacaagggggtgtgcatgtcataatgatcactggggatgccgaaaacacagccgtaaatatagccagacaaattggcatacccgttattaatcccgaaataagtgttcttaccggtgatagacttgaccaaatgactgatgaccaactggccggcgtgatcgatcatgtgaatatttttgctcgtgctacacctgaacacaagctgaatattgtgcgtgctttgcagaagaggggcgacattgtcgctatgacaggagatggtgttaacgacgcacctgcattgaaattggctgatatcggtgtcgccatgggccatatgggtactgatgttgcgaaagaagcttctgatatggtattaactgatgatgacttcagcaccatcctaaccgctattgaagaaggcaagggtatttttaacaatattcagagttttctaacgtttcaattgtctacctctgtcgcagccttgtcacttgtcgccatagctactgcatttaagcttcaaaatccgttaaatgccatgcagatattatggatcaacatattgatggacggtccacccgcgcaatccctaggtgtggagccagttgaccacgaagtaatgaggaagcctccaagaaaacgttcagacaagatcttgactccccaagttatgcggagactccttatcaatgcagcctttatcattggtggtactatctacgtgttcatcaaggaaatgactgaggatggacaggttactgcgagagacaccacaatgacgtttacctgtttcgtgttttttgatatgttcagcgctctagcgtgtaggcatgctacgaagtccattttcgaaattggtatcttcaataataagatgtttaactatgctgttggtttctcattactaggtcagttgtgcgctatttacattccatttttccagaatatcttcaagacagagcgcctgagcctgggggatctcatttatttgattgtaatcagtagcagtgttttcattgcagatgaagttcgaaagtattacgccaaaaagaatacccatcaagacgcatattacttttccatggtttaa

SEQ ID NO: 107894 - protein, 957 aa, Ashbya gossypii
MGSVGKMSDNPFDSYLNRSKDDSSMETKSLASEAFLKPNASLEYCTMTVDETLRQLNTDSAKGLCDQQQVRASEQEWGTNEVTVDGEDPVWKRFMSTFVEDPLILLLIGSAVLSFLMGNIDDAVSITLAVVIVVSVGFVQEYRSEKSLEALHKLVPASCHLIRFGAETHVLASCLVPGDLVYFKVGDRIPADVRIIESTDLSLDESTLTGETEPVHKSCTPVNSATYSDVPGGIIPIGERTSIAYMGTLVREGHGKGIVVATGKHTMFGAVFEMMNSIEKPKTPLQMAMDTLRRDLSYVRFVLSGIIFLLGVIQGRSWLEMFQISVSLAVAAIPEGLPIIVTVTLALGVLRMANRKAIVRRLPSVETLGSVNVICSDKTGTLTANHMTASKIWCLGSMANKNNVLSLEAKSSGGLPGKLPNLKNYLSDDVKATLRIGSICNNASFSHEHGKYLGNPTDIALLEVLQKFDLVDERPTTTRVDELTFNSKRKYMAVKVDSPANSGKHIIYVKGAFERILERSASFIGGAGKVEKLSDSHKSLINDCAKSLASEGLRTLAFAQLECSTNKPMNDSTIQNLTFVGLIGMKDPPRSTVRPAIEELLQGGVHVIMITGDAENTAVNIARQIGIPVINPEISVLTGDRLDQMTDDQLAGVIDHVNIFARATPEHKLNIVRALQKRGDIVAMTGDGVNDAPALKLADIGVAMGHMGTDVAKEASDMVLTDDDFSTILTAIEEGKGIFNNIQSFLTFQLSTSVAALSLVAIATAFKLQNPLNAMQILWINILMDGPPAQSLGVEPVDHEVMRKPPRKRSDKILTPQVMRRLLINAAFIIGGTIYVFIKEMTEDGQVTARDTTMTFTCFVFFDMFSALACRHATKSIFEIGIFNNKMFNYAVGFSLLGQLCAIYIPFFQNIFKTERLSLGDLIYLIVISSSVFIADEVRKYYAKKNTHQDAYYFSMV

SEQ ID NO: 107895 - DNA, 3384 bp, Daucus carota
  CDS (277)..(3147)
agcttgtaacagttaagtacactacctcttctctctgagctgttccacttcttctaagtagatttggtgttggtgggtctacctcatctatcttttacaaatctttccttggttttttttttttgatatttcaataattgcaaagtgtctccttttcatttcttgaaattttaactacaggttcttgaaattttatgctggtagctatagttcaggtagaaaattagtgggttgtaatcttttttcgatttcatagacaatttgaagcagaaaaagatggaagataagcctgaagttcttgaagctgtgctgaaggaaacagttgatttggaaagcattcccattgaggaagttttcgagaatctgagatgtagcaaagatggtctaactagctctggtgctgcagagagattaaccatatttggacataacaagcttgaggaagtcaaggaaaggaaattcttgaagtttttggggtttatgtggaatcctttgtcatgggttatggaagctgctgcaatcatggcaattgctcttgctaacggaggcggaaagccacctgattggcaagatttcgttggtatcattactttgcttgtgattaactcaactattagttttatcgaggaaaataatgcaggaaatgcggcagctgctctaatggcacgtcttgctccaaaagccaaggttctccgagatggaaagtggaacgaggaagatgcttctgttttggtgcctggggacattatcagtataaaacttggagatattgttcctgcggatgctcgtcttcttgaaggcgatcccttgaaaattgaccagtctgctttgactggcgagtctcttccggtgactaaaggccctggggatggtgtgtattctggttctacgtgcaagcagggagagcttgaggctgtggtcattgccaccggggttcataccttctttggaaaggccgctcacctagtagattccactaaccaagtgggccactttcagaaggttttaactgcaattggaaacttttgtatatgctcaattgctgtgggaatgattatagaggttatcgtacaataccccattcaagatagaaaatatcgccctgggattgacaatcttcttgtgcttttgattggtggaattccgattgcaatgcccactgttttgtctgtaacaatggcaattggttctcaccgtttggcccaacagggtgcaatcacaaaaagaatgacagcaattgaagagatggcaggaatggatgttctttgcagtgataaaactggaactttgacactaaacaagcttacggttgacaaaaatcttatcgaggtatttgccaaaggagtggatgcagatactgttgttttgatggcagctcgagcctcccggacagaaaaccaagatgccatagacaccgccatagttaacatgctagctgatccaaaagaggcacgtgctggtgttcaagaacttcacttccttccgttcaatcccactgacaagcgtacagctttgacctatcttgacagtgaaggtaaaatgcatcgcgtcagcaaaggtgctccagaacagattttgcatctcgcccacaacaagtcagatatagaacgcagggttcattctataattgataagtttgcagagcgagggttgcggtcacttgctgtagcttaccaggaagttcccgagagaaggaaggagagtgctggtggcccatggcagtttgtaagtctcatgcctctctttgatccgccaaggcatgacagtgcagaaacaattaggagagcattaaatcttggtgtaaatgtaaagatgatcacaggggatcaattggccataggaaaagaaaccggtcgtcgcttaggtatggggaccaacatgtatccttcttcggctttgttgggacagaacaaagatgagtcaattgctgccttaccaattgatgagctcatagagaaagcagatggttttgctggagtttttccagagcacaaatatgagatagtgaagcgcttacaagctaggaaacacatctgtggaatgactggtgatggagtaaatgatgctcctgctcttaaaaaggctgatataggaattgctgtggctgatgcaactgatgcagcacgtagtgcttctgatatcgtacttactgaaccgggactcagtgttatcattagtgctgtcttgaccagtcgtgcaatcttccaaagaatgaaaaactatacgatatatgcagtttctattacaattcgtatcgtggttggctttatgctgctagccctgatatggaaatttgatttcccaccctttatggtgctaatcattgcaattcttaatgatggtactatcatgacaatttcgaaggacagggtgaaaccatctcctctgcccgatagctggaagcttgctgagatttttaccactggtattgttcttggtagttacttggcaatgatgacagttatattcttctgggctgcatataaaacaaacttctttccgaatacatttggggtaagttcactcgagaagaccgcccacgatgactttaagaagcttgcttctgctatatatcttcaagtaagcactataagtcaggcacttatatttgtaacaagatcccgaagttggtcttttgtagagcgtcctggtttgttgcttgttgcggcatttgcagttgctcaattgattgctaccttgattgcggtttatgcgaactggaattttgctgcaatcgaaggaatcggatggggatgggctggtgtaatttggctttacaatatcatcttctacttcccccttgacatcataaagttctttatcagatatgctctaagtggaagagcctgggatcttgttctagagcggagggttgcttttacgaggcaaaaggattttggaaaggaacagcgggagcttaaatgggcacatgcccagagaaccctccacgggcttgaagtacctgacaccaagatgtttaatgacaaatcaaatttcaccgagctcaatcaaatggccgaggaagctaaaaggagagccgaaattgccaggttaagggaactacacacactcaagggtcacgtcgaatcagttgtgagattgaagggtcttgacatcgatacaattcagcaatcatacaccgtctaagtaactaaatatgtacttaggctatcctcaagcatagcgaaaactgtgctttcccttgagctcgtaggtcggcttttcatgtccattttcgttttccatgtttatataaattgttcttcggtcatttcagggatttgcaatccccagcaatacaactaaactgggatatagagcaatcatatattatgtctatactttttactttaatatagtaaggttctctaagcatacaatatc

SEQ ID NO: 107896 - protein, 956 aa, Daucus carota
MEDKPEVLEAVLKETVDLESIPIEEVFENLRCSKDGLTSSGAAERLTIFGHNKLEEVKERKFLKFLGFMWNPLSWVMEAAAIMAIALANGGGKPPDWQDFVGIITLLVINSTISFIEENNAGNAAAALMARLAPKAKVLRDGKWNEEDASVLVPGDIISIKLGDIVPADARLLEGDPLKIDQSALTGESLPVTKGPGDGVYSGSTCKQGELEAVVIATGVHTFFGKAAHLVDSTNQVGHFQKVLTAIGNFCICSIAVGMIIEVIVQYPIQDRKYRPGIDNLLVLLIGGIPIAMPTVLSVTMAIGSHRLAQQGAITKRMTAIEEMAGMDVLCSDKTGTLTLNKLTVDKNLIEVFAKGVDADTVVLMAARASRTENQDAIDTAIVNMLADPKEARAGVQELHFLPFNPTDKRTALTYLDSEGKMHRVSKGAPEQILHLAHNKSDIERRVHSIIDKFAERGLRSLAVAYQEVPERRKESAGGPWQFVSLMPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVVGFMLLALIWKFDFPPFMVLIIAILNDGTIMTISKDRVKPSPLPDSWKLAEIFTTGIVLGSYLAMMTVIFFWAAYKTNFFPNTFGVSSLEKTAHDDFKKLASAIYLQVSTISQALIFVTRSRSWSFVERPGLLLVAAFAVAQLIATLIAVYANWNFAAIEGIGWGWAGVIWLYNIIFYFPLDIIKFFIRYALSGRAWDLVLERRVAFTRQKDFGKEQRELKWAHAQRTLHGLEVPDTKMFNDKSNFTELNQMAEEAKRRAEIARLRELHTLKGHVESVVRLKGLDIDTIQQSYTV

SEQ ID NO: 107897 - DNA, 3195 bp, Daucus carota
  CDS (162)..(3014)
accccttccttgtctcatttcatctctgcaactctctcctctctcgaacccaacacatttcttgggctcggagagagtcagcaagtgaatcactaacccctcatatacatctgttcttacatacatacaattctagaaggtggtgttggagagttgtcaggatggggctcagtcttgaagagattaaaaacgagactgttgatctggaaaaaattccgatagaggaggtttttgagcagctaaaatgtacccgagaaggtctcagcgcggacgagggaaccaacaggctggagatctttggacccaacaaattagaagagaaaaaggaaagcaaactactcaagtttctcggctttatgtggaatccactctcatgggttatggaagctgctgccataatggctattgcactggctaacgggaatgggaaacctcctgattggcaagattttgttggcattatgtgcctgcttgtcatcaattcaacaatcagtttcattgaagaaaacaatgctggtaatgctgctgcagcacttatggctggtctggctcccaaaacaaaggttcttagggatggtcgatggagtgaacaagatgctgcaatcttggttcctggagacatcattagtatcaaactgggagacattgttcctgcagatgcacgtcttcttgagggtgatcctttaaagattgatcaatctgccctcactggagaatcacttccggtgactaggaatccttatgatgaagttttctccggttcaacttgtaaacaaggtgagatcgaagccgtggtcattgctactggggttcataccttctttggaaaggctgcacatcttgtggacagcacaaaccaagttggccacttccagaaggtccttacagccatcggaaacttttgtatctgttccattgctattggaatgttggtcgagattgttgtcatgtatccaattcagcacaggaagtatcgggatgggattgacaatctcttggttctattgatcggaggtattcctattgccatgcccacagttctgtcagtcacaatggctattggatcgcacaggctatcacaacaaggagccattactaagagaatgactgctatagaggagatggctggcatggacgtcctttgtagtgataagacagggacactgacccttaacaaacttactgttgataagaacttaattgaggtatttgcaaagggcttcgataaggaaaatgtcttgctttgtgctgcaagagcttcgagggttgaaaatcaagatgctattgatgctgctatagttggaacgcttgctgatcctaaagaggctcgagctggaattagagaagtacacttccttccgttcaatcccgtggacaagaggactgccttgacttacattgattctgatggaaattggcatcgtgccagcaagggtgctcctgaacagatcctgactctctgcaactgcaaggaagatcaaaagaagaaggttcatgccattattgataaatttgcagaacgtgggctaagatcattgggtgttgcaagccaggtagtgcctgagaaatcaaaagacagtgctggtggtccatggcaatttgttggattgctatccctctttgatcctccaaggcacgacagtgctgagactatccgcagggctctcaatctcggtgtaaatgtcaagatgattacaggtgatcaacttgctattgcaaaggagactggccgaagacttggaatgggaacaaatatgtatccatcttcttctttgcttggtcaacacaaggatgaatcaatagctgcacttcccatagaagagttaattgaaaaggcagatggatttgctggagtttttcctgagcacaagtatgaaatcgtcaagaaattgcaagagaggaagcatatatgtggtatgacaggagatggtgtcaatgatgcccctgctttgaaaaaggcagacattggaattgcagtagccgatgccactgatgccgcacggagtgcttctgacattgttctgaccgaacctgggcttagtgttattattagcgcagtgctaactagtagagcaattttccaaaggatgaaaaattacaccatctatgcagtatccatcacaatccgtattgtgtttggtttcatgtttattgctttgatttggaagtttgacttctctccattcatggttttgatcattgccatcctaaatgacggaacaattatgacaatctcaaaggatcgagtaaaaccatctccattgcctgatagctggaagttgaaagagatatttgctactggagtagtgcttggaggttacttggcattgttaactgttatattcttctggttgataaaagatactgattttttcccggacaaatttggtgtgagatctatcagacataatcctgaggaaatgatggcagtactgtacttgcaagtgagtattgtaagccaggctcttattttcgtaacaaggtcacgtagctggtccttcgttgagcgccctggattcttgttgcttggggccttcatgattgcacaattgctggcaactgtgatagctgtctacgcaaactggggtttcgccagaattcacggatgtggttggggatgggctggtgtcgtatggctttacagtatcgtgttctattttccgctcgatatcatgaaattcgctactcgttatgctttaagcggcaaggcctggcaaaacatgattgacaacaggacggctttctccaccaagaaagactacggaaaagaggagcgtgaagctcagtgggctctagctcaaaggactttacatggacttcaaccaccagaagcctctaccatcttcaatgacaagagcagctacagagaactttctgagatagcagagcaagcaaagagacgagcagaggtcgcaaggcttcgagaactgcacactctcaagggacatgttgaatctgtggtgaagctaaaaggcctcgacattgatacaattcaacaacattacacagtctaagactgagatgaagatatatatgattcggaagatgccatcactgaaaacttatctaagccataggaagataaaaaagaaggcattaatagtagtttatgaacaagtgtgcacttagaaactgcagtgggaacacttagccttataagggctataattccagtgatactttgctttctcttta

SEQ ID NO: 107898 - protein, 950 aa, Daucus carota
MGLSLEEIKNETVDLEKIPIEEVFEQLKCTREGLSADEGTNRLEIFGPNKLEEKKESKLLKFLGFMWNPLSWVMEAAAIMAIALANGNGKPPDWQDFVGIMCLLVINSTISFIEENNAGNAAAALMAGLAPKTKVLRDGRWSEQDAAILVPGDIISIKLGDIVPADARLLEGDPLKIDQSALTGESLPVTRNPYDEVFSGSTCKQGEIEAVVIATGVHTFFGKAAHLVDSTNQVGHFQKVLTAIGNFCICSIAIGMLVEIVVMYPIQHRKYRDGIDNLLVLLIGGIPIAMPTVLSVTMAIGSHRLSQQGAITKRMTAIEEMAGMDVLCSDKTGTLTLNKLTVDKNLIEVFAKGFDKENVLLCAARASRVENQDAIDAAIVGTLADPKEARAGIREVHFLPFNPVDKRTALTYIDSDGNWHRASKGAPEQILTLCNCKEDQKKKVHAIIDKFAERGLRSLGVASQVVPEKSKDSAGGPWQFVGLLSLFDPPRHDSAETIRRALNLGVNVKMITGDQLAIAKETGRRLGMGTNMYPSSSLLGQHKDESIAALPIEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGVVLGGYLALLTVIFFWLIKDTDFFPDKFGVRSIRHNPEEMMAVLYLQVSIVSQALIFVTRSRSWSFVERPGFLLLGAFMIAQLLATVIAVYANWGFARIHGCGWGWAGVVWLYSIVFYFPLDIMKFATRYALSGKAWQNMIDNRTAFSTKKDYGKEEREAQWALAQRTLHGLQPPEASTIFNDKSSYRELSEIAEQAKRRAEVARLRELHTLKGHVESVVKLKGLDIDTIQQHYTV

SEQ ID NO: 107899 - DNA, 3283 bp, Daucus carota
  CDS (138)..(2987)
gactacacttctcctctagtcatctacttctgctatactacgtctctatatttctctctccttccatctctctctatctctctccctctctctcggttccttgagttcgttcggtggtgttgaattggagtgatacaatgagtcatttagaggatatcaaaaacgagaccgtcgatctggaaaagattcctatcgaagaagtatttgagcagctaaaatgtacccgggaaggattatcaggagatgaaggagccaacaggcttcaaatctttggacccaacaaactagaagagaaaaaagagagtaaactactgaaatttcttgggtttatgtggaatccactctcctgggtcatggaagctgcagctataatggcgattgtgctggctaatggtgatggaaagcctccagattggcaagattttgttggtatcatatgcttgcttcttataaactctaccattagtttctgggaagaaaataatgctggaaatgctgctgccgcacttatggctggcctggcccccaaaaccaaggttcttagagatggtcggtggagtgagcaggacgctgccattttggttcctggagacataattagtatcaaactaggggatattgttcctgctgatgcacgccttcttgagggtgatcctttaaagattgatcaatctgccctgactggagaatctctaccagtgacaaggaatcctcatgacgaagttttctctggttctacttgcaaacaaggtgaacttgaagctgttgtcattgctaccggagttcatactttctttgggaaggctgcgcatcttgttgacagcaccaaccaggttgggcactttcagacggtgctcactgcaattgggaacttttgcatctgttctatagctgtcggaatggtagtagagataatagttatgtacccaattcaacacaggaagtatagggatggaattgacaatctccttgttctgttgattggtggcattcctattgctatgcccacagtcctttctgttacaatggctattggatcacacagactgtcagagcagggcgccattacaaagagaatgactgccatagaagagatggcagggatggatgttctttgcagtgacaagacaggaacactgacccttaacaagctgactgttgataaaaatttaatcgaggtttttgcgaagggagtagataaggaatatgtgttactttgtgctgccagggcttctaggacagaaaaccaggatgctattgatgcagcaattgttggaactctagctgatccgaaagaggctcgagctggcataagggaggtgcatttctttccgtttaatcctgtggacaagaggactgccttgactttcatcgactctgaaggcaactggcatagagctagtaagggtgcccctgaacagatcttgaccctgtgcaattgcaaggaagatcaaaaaaagaaggtccatgcaattattgataaattcgcagaacgtggattaaggtctttggctgttgcaagacaggaagtgcctcagaaatcgaaagatagtgaaggtggaccatggcagtttgttggattgttgtctctgtttgatcctcccaggcatgacagttcagagactatacgcagggctctcaatcttggtgtaaatgtcaagatgattactggtgatcaacttgccattgcaaaggagaccggccgaaggcttgggatggggacaaatatgtatccttctgctgctttactgggtcaaaacaaggacgcttcaattgcttcacttcctgtagacgagttaattgagaaggcagatgggtttgcgggggtgtttcctgagcacaaatatgaaatagtaaaaaggttacaggagaaaaagcacatttgtggtatgactggggatggtgtgaatgatgcccctgctctgaaaaaggcagatataggaatagcagttgctgatgcaacagatgctgctcgaggtgcttctgacattgtgctgactgaacctggactcagtgtcattataagtgcagttttaaccagtagagcaattttccagaggatgaagaattacacaatatacgcagtgtccatcacaattcgtatcgtgtttgggttcatgtttatcgctttgatatggaaatttgacttctctcccttcatggttctgatcattgctatcctaaatgatggcactattatgacaatctccaaggatagagtaaagccctctccgatgcctgatagttggaagctgaaggagatatttgctacaggcatcgtgcttggaggttatttggcattgttgactgtgatattcttttggttaataaaggatacagattttttcccggagaaatttggagtaaggcctataagaaataaacctgatgaaatgatggccgttctttatctgcaagttagtattgtgagccaggcactcatctttgtcactagatctcgcagctggtcctttatggaacgtcctggtttattgttagtcgccgcttttctagtggcacaactgattgcaactttcgtagctgtgtatgcaaactgggattttgcaagaatacacggttgtggatggggatgggctggtgtcatttggatttatagtatcgttttctatattcctcttgacattttgaagtttggcactcgttatgcattgagtggaaaagcatggctgaacctgctcgagaacaagaccgccttcaccaccaagaaagattatggaaaagaggagagagaagctcagtgggctcatgctcagcgaactttacatggacttcaaccaccagcagattctaacatatttgatgataagaacagttacagggaactatctgaaatcgctgagcaggccaaaagacgagctgaagttgctaggcttcgagaattgcacaccctgaagggacacgtcgagtcggtggtgaagctcaaaggcttggatatcgacacaattcagcagcattacactgtctaacaaaagctgaacgcataacacctaagagggcaaagagccatatcgaagaaagtatgcataaattgagctggaagagagagaccttttagtacttttaaaacattaaaattaaaatgtttttagacatagaagcttatatatatgtatgatacatatatataacatatgttaggtaaactttggaaaaggtttgatttgattgcacttgtggtttaacatgcatgatatcctccttgatattctgcatggttattgcatgctttctgcaattttacttcggctgaatgcttagttta

SEQ ID NO: 107900 - protein, 949 aa, Daucus carota
MSHLEDIKNETVDLEKIPIEEVFEQLKCTREGLSGDEGANRLQIFGPNKLEEKKESKLLKFLGFMWNPLSWVMEAAAIMAIVLANGDGKPPDWQDFVGIICLLLINSTISFWEENNAGNAAAALMAGLAPKTKVLRDGRWSEQDAAILVPGDIISIKLGDIVPADARLLEGDPLKIDQSALTGESLPVTRNPHDEVFSGSTCKQGELEAVVIATGVHTFFGKAAHLVDSTNQVGHFQTVLTAIGNFCICSIAVGMVVEIIVMYPIQHRKYRDGIDNLLVLLIGGIPIAMPTVLSVTMAIGSHRLSEQGAITKRMTAIEEMAGMDVLCSDKTGTLTLNKLTVDKNLIEVFAKGVDKEYVLLCAARASRTENQDAIDAAIVGTLADPKEARAGIREVHFFPFNPVDKRTALTFIDSEGNWHRASKGAPEQILTLCNCKEDQKKKVHAIIDKFAERGLRSLAVARQEVPQKSKDSEGGPWQFVGLLSLFDPPRHDSSETIRRALNLGVNVKMITGDQLAIAKETGRRLGMGTNMYPSAALLGQNKDASIASLPVDELIEKADGFAGVFPEHKYEIVKRLQEKKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPMPDSWKLKEIFATGIVLGGYLALLTVIFFWLIKDTDFFPEKFGVRPIRNKPDEMMAVLYLQVSIVSQALIFVTRSRSWSFMERPGLLLVAAFLVAQLIATFVAVYANWDFARIHGCGWGWAGVIWIYSIVFYIPLDILKFGTRYALSGKAWLNLLENKTAFTTKKDYGKEEREAQWAHAQRTLHGLQPPADSNIFDDKNSYRELSEIAEQAKRRAEVARLRELHTLKGHVESVVKLKGLDIDTIQQHYTV

SEQ ID NO: 107901 - DNA, 3162 bp, Daucus carota
  CDS (81)..(2951)
aagagctttgaagtgtaacagttagtgcttctctctctgctgtttaacttgttgtagatttggtgttgatatttggaaagatggaagacaagtctgaagttcttgaagctgtgttgaaagaaactgttgatttggaaagtatacccattgaggaagttttcgagaatctgagatgtagtaaagatggtcttactagctccggtgctttagagagattaaccatatttggacacaacaagcttgaagagaaaaaggaaagtaaattcttgaagtttttggggtttatgtggaaccctctgtcatgggttatggaagctgctgcaattatggcaattgctcttgctaatggaggcggaaagccacctgattggcaagattttgttggtattattaccttacttgtgatcaactctactattagttttatcgaggaaaacaatgcaggaaatgcagcggcagctcttatggcacgtcttgctccaaaagccaaggttctgcgggatggaaagtggaacgaagaagatgctgcagttttggtgcctggggatattatcagtataaaacttggagatatagttcccgcggatgctcgtctgctcgaaggcgatcccttgaaaattgaccagtctgctttgactggcgagtctcttccagttactaaaggccctggggatggtgtgtattctggttcgacgtgcaagcagggggagcttgaggctgttgtcattgccactggggttcacacattctttgggaaggctgctcatcttgtagattccactaatcaagtcggtcactttcagaaggttttaactgcaattggaaatttttgcatatgctctattgcggtgggaatggtcatagaaattatcgtacaataccccatccaagatagaaaatatcgtcctgggattgacaatcttcttgtgcttctcattggcggaattcctattgctatgcccacggtattatcagttacaatggcgattggttctcaccgtttagctcaacagggtgcaattactaaaagaatgacagcaattgaagagatggctgggatggatgttctttgcagtgataaaacaggaactctgacactaaacaagctcacagttgacaaaaatcttattgaggtatttgccaaaggagtagatgcagatactgttgttttaatggcagctcgagcctctcgaatagaaaaccaggatgccatagacactgctatagtcaacatgcttgctgatccaaaagaggcacgtgctggtgttcaagaacttcacttccttccattcaatcccactgacaagcgtacagctttgacttatcttgacaatgaagggaagatgcaccgggtcagcaaaggtgctccagaacagatcttacatctcgcacacaacaaatcagatatagagcgtagggttcattctataatcgataagtttgcagagcgagggttgcggtcactcgctgtagcataccaggaagttccagagagaaggaaggagagtgctggtggaccatggcagtttataggtctcatgcctctctttgatccgccaaggcatgacagtgcagagacaattaggagagctttaaatcttggagtaaatgttaagatgatcacaggggatcaactagccataggaaaagaaactggtcgtcgcttgggcatggggaccaacatgtatccttcttctgctttgttgggacagaacaaagatgagtcaattgctgccttacccattgatgagctcatagaaaaagcagatggttttgctggtgttttcccagagcacaaatatgagatagtaaagcgcttgcaagctaggaaacacatctgtggaatgactggtgatggagtaaatgatgctcctgctcttaaaaaggctgatattggaattgctgtggctgatgcaactgatgcagcacgtagtgcttctgatattgtacttactgaaccaggactcagtgttatcattagtgctgtcttgaccagtcgtgcaatctttcaaagaatgaaaaactatacgatatatgcagtttcgattacaattcgtatcgtggttggctttatgctgctggctctgatatggaaatttgattttccaccctttatggtccttatcattgcaatcctcaacgatggtactataatgacaatttctaaggatagagtgaaaccgtctcctctaccagacagttggaagcttgctgagatttttaccactggtatcgttcttggcagttacatggcaatgatgacggttatattcttttgggccgcatataaaacaaatttctttccgaataccttcggggtaagttcacttgagaaaactgctcacgatgacttcaagaagcttgcttctgcaatatatcttcaagtgagcactattagtcaagccctcatatttgtcacaagatctcgtagttggtcttttgttgagcgtcctggtttgttgctcgttgcggcctttgcagttgctcaattgattgctaccttgatagcggtttatgcgaattggaattttgctgcaattgaagggatcggatggggatgggctggtgtaatttggctttacaatatcatcttctacttccctcttgacatcataaagttcttaacccgatatgctctgagtggaagagcttgggatcttgttcttgagcgaaggattgcttttactaggcaaaaggattttggaaaggaacaaagggagcttagatgggcacatgcccaaagaacccttcatgggctggaagtacctgacaccaagatgttcaacgaccgaaccaatttcacggagctcaatcaaatggctgaagaagctaaaagaagagccgaaattgccaggttaagggaactgcacacacttaagggtcatgtcgaatcagtagtaagattaaagggccttgatatcgacacaatccaacaatcatacactgtctaagaagaggataatcatgtacttgggttaccctgaaacatagtgagaatagtagttttccttgagctcttaggttgtcttttcatgtcatttcattttctttgtttatataagttgttcgtcagttgtatcagagttggcaatgtgcctaaactgggatgttaacaaatgttatgtttatactttttatagataaaacttgaaaggttcttcc

SEQ ID NO: 107902 - protein, 956 aa, Daucus carota
MEDKSEVLEAVLKETVDLESIPIEEVFENLRCSKDGLTSSGALERLTIFGHNKLEEKKESKFLKFLGFMWNPLSWVMEAAAIMAIALANGGGKPPDWQDFVGIITLLVINSTISFIEENNAGNAAAALMARLAPKAKVLRDGKWNEEDAAVLVPGDIISIKLGDIVPADARLLEGDPLKIDQSALTGESLPVTKGPGDGVYSGSTCKQGELEAVVIATGVHTFFGKAAHLVDSTNQVGHFQKVLTAIGNFCICSIAVGMVIEIIVQYPIQDRKYRPGIDNLLVLLIGGIPIAMPTVLSVTMAIGSHRLAQQGAITKRMTAIEEMAGMDVLCSDKTGTLTLNKLTVDKNLIEVFAKGVDADTVVLMAARASRIENQDAIDTAIVNMLADPKEARAGVQELHFLPFNPTDKRTALTYLDNEGKMHRVSKGAPEQILHLAHNKSDIERRVHSIIDKFAERGLRSLAVAYQEVPERRKESAGGPWQFIGLMPLFDPPRHDSAETIRRALNLGVNVKMITGDQLAIGKETGRRLGMGTNMYPSSALLGQNKDESIAALPIDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVVGFMLLALIWKFDFPPFMVLIIAILNDGTIMTISKDRVKPSPLPDSWKLAEIFTTGIVLGSYMAMMTVIFFWAAYKTNFFPNTFGVSSLEKTAHDDFKKLASAIYLQVSTISQALIFVTRSRSWSFVERPGLLLVAAFAVAQLIATLIAVYANWNFAAIEGIGWGWAGVIWLYNIIFYFPLDIIKFLTRYALSGRAWDLVLERRIAFTRQKDFGKEQRELRWAHAQRTLHGLEVPDTKMFNDRTNFTELNQMAEEAKRRAEIARLRELHTLKGHVESVVRLKGLDIDTIQQSYTV

SEQ ID NO: 107903 - DNA, 3382 bp, Daucus carota
  CDS (151)..(3006)
aaactcatctgagagagactcactgggaattcttcttttttcttcaatggctatgctcctatagtcaccccctctctctctattcatatttctcccttaactcgttgctgttggcggtggtatcaaatcaacaactcgtagacatacaaaatgggcatcagtcttgaagagattaaaaatgagaccgttgatctggagaagattccgatcgaggaagtgtttgagcagttgaaatgtactcgggaaggattatctacagacgaaggagccaacaggctcgagatctttggacccaacaaattggaagagaagaaggaaagcaagtttctcaagtttcttgggtttatgtggaatcctctgtcatgggtcatggaagctgcagctattatggctattgcattggccaatggtagtggaaagcctccagattggcaagattttgttggtattatctgcttgcttgtgatcaactccaccattagtttcgttgaagagaataatgctggaaatgctgctgcagcacttatggctggcctggctcccaagaccaaggttcttagagatggtcgatggagtgagcaggatgctgctattctggttcctggtgacataatcagtatcaaactaggagatattgttcctgctgatgctcgtcttcttgagggtgatcctttaaaaattgatcaatctgcccttacaggagaatcgcttccagtgaccaggcatccttatgatgaagttttctctggttctacctgcaaacaaggtgaacttgaagctgtggtcattgctactggagttcatactttctttgggaaggctgcacatcttgtggatagcaccaaccaagttgggcactttcagaaagttctcacagcaattggaaacttttgcatctgttccattgctgttggaatgattgttgagatcatagtcatgtaccctattcaacacaggaagtacaggaatggaattgacaatctcctggttctcttaattggaggcattcctattgctatgcccacagtcctttctgtcacgatggctattggatcacacagactgtcacagcagggtgccatcaccaagagaatgacagctatagaagagatggctgggatggatgttctttgcagtgataagacaggaacactgaccctcaacaagctgactgttgataaaaatttaatcgaggttttcgctaaaggcatggataaagattttgtgctactttgtgccgcaagagcttccaggacagaaaaccaagatgccattgatgcagcaatagttggaaccctagctgatcctaaggaggctcgagctggcattaaagaggtgcatttcttcccattcaatcctgtggacaagaggactgccttaacattcattgatgctgacggaaactggcatagagctagtaagggtgcccctgaacagatcttgaccctgtgcaattgcaaggaagatcttaaaaagaaggttcatgcaattattgataaatttgcagaacgtggattgagatcattgggtgttgcaagacaggtagtgccgcagaaatcaaaagatagcgctggtgggccttgggagtttgttggattgttgtcgctgtttgatcctcccaggcatgacagtgcagagactatacgcagggcacttaaccttggtgtaaatgtcaagatgattactggtgatcaacttgctattgcaaaggagactggacggagactgggaatgggcacaaatatgtacccctctgctgctttactaggtcaaaacaaagacgcgtcaattgcttcacttcctgtagatgagttaattgaaaaggctgacgggtttgcaggagtgtttcctgagcacaaatatgaaatagtaaagaagttacaggagaagaagcatatttgtggtatgactggagatggtgtcaatgatgcccctgctctgaagaaggctgatataggaatagcagttgctgatgcaacagatgccgcacgaggtgcttctgacattgtgcttactgaacctgggcttagtgtcatcataagtgcagtcttaacgagtagagcaattttccagaggatgaagaattacacaatatatgcagtctctataacaatccgtattgtgtttggattcatgtttattgctttgatatggaaattcgacttttcacccttcatggttttgatcattgccatcctgaatgacggcactatcatgacaatctccaaggatagagtaaagccttcaccattgcccgatagctggaagctaaaggagatctttgccactggcattgtgcttggaggttatttggcattgttgactgttatattcttttggttaatgaaggatacagactttttcccgaataaatttggagtaagacctattagggatagtcctgatgaaatgatggccgctctttatctgcaagtgagtattgtgagccaggcactcatcttcgttactagatcacgcagctggtccttcgtcgaacgtcctggtttcttgttgcttggtgctttcctaattgcacaactgattgcaactttgatagcagtatatgcaaactggggttttgcaagaatagaaggatgtggatggggatgggctggcgtcatctggatatacagtgtcgtcttctatttccctcttgacataatgaaatttggcacacgttatgccttaagtggaaaagcttggaacaacatgatagagcaaagggttgctttcaccaccaagaaagattacggaaaagaggaacgagaagctcaatgggctcacgttcagagaactttacatggacttcaaccgccagaagccactaacatcttcaatgacaagaacagtaattatagggaactatctgagattgctgaacaggccaagagacgagctgaagttgccagactccgagaattgcacaccctaaagggccatgtcgagtcagtggtgaagctgaagggcttggatatcgacacaattcaacagcattatacagtgtaagaagctgtacatgcatcacctgagaggggaaaagggccattttcgacaagccttgcatgatttgagaagaatagagaggagagaaggccctgatagtattttcaaaaacttaaaatgttgtagacatagttggaacactttgtgtcataaattccaacagtagcttatatatatcagttttcttttcttaatttacgacgtttttcaagtgaacctcaaaaagggctcaatgtaattgcccttttgctttaaagtgcataatttttctgcaaaagtccttcccggctattgcaagatttgtgcaatctttcttccattgtatgtaaaggttgttcctgcctcaggcattttcgcaatccaataagagctttttacc

SEQ ID NO: 107904 - protein, 951 aa, Daucus carota
MGISLEEIKNETVDLEKIPIEEVFEQLKCTREGLSTDEGANRLEIFGPNKLEEKKESKFLKFLGFMWNPLSWVMEAAAIMAIALANGSGKPPDWQDFVGIICLLVINSTISFVEENNAGNAAAALMAGLAPKTKVLRDGRWSEQDAAILVPGDIISIKLGDIVPADARLLEGDPLKIDQSALTGESLPVTRHPYDEVFSGSTCKQGELEAVVIATGVHTFFGKAAHLVDSTNQVGHFQKVLTAIGNFCICSIAVGMIVEIIVMYPIQHRKYRNGIDNLLVLLIGGIPIAMPTVLSVTMAIGSHRLSQQGAITKRMTAIEEMAGMDVLCSDKTGTLTLNKLTVDKNLIEVFAKGMDKDFVLLCAARASRTENQDAIDAAIVGTLADPKEARAGIKEVHFFPFNPVDKRTALTFIDADGNWHRASKGAPEQILTLCNCKEDLKKKVHAIIDKFAERGLRSLGVARQVVPQKSKDSAGGPWEFVGLLSLFDPPRHDSAETIRRALNLGVNVKMITGDQLAIAKETGRRLGMGTNMYPSAALLGQNKDASIASLPVDELIEKADGFAGVFPEHKYEIVKKLQEKKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGIVLGGYLALLTVIFFWLMKDTDFFPNKFGVRPIRDSPDEMMAALYLQVSIVSQALIFVTRSRSWSFVERPGFLLLGAFLIAQLIATLIAVYANWGFARIEGCGWGWAGVIWIYSVVFYFPLDIMKFGTRYALSGKAWNNMIEQRVAFTTKKDYGKEEREAQWAHVQRTLHGLQPPEATNIFNDKNSNYRELSEIAEQAKRRAEVARLRELHTLKGHVESVVKLKGLDIDTIQQHYTV

SEQ ID NO: 107905 - DNA, 3201 bp, Daucus carota
  CDS (73)..(2925)
gatgagagttcctcttttcttttagcctcagttttgttctcaacaaggtggtgatttgcgagggttttcaagatgggcctcagtctcgaagagattaaaaacgaaaccgttgatctggaaaagattccgatagaggaagtctttgagcagttgaaatgtactcgagaaggtttgagtgccgacgagggagccaacaggcttcagatttttggacccaacaaactggaagagaagaaagaaagcaaattactcaagtttcttgggtttatgtggaatccactctcatgggtcatggaagctgctgctattatggccattgcactggctaacggtaatgggaaacctccagattggcaagattttgtcggaattatctgcttgcttgttatcaactcgacaattagtttcattgaagaaaacaatgctggtaatgccgctgcagcacttatggctggtctcgctcccaaaacaaaggttcttagggatggtagatggagtgaacaagatgctgcgatcttggttcctggagacatcatcagtattaagttgggagacattgttcctgctgatgcacgtcttcttgaaggtgatcccttaaagattgaccaatctgccctcaccggagaatcacttccagtaaccaggaacccttatgatgaagttttctctggttcaacttgtaaacaaggagagattgaagctgtagtcattgctaccggggtccataccttctttggaaaggctgcacatctcgtggacagcacgaaccaagttggccatttccagaaggtgcttactgctattggaaacttttgtatctgttccattgctgttggaatgttggtcgaacttgttgtcatgtacccgattcagcacaggaagtatagggatggaattgacaatctcctggttctgttgatcggaggtattcctattgctatgccaacagttctatcagttacaatggctattggatcgcacaggctctcacaacaaggagccattactaagaggatgactgctatagaggagatggctggtatggacgtcctttgtagtgataagacagggacactgacccttaacaagctatctgttgataagaacttgattgaggtatttgcaaagggctttgataaggaacatgtgttactttgtgctgcacgagcttcaagaactgaaaaccaagatgctattgatgctgcgatagttggaacacttgctgatcctaaagaggctcgagctggtattagagaagtacacttccttcctttcaatcctgtggacaagaggactgccttgacttacattgattctgacggaaattggcacagaaccagcaagggtgccccagaacagatccttaccctttgcaattgcaaggaagatctaaaaaagaaagttcatgcaatgattgataagtttgcagagcgtgggttgagatcactgggcgttgcaagccaggtagtgcctgagaaatcaaaagatagtgctggtggcccatggcaattcgttggtttgctgtccctatttgatcctccaaggcatgacagtgctgagactattcgtagggctctcaatctcggtgtaaatgtgaaaatgataactggtgaccaacttgctattgcaaaggagactggccgaagactgggaatgggaacaaatatgtatccgtctgcttctttgcttggtcaagacaaggatgcatcaatagcatcacttcctgtagaagaattgattgaaaaggcagatggatttgctggagtctttccagagcacaaatatgaaatcgtcaagaagttgcaagagaggaagcatatttgtggtatgactggagacggtgtcaatgatgcccctgctttgaagaaggcagacattggaattgctgtggctgatgctactgatgcagcacgaagtgcttctgacattgttcttacggaacctggacttagtgttatcatcagtgcagtgctaactagtagagctatcttccagcggatgaaaaattatacaatatatgcagtatccatcacgatccgtattgtgtttgggttcatgtttattgcactgatatggaagttcgacttttctccattcatggttttgatcattgccatcctaaatgacggaactattatgacaatctcaaaggatagagtaaaaccatctccattgcccgatagctggaagttaaaagagatatttgctactgggatagtgcttggaggttacttggcattactaactgttatcttcttctggttgatgaaggatactgattggttgccgaatacatttggtgtgagatccatcagaaataaacctgatgaaatgatggcagccctctacctccaggtcagtattgtcagccaggctcttattttcgtaacaaggtcacgcagctggtcttttgtcgagcgccctggattcttgttgcttggtgccttcctgattgcacaattgatagctactttgatagccgtgtacgcaaactggggtttcgccaggattcaaggatgtggatggggatgggctggtgtcatatggctatacagtatcgtcttctatttcccgcttgacatcatgaaattcgctactcgttatgctctaagtaacaaggcttggcaaagcatgatcgacaacaggactgctttcacaaccaagaaagactatggaaaagaagagagagaagctcagtgggcactagctcaaaggactttgcatggacttcaaccgccagaggcatctaacatctttaatgagaagagcagttacagagaactttctgagattgctgaacaagccaagagacgagcagaagtcgcaaggctccgagaactccacactctcaaggggcatgttgaatcagtggtgaagctaaagggtcttgacatcgacacaatccagcagcattacacagtctaagacaacataagagagatacgtaactcaactcgggagcgcagatgccatcgctcaagaacttatccgaatcgataagagattgacgagatggcattagtatttaacataagaagtgtacccttagaaatgcactgcgaactttggcctttgagctataatatcagcagtacctaaactttgtgttgcattttcttgcattaccatgtgttttgatctgctcctggtttggttttcttggtgctttagatgttagattaaaaaaatttgctgtagccc

SEQ ID NO: 107906 - protein, 950 aa, Daucus carota
MGLSLEEIKNETVDLEKIPIEEVFEQLKCTREGLSADEGANRLQIFGPNKLEEKKESKLLKFLGFMWNPLSWVMEAAAIMAIALANGNGKPPDWQDFVGIICLLVINSTISFIEENNAGNAAAALMAGLAPKTKVLRDGRWSEQDAAILVPGDIISIKLGDIVPADARLLEGDPLKIDQSALTGESLPVTRNPYDEVFSGSTCKQGEIEAVVIATGVHTFFGKAAHLVDSTNQVGHFQKVLTAIGNFCICSIAVGMLVELVVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGFDKEHVLLCAARASRTENQDAIDAAIVGTLADPKEARAGIREVHFLPFNPVDKRTALTYIDSDGNWHRTSKGAPEQILTLCNCKEDLKKKVHAMIDKFAERGLRSLGVASQVVPEKSKDSAGGPWQFVGLLSLFDPPRHDSAETIRRALNLGVNVKMITGDQLAIAKETGRRLGMGTNMYPSASLLGQDKDASIASLPVEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPLPDSWKLKEIFATGIVLGGYLALLTVIFFWLMKDTDWLPNTFGVRSIRNKPDEMMAALYLQVSIVSQALIFVTRSRSWSFVERPGFLLLGAFLIAQLIATLIAVYANWGFARIQGCGWGWAGVIWLYSIVFYFPLDIMKFATRYALSNKAWQSMIDNRTAFTTKKDYGKEEREAQWALAQRTLHGLQPPEASNIFNEKSSYRELSEIAEQAKRRAEVARLRELHTLKGHVESVVKLKGLDIDTIQQHYTV

SEQ ID NO: 107907 - DNA, 2766 bp, Gloeobacter violaceus
  CDS (1)..(2766)
atgacttcgggagacgatgcgatgcgcaacactccgatggaacctagcaccccggtctgccggccggacggttggcactgcctgccggtggagcaggtgctcgctgcactggccacggaggccgagcgcggcctgccgggtgccgaggcggcccggcggttggctgaaggtggtgccaacgaactggtggatcgcggagcacgctcgccgtggataatcctctgggagcagctcagcgctgtgatggtactgattttattgggggcagcgggattgtccctggtgctgggcaaatggctggaggcaggggctatcctcgccatcgtggtcctgttcgtcgtgttgggtttcctgcaggattaccgggccgaaaaggcgattgccgccctcagaaagctggcggtccccgatgtgcgcgttcggcgcgacggcgctttgcgcaccgtcggtgcccgcgaactggtgccgggcgatgtgattgtgctggaggcgggcaacctggtgcccgcggatgtgcgcttcatcgagtgcaccaatttgcgcgtgcaggaggcggccctcaccggtgaatccgaggcggtcgaaaaagacaccgcccccttggcccgcgccgatgtgcccctgggggaccggctgaatatgggctacatgggcaccgtcgtcacctacggccggggcagggctgtcgtggtcgagaccggcatgggcaccgaactgggcaagattgccacgctcattcaggaagtaaaggcggaactgacgcctttgcagcagcgcctcgacgcggtcggcaagcaactggccgccgccggaatcgccgtggcggggctgatcatgaccgtcggtctgagcgcgggcgagccgctcgatgggatgatcctgacggccatcagcgtggcggttgcttttattcccgagggattgcccgccgtcgtcaccttcaccctcgctctgggggctcaacggatgctggcccgccgggcgctcatccgcaaactgccggcggtcgagaccctgggctcggtgacgaccatctgttccgacaaaaccggtacgctcaccgaaaaccgcatgagcgccactgcggcctgcgttgcgggccgctgcctccggcgaggggagagcggtggttttggggactcccccgccgccctcgaattgctgttggcggcaggagccctgtgcaacgacgccgtctggcagccggacggcccggtgggcgacccgaccgagggggcgctcttggcggcggcggtcgaggccggactggcgatggccgagttgcgccgggcactgccgcgggtggcggaattgcccttcgattcggagcgcaagcggatgagcaccctgcaccggtttgcccgctcgatggcggatggtccgcctcaggcggccgctcggctcgcggcgatggccggtactccctacgtcgtcttcaccaaaggagccccggacagcctgctgcccctggccaccaacctgtgggacggcgagcggccggtgccgatggacgaagcgagggccgcccacatccgctcgcagcaggaagccctggcccgggacgggatgcgcgtgctgggggtggcctttcggccgctggccgaaccggtgagcgccaacgccctcgaagagcaattggtctttgtcgggctggtggggctcatcgatccgccgcggccggtggtgcgccaggcggtgcagacttgcctgcgcgcgggcatccgcccggtgatgatcaccggcgatcacccgctgaccgcctgcagtatcgcccgcgaactgggcatctccgacgggggcgtggtgctcagcggtgagcagttgagccgcatgtccgccgagcaactcgccgccgatgtcgagacggtctcggtctacgcccgggtgacgcccgaacacaagctcaaaattgtcgaagccctgcagcgcaaggggcacatcgtcgcgatgaccggcgatgggatcaacgacgccccggcgctcaaaaaagccgacatcggtgtggcgatgggcgtcaccggcaccgacgtcgccaaggaagcggcggatatggtgctcctcgacgacgatttcgccacgatcgtggcggcggtcgaagaaggccgcatgatttacgacaacctgcggcggtttatcaagttcgccgttgcgggcaacgtcggcaaggtgggcgtgatgctcctgtggccaatgccattttttctgacgggtcaaccgctcgaaagcaccgtcgccatcttgccgctgcagcttctgtggctcaatttgatgaccgacgggcttttgggcctcagcatgggagtggaacaggcagaaaagcgcgtcatgcagcgcccgccccgctcgcccgccgacggcgtcttcagcgacggcatgggctggcaggtggcttgggtcggcggattcatcgccgccgtcaccctcgcggtcggctacgggtactacctgcagggactgccccagtggcagacgatgatcttcacaaccctggccttcctgcagatttttcaggcccttgcgacccgttcgagccacgaatcgctctggcgcttgggactgttcaccaaccggctgatggtgctggtcatcttcctgattgtcctattgcaggtggctgccctcaccgtgccgccgctgcgcgacatatttctcagacttaccccgctgtcgcccgtcgactttttgttgtgcgtcgggctgggcggcacgctgctcctggctgtcgaggctgaaaagtggctgttgcgccgtcggcaagcccgctga

SEQ ID NO: 107908 - protein, 921 aa, Gloeobacter violaceus
MTSGDDAMRNTPMEPSTPVCRPDGWHCLPVEQVLAALATEAERGLPGAEAARRLAEGGANELVDRGARSPWIILWEQLSAVMVLILLGAAGLSLVLGKWLEAGAILAIVVLFVVLGFLQDYRAEKAIAALRKLAVPDVRVRRDGALRTVGARELVPGDVIVLEAGNLVPADVRFIECTNLRVQEAALTGESEAVEKDTAPLARADVPLGDRLNMGYMGTVVTYGRGRAVVVETGMGTELGKIATLIQEVKAELTPLQQRLDAVGKQLAAAGIAVAGLIMTVGLSAGEPLDGMILTAISVAVAFIPEGLPAVVTFTLALGAQRMLARRALIRKLPAVETLGSVTTICSDKTGTLTENRMSATAACVAGRCLRRGESGGFGDSPAALELLLAAGALCNDAVWQPDGPVGDPTEGALLAAAVEAGLAMAELRRALPRVAELPFDSERKRMSTLHRFARSMADGPPQAAARLAAMAGTPYVVFTKGAPDSLLPLATNLWDGERPVPMDEARAAHIRSQQEALARDGMRVLGVAFRPLAEPVSANALEEQLVFVGLVGLIDPPRPVVRQAVQTCLRAGIRPVMITGDHPLTACSIARELGISDGGVVLSGEQLSRMSAEQLAADVETVSVYARVTPEHKLKIVEALQRKGHIVAMTGDGINDAPALKKADIGVAMGVTGTDVAKEAADMVLLDDDFATIVAAVEEGRMIYDNLRRFIKFAVAGNVGKVGVMLLWPMPFFLTGQPLESTVAILPLQLLWLNLMTDGLLGLSMGVEQAEKRVMQRPPRSPADGVFSDGMGWQVAWVGGFIAAVTLAVGYGYYLQGLPQWQTMIFTTLAFLQIFQALATRSSHESLWRLGLFTNRLMVLVIFLIVLLQVAALTVPPLRDIFLRLTPLSPVDFLLCVGLGGTLLLAVEAEKWLLRRRQAR

SEQ ID NO: 107909 - DNA, 2745 bp, Chromobacterium violaceum
  CDS (1)..(2745)
atgaccaagaatctcaccccccgcaaacggagccggggcttcatcgccaccccgggcaagaccggcgaccaaatcgccttccgcctggctcacgaagccttgctgccgcaagaagaaaccttcaagcggctgcgcagccagccggaaggcctcaccgccgccgaagccgcccaacggctggagcaatacgggcccaacgaagtggcccacgacaagccgccgcacgcgctggtccaattgctgctggcgttcaagaacccgttcgtgatggtgctgatcgcgctggccgcgatcagctacgtgatggacatcgcgatggccgcgccgggcgaccaggactggaccaaggtcatcatcctggggagcatgataggcgtcagcggcctgctccgattctggcaggaataccgctcggccaaggcggcggaaaaactgaagtcgctggtgcgcaacaccgccaccgtgcagcgccgccccacttcgccgaccgtgccgctgcgcatggaggtgccgatggccgaactggtggtgggcgacgtcatccatctgcaagccggcgacatggtgccggccgacgtgcggctgctggagtcccgcgacctgttcatcagccaggcggtgctgaccggcgaggcgctgccggtggagaagtacgacacgctgggcgcggtggccgccaagtccgccgacggccagacggacggcgaggccggcctgctcgacctgtccaacgcctgcttcatgggcaccaacgtggtgtccggcaccgcccgcgcggtggtggtggccaccggcaccgatacctatttcggctcgctggcgcgcaacgtagtcagccacaaacgcatcgagaccagcttcgacaagggcgtcaacagcgtgtcctggctgctgatccgcttcatgctggtgatggtgcccatcgtgttcatgatcaacggcgtcaccaagggcgactggatgtccgccctcaccttcgcgctggcggtggccgtgggcctgacgccggaaatgctgccgatgatcgtctccgccaacctggccaagggcgcggtggcgatggcgcggcgcaaggtggtggtgaagcggctgaactcggtgcagaacttcggcgcgatggacgtgctgtgcaccgacaagaccggcaccctgacccaggacaagatcatcctggagcatcactacgacgtttacggcgacaaggatgaaaccacgctgcagctggcctggctcaacagcttccaccagagcggcatgaagaacctgatggacatcgccatcgtcgaacgcgccgacgaactgggcgagcgcgtcaagctgcgccattacagcaaggtggacgagctgccgttcgatttcgagcgccgccggctgtcggtgatcctgcaggagcagaatggccagcagctgatggtgtccaagggcgcggtggaagagatgctggccgtctgcagccacatccaggacggcgacgaagtgcgcgcgctgaacgcggaagaacgcgcccgcatgctgcgcctgagccaggaattcaacgccgagggctatcgcgtgctggtggtggccacccgccacattccgtccgacgaacgcaagaacgcctaccagaccgcggacgaaaaaggcctggtggcgcgcggcttcctgaccttcctcgacccgccgaaggactcggccgcgccggcgatcaaggcgctgaacgagtacggcgtcgcggtcaaggtgctgaccggcgacaaccccatcgtcaccgccaaggtctgccgcgacgtcggcctcaatccgggcaagccgctcttgggccaggagatcgaggcgatggacgacgtggcgctgtgcgccgcggtcaagcacaccaccatcttcgccaagctgaccccgctgcagaaatcgcgggtggtgaaggcgctgcaggccaacggccacaccgtcggcttcctcggcgacggcatcaacgacgcgccggcgctgcgcgacgccgacgtcggcatctcggtggacagcggcgccgacatcgccaaggaaaccgccgacatcatcctgctggaaaagagcctgatggtgctggaagaaggcgtgatcaagggccgcgaaaccttcggcaacatcctcaagtacctgaacatgaccgccagctccaacttcggcaacgtgttctcggtgctggtggcgtccgcctggctgccgtgggaaccgatgctggccatgcagctcttgctgcagaacctgatctacgacctgtcgcagatgttcctgccctgggacaagatggatccggacttcctgaagaagccgcgcaagtgggaagccggcaacatcaagcgcttcatgctgtggctgggaccgacgtcctcggtgttcgacatcaccacctacatcctgctgtggacggtgttcggcgccggcgcggcctaccacctgcacggcggcgacggcggccagttgatcatgaacactggctggttcatggaaggcctgatatcgcagaccctggtggtgcacatgctgcgcacccgcaagattccgttcctgcagagcacggcgtccctgccggtgatgctgtccaccacggctgccatcgccatcgcctgctacctgccgttctcgccgatcgcttcctcgctgggcttcatccagctggataccagctacttctggtggctgctgctgaccatggccggctacctggccctgacgcaaacggtgaagacgctgtacatcaaacgttacggccagtggttctga

SEQ ID NO: 107910 - protein, 914 aa, Chromobacterium violaceum
MTKNLTPRKRSRGFIATPGKTGDQIAFRLAHEALLPQEETFKRLRSQPEGLTAAEAAQRLEQYGPNEVAHDKPPHALVQLLLAFKNPFVMVLIALAAISYVMDIAMAAPGDQDWTKVIILGSMIGVSGLLRFWQEYRSAKAAEKLKSLVRNTATVQRRPTSPTVPLRMEVPMAELVVGDVIHLQAGDMVPADVRLLESRDLFISQAVLTGEALPVEKYDTLGAVAAKSADGQTDGEAGLLDLSNACFMGTNVVSGTARAVVVATGTDTYFGSLARNVVSHKRIETSFDKGVNSVSWLLIRFMLVMVPIVFMINGVTKGDWMSALTFALAVAVGLTPEMLPMIVSANLAKGAVAMARRKVVVKRLNSVQNFGAMDVLCTDKTGTLTQDKIILEHHYDVYGDKDETTLQLAWLNSFHQSGMKNLMDIAIVERADELGERVKLRHYSKVDELPFDFERRRLSVILQEQNGQQLMVSKGAVEEMLAVCSHIQDGDEVRALNAEERARMLRLSQEFNAEGYRVLVVATRHIPSDERKNAYQTADEKGLVARGFLTFLDPPKDSAAPAIKALNEYGVAVKVLTGDNPIVTAKVCRDVGLNPGKPLLGQEIEAMDDVALCAAVKHTTIFAKLTPLQKSRVVKALQANGHTVGFLGDGINDAPALRDADVGISVDSGADIAKETADIILLEKSLMVLEEGVIKGRETFGNILKYLNMTASSNFGNVFSVLVASAWLPWEPMLAMQLLLQNLIYDLSQMFLPWDKMDPDFLKKPRKWEAGNIKRFMLWLGPTSSVFDITTYILLWTVFGAGAAYHLHGGDGGQLIMNTGWFMEGLISQTLVVHMLRTRKIPFLQSTASLPVMLSTTAAIAIACYLPFSPIASSLGFIQLDTSYFWWLLLTMAGYLALTQTVKTLYIKRYGQWF

SEQ ID NO: 107911 - DNA, 2757 bp, Bordetella bronchiseptica
  CDS (1)..(2757)
atgaaaatcatcgacaccctgctcaagcgcctcttcagccgatttctccaggggcggcacgcgaatcgccatttcaagcgccaggccattctcgaaaccctgcgcggcgcccatggcgcggcggcgcgggccggggccgggcgcgtcgcgcgcgacatgcggcggatcgcctccgatgacgtcgccgccgccatggcccgcatgggctcgcgcgagggggggctgagcgcggccgaggtgcacgagcgccggacccgtttcggccccaacgaggtcgaacacgagaagcccctgcccgggtggctgcacctgtggcactgctacaggaatccgttcaatcttctgctgagcgtgctggccggcatttcgttcgcgacggatgacatgacggcggccgcggtcatcggcacgatggtggccttgagcaccctgatccgcttcgtgcaggaaggccgttccagccgggcggccgagcggctcaaggccatggtcggcaacaccgccacggtcatccggcgccgggaggacggcgagccggccggcccgcccgggcgcgccgcgcgggcggaagtgccgatccgcgacctcgtgcccggcgaccacatcgtgctttccgccggcgacatgattccggcggactgccgcctgctggccgccaaggacctgttcatcgcccaggcggcgatgaccggcgagtcgctgccggtggagaaattcgccggcatcaacgaaccgttcgagacgatattcgacgcgcccaacctggtcttcatgggcaccaccgtggtttccggcgcggccaccgcgctggtgatcgccacgggcggccggacctatttcggcgggctttcggcgcgcgtgaccgccgccgatcgcgcgccgaccgcgttcgagagcggggtgaacagcgtcagctggctgctgatccggttcgcgctggtcatggcgccggtcgtcctgctgatcaacggtttcaccaagggcgactggctggaggcttcgctgttcgcgctgtcggtggcggtgggcctgacgccggagatgctgccgatgatcgtgacgtccaccctggccaagggcgcggtggtgatgtcgcgcaagaaagtgatcgtcaagcgcctggacgcgatccagaacttcggcgccatggacgtgctgtgcaccgacaagaccggcacgctcacgcaggaccggatcgcgctggagcggcacaccgacgcgttcggcaacagctcggacgaggtgttgcggtatgcctatctcaacagctattaccagaccggcctgaagaacctgctcgaccatgcggtgctcgagcacgccgagctgcagcgggaaatgcgggtggcgctcgactatcgcaaggtcgacgagattccgttcgatttcgagcggcggcgcatgtcggtggtggtgtccgagcgcgacgatcatcacgaactgatctgcaagggcgcggtcgaggaaatgctgtcggtctgcgaccgcattcgcatcgagaccgcgcaggggccgcgccatgttccgctcgacggcgaacagctcgaccgcgtgcgcgcgttcacgcatgccttgaacgaacagggcttgcgggtggtcgcggtggccatgaaggcgctgccggcctcgcagtcggcgtattcggtggccgacgaagccgggctgaccctggtgggccatatcgcctttctcgatccgccgaaggaatccaccgagccggcgctgcgcgcgctggccgggcatggcgtgcgggtcaaggtgctgaccggcgacagcgaactcatcgcggcgcatgtgtgcggcagggtggggctggagcacggccgctacctgctgggcgcgcagatcgagaacatgagcgacgagcacctggcctgcgcggtcgagacgcaccagttgttcgcgcgcctgacgccgcaggacaaggagcgcatcgtgcgcgccctgcgcggcaatggccacgtggtcggcttcatgggcgatggcatcaacgatgccgcggccctgcgtgcggcggacatcggcatttcggtggacgccggcgtggacatcgccaaggaagccgccgacatcatcctgctggaaaaaagcctgatggtgctggaggagggcgtggtggagggccgcaggacgttctgcaacatgctcaagtacatacgcatgacggccagctccaacttcggcaacgttttctcggtcctggtgggcagcgcgttcctgccgttcctgcccatgctgccgctgcaattgctggtgcagaacctgctgtacgacatctcgcagatcgccatcccgttcgatgacgtggacgaggagctggtcgccaagccgctgaaatggaatccggccgacatcgggcgcttcatggtgttcttcggcccgctcagctcggtcttcgatatcgctacctacgtgctcatgtggcatgtcttcgcggccaacacggtgggcgagcaggggttgttccaatcgggctggttcgtggtcggcctgctgacgcagaccttgatcgtgcacatgatccgctcgcccaaattgccgttcatccagagccgggcggcctggccgctgctgctgatgaccgcgctcatcatggccataggcgtggccttgccgatgagcccgctggccggctatttcaacctgcaggcgctgcccccggcctatttcccgtggctgctcgccatcctgctgggctacgcgctgctgaccacggcgatgaagaagatctatatacggaagttcggctggcagtga

SEQ ID NO: 107912 - protein, 918 aa, Bordetella bronchiseptica
MKIIDTLLKRLFSRFLQGRHANRHFKRQAILETLRGAHGAAARAGAGRVARDMRRIASDDVAAAMARMGSREGGLSAAEVHERRTRFGPNEVEHEKPLPGWLHLWHCYRNPFNLLLSVLAGISFATDDMTAAAVIGTMVALSTLIRFVQEGRSSRAAERLKAMVGNTATVIRRREDGEPAGPPGRAARAEVPIRDLVPGDHIVLSAGDMIPADCRLLAAKDLFIAQAAMTGESLPVEKFAGINEPFETIFDAPNLVFMGTTVVSGAATALVIATGGRTYFGGLSARVTAADRAPTAFESGVNSVSWLLIRFALVMAPVVLLINGFTKGDWLEASLFALSVAVGLTPEMLPMIVTSTLAKGAVVMSRKKVIVKRLDAIQNFGAMDVLCTDKTGTLTQDRIALERHTDAFGNSSDEVLRYAYLNSYYQTGLKNLLDHAVLEHAELQREMRVALDYRKVDEIPFDFERRRMSVVVSERDDHHELICKGAVEEMLSVCDRIRIETAQGPRHVPLDGEQLDRVRAFTHALNEQGLRVVAVAMKALPASQSAYSVADEAGLTLVGHIAFLDPPKESTEPALRALAGHGVRVKVLTGDSELIAAHVCGRVGLEHGRYLLGAQIENMSDEHLACAVETHQLFARLTPQDKERIVRALRGNGHVVGFMGDGINDAAALRAADIGISVDAGVDIAKEAADIILLEKSLMVLEEGVVEGRRTFCNMLKYIRMTASSNFGNVFSVLVGSAFLPFLPMLPLQLLVQNLLYDISQIAIPFDDVDEELVAKPLKWNPADIGRFMVFFGPLSSVFDIATYVLMWHVFAANTVGEQGLFQSGWFVVGLLTQTLIVHMIRSPKLPFIQSRAAWPLLLMTALIMAIGVALPMSPLAGYFNLQALPPAYFPWLLAILLGYALLTTAMKKIYIRKFGWQ

SEQ ID NO: 107913 - DNA, 2934 bp, Physcomitrella patens
  CDS (1)..(2934)
atggtcgacatccgagagttgatggaggtaccatgcgacgaatcatgctcaaaccatagcaagtccttcgaggaagttatcaaggttctagacagcaattcggagttggggctctcgaatgccaaagctgagcgattgctgaagcagtacggtcgcaacgagctcaagggtcagggggcagtgaacccatggaaaattttgcttgcgcaagtggccaacggcctgacggccgtgctgacaatcgctatggtggtgtctttcgccgtaaaagactacggcgaaggaggagtgttggtgctagtgattgcattcaacaccatcgttggattcatgcaagagtatcgcgcggagaaaaccatggatgccttgcgaaagatggcgtcgccgtcggcgaaggtcatccgagagggtattcagcaaagaatctccagtacggatgttgttccaggagatgtgctgactttcgaggtcggcgacattattcctgcagactgccgactgatggaggtcctgaatcttgaagttgacgaggctttgctcactggtgaatctgtaccttcgatcaagctcgtagagccaattctgggcaaggatgtctcgattggcgatcgcatcaacatggtgtactcgagcaccacggtggcgaagggaagaggtcgagcaatcgttgcatccaccgggatgtccactgagattggaaagatttccaacgcaatcaatgaaacacctgcgcaattgactctcttgcagcggaggcttaacatgatggcatacgtgctgatggtgatcgcgctcatcttagcactgattgtttttgctgtgaacaaatttgattttaacacggaaataattatctacgccatcgccctcgcaattggtgtcatcccagaggggcttatcgcggtcattaccattgtgcaagctctcggcgtacggcggatggccaagcagcatgcactggtgcggaagctggtagctttagagtccctgcaggcggtgacaaacatctgctcagacaagaccggcactttgacgcagggcaagatggtggtgacgaatgtttggttccctggacacgactccgagtacatcatctccggccagggatacgagaccaaaggcgacatttcggctcagggccgtgctatcgccacagagacagcgctcgaggacttgaatttccggaagctggtggagtgctgcgcgttatgcaacacggcaaacatcgttgaggcttcacagggcaacgtgtggggggatccaactgagattgctctgcaggtgttcgcgtacaaaatgcagatggggaagcctatcctgcgcaagaccaagaagccggttgaggagttccccttcagctccgacaccaagcggatgagcatggtttacctaacaaaactcgaagacgtgcttgaagtttattcaaagggggcagaggttgtgctgacaatctgcgacgatgtgatggaacggacggggaacctcaggaacatcagcgaggacggtgagttcatgaagaatgtgactgtacaacaagaggagatggcgaaacagggtttaagggttttagtgatagcctacagacaagaatctgagcgagcgattggcaagccggtgtgtaaatggaagcgtgaggatgttgagagtaatttgacattcctagggttggtaggaatccgagacactcctcggatagagtccaaggaatctgtgagtcagtgtcaccaagctggtattactgtccacatgctcacgggagatcacaaagctacggctctgtccatcgccagggaagttggcatcttggagccactgtccgcatccaagagatctacatcgaaacgtggagtgaaaggtgatgcccatgtggtgcccatgtcatcgtctgtgatgacggcaacggagttcgacccgttgtcggagaaggaggtggacgcactggacgaacttccactggtgattgcgaggtgcacaccatcaacgaaggtgagaatgatcgacgcactgcacaggaggaagaagtatgcggctatgacgggagacggagtgaacgatgcgcccagtttgaagaaagcggacgtgggaatagccatgggagctgggagtgatgtggccaagacaagcagcgaaattgtacttacagacaacaatttcgcaacaattgttcaagccgtggccgagggacgtcgaatattttccaacatcaagaaattcgttgtgcatttgctgagcactaatgttggacaggtcattgtgctcctcggagggctggcgttcaaggatggctctggaatgtcagtgtttccactatcccctgtacagattctattcctgaatcttattacgggcacgccacccgccatggcattgggaattgagcgtgcctcctccacagtcatgcaagtacgaccatatctcaagggactattcacgaatgagctcatcgctgacatcctcgtttacggtaccttcaccggcgtcttggcccttctgaattgggtgcttgttatctacgcattcgggaatggcgaccttggcagtcagtgcaatacttcatcgaatctgggagcctgcgtgaccgtcttccgcgctagggcgactgtgcaaatggcattcacatggatgatcctatttcacgcttacaactgccgacacttgcgagcaagtctgttcaccacggaaggaggcggccgttctcgctttttcgccaacaaattgatggttgcctcggtgttcttgggcgctgtcgtgccagttctcaccctgtacataccggtcctcaacaccggcatcttcaagcaggaaggtctgacatgggagtggatccttgtcggtatcaccatggttgtgttctttctgttgtcggagttttacaagttgctcaagcggcgcttcatcaccaccccttacactatgaccagggtgaggaagtag

SEQ ID NO: 107914 - protein, 977 aa, Physcomitrella patens
MVDIRELMEVPCDESCSNHSKSFEEVIKVLDSNSELGLSNAKAERLLKQYGRNELKGQGAVNPWKILLAQVANGLTAVLTIAMVVSFAVKDYGEGGVLVLVIAFNTIVGFMQEYRAEKTMDALRKMASPSAKVIREGIQQRISSTDVVPGDVLTFEVGDIIPADCRLMEVLNLEVDEALLTGESVPSIKLVEPILGKDVSIGDRINMVYSSTTVAKGRGRAIVASTGMSTEIGKISNAINETPAQLTLLQRRLNMMAYVLMVIALILALIVFAVNKFDFNTEIIIYAIALAIGVIPEGLIAVITIVQALGVRRMAKQHALVRKLVALESLQAVTNICSDKTGTLTQGKMVVTNVWFPGHDSEYIISGQGYETKGDISAQGRAIATETALEDLNFRKLVECCALCNTANIVEASQGNVWGDPTEIALQVFAYKMQMGKPILRKTKKPVEEFPFSSDTKRMSMVYLTKLEDVLEVYSKGAEVVLTICDDVMERTGNLRNISEDGEFMKNVTVQQEEMAKQGLRVLVIAYRQESERAIGKPVCKWKREDVESNLTFLGLVGIRDTPRIESKESVSQCHQAGITVHMLTGDHKATALSIAREVGILEPLSASKRSTSKRGVKGDAHVVPMSSSVMTATEFDPLSEKEVDALDELPLVIARCTPSTKVRMIDALHRRKKYAAMTGDGVNDAPSLKKADVGIAMGAGSDVAKTSSEIVLTDNNFATIVQAVAEGRRIFSNIKKFVVHLLSTNVGQVIVLLGGLAFKDGSGMSVFPLSPVQILFLNLITGTPPAMALGIERASSTVMQVRPYLKGLFTNELIADILVYGTFTGVLALLNWVLVIYAFGNGDLGSQCNTSSNLGACVTVFRARATVQMAFTWMILFHAYNCRHLRASLFTTEGGGRSRFFANKLMVASVFLGAVVPVLTLYIPVLNTGIFKQEGLTWEWILVGITMVVFFLLSEFYKLLKRRFITTPYTMTRVRK

SEQ ID NO: 107915 - DNA, 2904 bp, Physcomitrella patens
  CDS (1)..(2904)
atggagggctctggggacaagcgacatgagaatttggacgaggatgggtacaactggcatgcgcagtcggtggaatccgtgagcaaggcgttggggacgaatccaaacctgggcgtgtcggatgggcggagtgcagagctgctgaagcagcacggttacaacgagctgaaggggcaggctggggtgaacccatggaagatcttgctgcggcaggtctcgaacggcctgacggccgtgcttgtcgtcgctatggttgtatcctttgcagtgaaggattatgccgaggcgggggttctggtaattgtgattgcgttcaatacaatcgtggggtttgtgcaagaataccgcgccgagaagaccatggatgcattgcggaaaatggcgtcaccctcggcgaaggtgattcgagacggaagccatcaccgaatctcgagcagggatgtggtgcccggggacttgttgacgttcgaggtcggggatgttgtacctgctgactgtcgtctgattgaggttctgaacctggaagtcgacgaggcgttgctgacaggagaggctgtgccttctttgaagactgtgcagccgatcggggggaaggatgtctcgattggggaccgcaccaacatgtcatactcaagtactacggtggtgaaggggagagggaaggcgattgtggtgagcacagggatgtctaccgagattggaaagatttccaaggccatcaacgagacgaagacgcagtccactcctatgcagaggaagcttaatctgatggcctacatgctcctcgcatttgcgctgctgcttgcgctgattgtgtttgctgtaaacaagtttaactttagtactgaggttgtgatttacgccatcgcgctctcgattgctatcattcctgaggggctgattgcagtcatcacgattgtacaagcgctaggcgtgcggcgtatggccaagcagcatgcattggtgaggaaactggtggcgttggaatcgcttcaagcagtgaccaatatctgctcggataaaacgggtacgctgacggagggaaagatggtggtgacgaacgtttggctgccgggacatgagtctgagtacattgtcgctgggcaagggtacgagactgttggcgacttgtccacttcggcgggtgtcgctgtagttagatcagcggcgctggaggatgtgaattatcgattgctggtggagtgctgtgccttgtgcaacacggcgaacatcgtcgaggcatccgagggtaaagtgtggggagaccccactgagatcgccctccaagtgttcgcatataaaatggagatgggtatgcccattctgcgtaaacacaaggaactcgttgaggaatttcctttcagctcagacacgaagcggatgagcatggtatgccagactgagtcgggaaacttcttagagattttcacgaagggttctgaagttgtgctcagtatttgcgacaacgtgatggatcggactggagacatacatagcatctctggggacgaggggttcttgaagctcgtctcaacgcaacaggaggagatggcaaagcaaggtttaagggttctagtgctcgcgtacgggcaagtatcggagagatccatcggcaagcccctttcaaagtgggagcgtaacgacgctgagaaaagcttgacattccttggtttggttggaatcagagacactcctcgggtcgagtctgagcaatctgtgcgcaattgtcaccgcgccggtattacagttcacatgctcaccggagaccataaagccaccgctatgtcgattgcaaaggaagtgggaatcatagaggaaccacatgggtctgagatagcgaatggtaatgaaatcgtccccttgtcagcatctgtcatgaccgcgacagaatttgaccaactgactgatgagcaagtggatgctctggtcgatctccctcttgtaattgcgcggtgcacaccctcaacgaaggtgagaatgatcgacgcgctccaccggagaaagaaattcgtggccatgaccggcgacggggtgaacgacgcgcccagtttgaagaaggccgatgtgggaatcgccatgggcgcaggtagtgatgtggccaagacaagcagtgacatcgtgctcacagacaacaacttcgcaaccatagtacaagccatcggcgaagggcggaggattttctccaacatcaagaagttcgtgttgcacctgctgagcactaacgtcggacaagtgatagtgctactgataggtttggctttcaaggatcggacgggcacttccgtctttccactatccccagtgcagattctctttctgaatctcgtcacgggaacaccgcctgccatggctctgggaattgagccggcctcctcttccgtgatgcaagtccctccccacgtcaaaggacttttcactgtggagctcatcatggacatcttcattttcggcaccttcataggcatcctcgccctggcatcatgggtgctcgtcatctaccccttcggaaactccgacctcgccactctctgcaacaccaccgccaacttacaagaatgctccaccatcttccgcgccaggtccacagttcaactgtccttcacgtggatgatcctcttccacgcttacaactgccgccacctccgtgccagtttgctcactgctgagggaggcggcgcctcgcggttcttctccaacaaagttttggttgcgagtgtgttcatcggtgctcttctgcccatccccaccatctacatcggcacgctcaacacggaagtcttcaagcaggaaggcattacctgggagtggatcatcgtgatcgtctcggtgttcgtcttcttcttgctatcagagttttacaagctgcttaagcgtcgcttcattaaaactccctacaacatgtga

SEQ ID NO: 107916 - protein, 967 aa, Physcomitrella patens
MEGSGDKRHENLDEDGYNWHAQSVESVSKALGTNPNLGVSDGRSAELLKQHGYNELKGQAGVNPWKILLRQVSNGLTAVLVVAMVVSFAVKDYAEAGVLVIVIAFNTIVGFVQEYRAEKTMDALRKMASPSAKVIRDGSHHRISSRDVVPGDLLTFEVGDVVPADCRLIEVLNLEVDEALLTGEAVPSLKTVQPIGGKDVSIGDRTNMSYSSTTVVKGRGKAIVVSTGMSTEIGKISKAINETKTQSTPMQRKLNLMAYMLLAFALLLALIVFAVNKFNFSTEVVIYAIALSIAIIPEGLIAVITIVQALGVRRMAKQHALVRKLVALESLQAVTNICSDKTGTLTEGKMVVTNVWLPGHESEYIVAGQGYETVGDLSTSAGVAVVRSAALEDVNYRLLVECCALCNTANIVEASEGKVWGDPTEIALQVFAYKMEMGMPILRKHKELVEEFPFSSDTKRMSMVCQTESGNFLEIFTKGSEVVLSICDNVMDRTGDIHSISGDEGFLKLVSTQQEEMAKQGLRVLVLAYGQVSERSIGKPLSKWERNDAEKSLTFLGLVGIRDTPRVESEQSVRNCHRAGITVHMLTGDHKATAMSIAKEVGIIEEPHGSEIANGNEIVPLSASVMTATEFDQLTDEQVDALVDLPLVIARCTPSTKVRMIDALHRRKKFVAMTGDGVNDAPSLKKADVGIAMGAGSDVAKTSSDIVLTDNNFATIVQAIGEGRRIFSNIKKFVLHLLSTNVGQVIVLLIGLAFKDRTGTSVFPLSPVQILFLNLVTGTPPAMALGIEPASSSVMQVPPHVKGLFTVELIMDIFIFGTFIGILALASWVLVIYPFGNSDLATLCNTTANLQECSTIFRARSTVQLSFTWMILFHAYNCRHLRASLLTAEGGGASRFFSNKVLVASVFIGALLPIPTIYIGTLNTEVFKQEGITWEWIIVIVSVFVFFLLSEFYKLLKRRFIKTPYNM

SEQ ID NO: 107917 - DNA, 3560 bp, Oryza sativa
  CDS (307)..(3162)
gccaccgacacgtgggccccacgacccagccagccagagtcccagaagttaacgggggcacgcgaacagagaggggggccccgcgcggcgaggtggggcccagtgcgggtatgaagcggggaggcgctatatagagcgcacccatcctcctcccccttcctccctctcctctccactactaataccaccaccgccgcgccggaggtggaagacggacggggtagagttggggtctcgcggtgagccgattcctctctagtggtcgcgcctggtgtgttcgccgacgacgccggcgtcgcgtcagccatgggtgggctcgaggagatcaagaatgaggccgttgatctggagaacataccgatcgaggaggtgttcgagcagctgaaatgtacgcgcgaggggctctcctccgaggaggggaaccggcgtatcgagatgttcggccccaacaagctcgaggagaagaaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaaccctcacccttaacaagttgagcgtcgacaagaacctcgttgaagtgttcactaaaggtgttgacaaggaccatgttttgttgctggctgcaagggcatctaggacagaaaaccaagatgccatcgatgctgccatggttggtatgcttgctgatcccaaggaggcaagagccggtatcagggaagtgcacttcttgcccttcaacccagttgacaagaggactgctctaacatacatcgatgccgatggtaactggcaccgtgccagcaagggtgctcctgagcagatcctgaccctgtgcaactgcaaggaggatgtaaagaggaaggtgcatgctgtgattgacaagtatgctgagcgtgggcttcgttctcttgctgttgcaagacaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctgagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccatttatgcagtttccatcaccatccgtatagtgcttggatttttgcttattgctctgatctggaaatacgacttctcacccttcatggtccttatcattgccatcctgaatgacggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggctgagagagctgaacactctcaagggccacgtcgaatcggtggtgaagctgaaggggctggacatcgacacgatccagcagaactacacagtgtgaggaaccccctcggcattcaacgagagatcgtcatcagcgctggagcgggaattgcaaacggcgctctggttaaaggaaattttcgatgaatgattggaagaacaaaaaacaaaaaaacatggctgatctgaacagccctagttgtaaagtgctaccaaatatatggtccggtttccctcttctagagaggttttacgttctagtggagtaccgtacgtacgtgttggagtacgacgacgtgttgtgatcgtttttggtctttttttactcttttccccctaactagcggtcttcttgcggaatgcaagatggagaaataatggatgaaaaattttctgccacgttaattctcactttggcaaatgggtctgcttcaattacttcttaattactctgcg

SEQ ID NO: 107918 - protein, 951 aa, Oryza sativa
MGGLEEIKNEAVDLENIPIEEVFEQLKCTREGLSSEEGNRRIEMFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKIDQSALTGESLPVTKNPGDEVFSGSTCKQGEIEAVVIATGVHTFFGKAAHLVDSTNQVGHFQTVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFTKGVDKDHVLLLAARASRTENQDAIDAAMVGMLADPKEARAGIREVHFLPFNPVDKRTALTYIDADGNWHRASKGAPEQILTLCNCKEDVKRKVHAVIDKYAERGLRSLAVARQEVPEKSKESAGGPWQFVGLLPLFDPPRHDSAETIRKALHLGVNVKMITGDQLAIGKETGRRLGMGTNMYPSSALLGQNKDASLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFLLIALIWKYDFSPFMVLIIAILNDGTIMTISKDRVKPSPLPDSWKLKEIFATGIVLGSYLALMTVIFFWAMHKTDFFTDKFGVRSIRNSEHEMMSALYLQVSIVSQALIFVTRSRSWSFIERPGLLLVTAFMLAQLVATFLAVYANWGFARIKGIGWGWAGVIWLYSIVFYFPLDIFKFFIRFVLSGRAWDNLLENKIAFTTKKDYGREEREAQWATAQRTLHGLQPPEVASNTLFNDKSSYRELSEIAEQAKRRAEIARLRELNTLKGHVESVVKLKGLDIDTIQQNYTV

SEQ ID NO: 107919 - DNA, 3527 bp, Sesbania rostrata
  CDS (208)..(3072)
ctagaattcagcggccgctgaattctagaactctaatcactctttcctttgcttctccactgcaagggacagagaatcctcatgatccttctgttctgtggcaatagcatttctctcttcccattcctccattgattaatttcactctcccacaattgccatctcaccttgctctggcctttccttctgttcagaatctgaacacacatggcggccaaagggtcaatcaccctcgaggaaatcaagaacgagactgttgatctggaacgtattcctgtagaggaagtgttcgagcaattgaaatgtaccagagaagggttgtcctcggaggaaggagccaatcggcttcaaatatttggtccaaacaagctagaggagaaaaaggaaagcaaaatactaaagtttctcgggttcatgtggaatcctctgtcatgggtcatggaagctgcagctatcatggcaattgctcttgcaaatggtgatgggaagcccccagattggcaagattttgttggtattgtttgcttgttgctcatcaactccaccatcagtttcattgaagaaaataatgctggtaatgctgctgctgctctcatggctggtcttactcccaagacaaaggttcttagagatggtcaatggagtgagcaagaagctgcaattctagtccctggagacatcataagcatcaaactaggtgatattattcctgctgatgctcgtcttcttgagggtgatcctttaaaggtggatcaatctgctttgactggagagtcacttccagtgaataagaatcctggggatgaggttttctctggctcaacttgtaaacaaggtgaaattgaagctgttgttattgcaactggtgtccacacattttttgggaaagcagctcacctcgtggatagtaccaaccaagttggacatttccagaaggtgcttacagcaattggaaacttctgtatttgttccattgcagttggtatgttggctgagatcatagtcatgtacccgattcagcaccgaaagtacagagatggaattgacaaccttttggtcctcttgattggaggaattcccattgctatgcctactgtgttgtctgtgacaatggccattggttctcacaggctttctcagcaaggtgctatcaccaagcgaatgactgccattgaagaaatggctggtatggatgttctttgcagtgacaagacgggtacactcacacttaacaagctaacagttgacaagaacttgattgaggtctttgcaaagggtgtggataaggaacatgtgttgcttcttgctgcaagggcttccaggactgaaaaccaggacgctatagatgctgcagttgttggaactcttgctgacccaaaagaggcaagggctgggataagagaagtgcacttcttcccattcaaccctgttgataaaagaactgctttgacttacattgattctgatggaaattggcaccgtgcaagcaaaggtgctcctgagcagataatgaccttatgtaacctcagggatgatgctaagaagaagatccatgctattattgacaaatttgcagaaagaggacttcgttcacttgctgttgctagacaggaagttcctgagaaatcaaaagacagtgctggtggtccatggcagtttgttggtttgctgtcactgtttgatccccctaggcatgacagtgctgaaaccattcgcagagctctcaatcttggtgtaaatgttaagatgattacaggtgatcaacttgccatagctaaggagacaggtcggagacttggtatgggaacaaatatgtacccatccgcttccttgcttggccaagacaaagatgcaagtattgctgcactacctatagaagagttgattgagaaggcagatggatttgctggagtttttccagagcacaaatatgaaattgtaaagaagttgcaagagaggaagcacatttgtggaatgactggagatggtgtgaatgatgctcctgcattgaagaaggctgatattggaattgcagttgctgatgccactgatgctgcaagaagtgcttctgatattgtcttgacagaacctggattgagtgttattattagtgcagtcttgactagtagagctatttttcaaagaatgaagaactacacgatctatgcagtatctatcactatccgtatagtgtttggcttcatgtttattgcattgatctggaaattcgacttctctcctttcatggttttgattattgccattctaaatgatgggacaatcatgacaatttccaaggacagggttaagccatctcccatgcctgatagttggaaactgaaagaaatatttgctactggggttgtgcttggaggttacttggcattgatgactgttatattcttctgggcaatgaaagaaactactttcttctctgacaaatttggagttagatccctgcatgacagcccagatgaaatgatagctgctttgtatctacaagtcagcatagttagtcaggctttgatctttgtaacccgttcacgcagctggtcttatgttgaacgccctggattgctgttaatgagtgcttttgtcattgctcagctgattgctacattgatagcagtatatgccaactggggctttgcaaggatcaagggaattggttggggttgggcaggagtcatatggctctacagtattgttttctatgttcctcttgacatcatgaagtttgctatccgctacatcttgagtggcaaagcttggctgaatcttcttgaaaacaagactgcctttaccaccaagaaagactatggtaaagaggagagggaagctcaatgggctcttgctcagaggaccctgcatggacttcaaccaccagaaacttctggcattttcaatgaaaagagcagttacagggaactgtctgagattgctgagcaggccaagagacgagctgaagttgcaaggcttcgtgagcttcacactcttaagggacatgttgagtctgtggtgaagctgaaaggtctggacattgatacaattcagcagcactacactgtgtgatgagcaacacacaaacgttgtagatagcaaaggggccaaaattcaatggcatacctgaaagaacaagagataaagccaaggcctaactatttaaatgcttactaggtagggagaggaagcctatcatatctctctcccaatttgtttttctttcttttttttttatgtgtttccagttccagcaaaaggatgtctttgccttgatgctagggggaaaagtagtgttagtttctatccttgcttttcccatgcttttcatatgcttttgggtgcttcctcaacctgggtttttcatgtttattgaatgtcacattgaagtgattagacaatgagctaaatgttgggattttttgtgatgggagaataagagtttatggaagtgttaacggcatcatgcaaaatttgaaactttgatttggtctcaaaaaaaaaaaaaaaaaaaaaaaaaaaaaaaa

SEQ ID NO: 107920 - protein, 954 aa, Sesbania rostrata
MAAKGSITLEEIKNETVDLERIPVEEVFEQLKCTREGLSSEEGANRLQIFGPNKLEEKKESKILKFLGFMWNPLSWVMEAAAIMAIALANGDGKPPDWQDFVGIVCLLLINSTISFIEENNAGNAAAALMAGLTPKTKVLRDGQWSEQEAAILVPGDIISIKLGDIIPADARLLEGDPLKVDQSALTGESLPVNKNPGDEVFSGSTCKQGEIEAVVIATGVHTFFGKAAHLVDSTNQVGHFQKVLTAIGNFCICSIAVGMLAEIIVMYPIQHRKYRDGIDNLLVLLIGGIPIAMPTVLSVTMAIGSHRLSQQGAITKRMTAIEEMAGMDVLCSDKTGTLTLNKLTVDKNLIEVFAKGVDKEHVLLLAARASRTENQDAIDAAVVGTLADPKEARAGIREVHFFPFNPVDKRTALTYIDSDGNWHRASKGAPEQIMTLCNLRDDAKKKIHAIIDKFAERGLRSLAVARQEVPEKSKDSAGGPWQFVGLLSLFDPPRHDSAETIRRALNLGVNVKMITGDQLAIAKETGRRLGMGTNMYPSASLLGQDKDASIAALPIEELIEKADGFAGVFPEHKYEIVKKLQERKHICGMTGDGVNDAPALKKADIGIAVADATDAARSASDIVLTEPGLSVIISAVLTSRAIFQRMKNYTIYAVSITIRIVFGFMFIALIWKFDFSPFMVLIIAILNDGTIMTISKDRVKPSPMPDSWKLKEIFATGVVLGGYLALMTVIFFWAMKETTFFSDKFGVRSLHDSPDEMIAALYLQVSIVSQALIFVTRSRSWSYVERPGLLLMSAFVIAQLIATLIAVYANWGFARIKGIGWGWAGVIWLYSIVFYVPLDIMKFAIRYILSGKAWLNLLENKTAFTTKKDYGKEEREAQWALAQRTLHGLQPPETSGIFNEKSSYRELSEIAEQAKRRAEVARLRELHTLKGHVESVVKLKGLDIDTIQQHYTV

SEQ ID NO: 107921 - DNA, 3371 bp, Sesbania rostrata
  CDS (154)..(3009)
tcaccaccttccttctttccttcagtatttctcatttaataacccaaacactgcatttattttctatgactctctaagtcacttcatatatattaatttcttctttataagcttttctcatctgttaatttcaacacttgatatttctccaacatgggaggtatcagcctcgaggagatcaaaaacgagaacgtcgatctggaacgaattccagtagaggaagtgtttgagcagctgaaatgttcaagagcaggtctctcatcagacgaaggagccagtcggctccaagtttttgggccaaacaaattggaagagaaaaaggagagcaaatttctgaaattcttgggttttatgtggaaccccttatcttgggtcatggaagctgctgctataatggctattgctttggctaatggcggaggaaggcctccagattggcaggatttcgtcggtatcattgctctgttggtgattaactccacaatcagttttattgaggaaaacaatgcaggaaatgctgctgctgcacttatggctggtttagctcccaagaccaaggttctcagagatggccgatggactgagcaagatgctgctattttggtcccaggagacataatcagcattaaattaggagatatcattcctgctgatgctcgccttcttgagggtgatgcctttgagtgtgatcagtctgctttaactggagagtctcttcaggtgacaaagaatccctctgatgaagtattttctggatcaactgttaagaaaggtgagatagaagcagttgtgattgctactggtgtgcacaccttctttggtaaagctgctcatctcgtgacagcaccaatcaagttgggcactttcagaaagttctcacagcaattggtaaatttctgcatttgctcaattgctgtgggaatagtcattgagctcatagttatgtacccaatacaacaccgcaagtacagagatgggattgacaatctgttggtgctattgattggaggaattccaattgccatgccaactgttttgtctgttactatggctattggttctcacagactttcccagcaaggtgcaattacaaaacgtatgacagctattgaggaaatggccgggatggacgttctctgtagtgataaaactggaactctgaccctaaataagctgactgttgataaaaacttgattgaggtttttgccaagggtgtcgagaaggagtatgttatccttcttgcagcaagggcttctaggactgagaatcaggatgccatagatgctgcaattgttgggatgcttgctgacccaaaggaggcacgagctggtatcagggaggtccattttctcccattcaatcccgtagacaagaggaccgctctaacctacattgattctgatggaaactggcatcgatctagcaaaggtgctcctgagcagatattgaacctctgcaactgcaaagaggatgtcagaaaaagggttcatacagcaattgacaagtttgctgagcgtggactccgttctttgggtgttgctagacaggaagtacctgagaaaaataaagatagtcctggtgcaccatggcaatttgttgctctgctaccactatttgatcctcctaggcacgatagtgcggaaaccatcacaagagctctgaacctcggtgtgaatgttaagatgattactggtgatcagcttgccattgccaaggaaactggccgaaggctggggatgggaacaaacatgtacccatcttcctcattgcttggccaaagtaaggatgcttctgtttcagctcttccagttgatgagttgattgaaaaggctgatggatttgctggagtatttcctgaacacaaatatgaaattgttaagaggttgcaagagaggaagcatatatgtggaatgacaggtgatggtgtcaacgatgcccctgcattaaagaaagcagatattggaattgctgttgctgacgctacagatgctgctagaagtgcttctgacattgtcctcactgaacctggtctgagtgtcattattagtgctgtgctcacgagcagggcgatattccaaaggatgaaaaactatacgatctatgctgtgtcaatcaccattcgtattgtgtttggcttcatgtttattgccttgatctggaagtttgattttgcacccttcatggtgttgattattgcaatactaaatgatggtaccattatgacaatatccaaggatagagtgaaaccatctccacagcccgacagctggaagctgagagagatatttgctactggtgttgtgctaggtagttacatggcactgatgacagtggtatttttctggctcatgaaggataccgacttcttctcggacaagtttggtgtgaggtccctgagaaatagtcctgaagaaatgatggcagccttgtacctacaagtcagtattataagtcaggcccttatttttgttactcggtcccgcagctggtcctatgttgaaagacctggtcttctcctactgggtgctttttttattgctcagctggtagcaacttttctagcagtatatgctaattggggcttcgcaagaattaagggaatgggatggggatgggccgctgtaatctggctgtacagtctagtgacatatgtccctcttgatatactcaaattcacaatccgctatgttctgagtgggaaggcttgggataatcttttggagaacaagactgccttcactacaaagaaagactatggcaaagaagagagagaagcacaatgggcaactgcgcagaggactcttcatggtcttcagccacctgaaacaaccagcattttcaatgacaagaatagttatagggagctttcagagattgctgagcaagccaagagacgtgctgaggttgcgaggcttagggagcttcatactctaaaggggcacgttgagtcagtggtgaagctaaaaggacttgatattgatacaatccagcaacactatacggtttaaagagcttggacaaccttcaagaagaacccgattccgtgcttgtccaagaacaaaaacaacaatgtgatgatgaagacataagtttgtctgtctttagattaggatgaaggtccttttgtgaaaaattgaatggttactcgtccattccctccatgtcagaagctggaggggagacttttctctttaggtaccaaataacatggatgataggatttacttgcgtcttattttgggaatgttaatgacattaaggtcacattaaagctctatattttcttttttggctgaacaaagctgaatatatattcgatcttgattaatcttgctctaaaaaaaaaaaaaaaaaaaaaaaaaaaaaaaaa

SEQ ID NO: 107922 - protein, 951 aa, Sesbania rostrata
MGGISLEEIKNENVDLERIPVEEVFEQLKCSRAGLSSDEGASRLQVFGPNKLEEKKESKFLKFLGFMWNPLSWVMEAAAIMAIALANGGGRPPDWQDFVGIIALLVINSTISFIEENNAGNAAAALMAGLAPKTKVLRDGRWTEQDAAILVPGDIISIKLGDIIPADARLLEGDAFECDQSALTGESLQVTKNPSDEVFSGSTVKKGEIEAVVIATGVHTFFGKAAHLVTAPIKLGTFRKFSQQLVNFCICSIAVGIVIELIVMYPIQHRKYRDGIDNLLVLLIGGIPIAMPTVLSVTMAIGSHRLSQQGAITKRMTAIEEMAGMDVLCSDKTGTLTLNKLTVDKNLIEVFAKGVEKEYVILLAARASRTENQDAIDAAIVGMLADPKEARAGIREVHFLPFNPVDKRTALTYIDSDGNWHRSSKGAPEQILNLCNCKEDVRKRVHTAIDKFAERGLRSLGVARQEVPEKNKDSPGAPWQFVALLPLFDPPRHDSAETITRALNLGVNVKMITGDQLAIAKETGRRLGMGTNMYPSSSLLGQSKDASVSALPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPQPDSWKLREIFATGVVLGSYMALMTVVFFWLMKDTDFFSDKFGVRSLRNSPEEMMAALYLQVSIISQALIFVTRSRSWSYVERPGLLLLGAFFIAQLVATFLAVYANWGFARIKGMGWGWAAVIWLYSLVTYVPLDILKFTIRYVLSGKAWDNLLENKTAFTTKKDYGKEEREAQWATAQRTLHGLQPPETTSIFNDKNSYRELSEIAEQAKRRAEVARLRELHTLKGHVESVVKLKGLDIDTIQQHYTV

SEQ ID NO: 107923 - DNA, 2754 bp, Glomus mosseae
  CDS (1)..(2754)
atgtcatcaaaaaaaagagaaatcgatcacgaaattactgtttcttcctcaacctcaagggatgttgaaaaaaagcccgctgagatcatagaacataaacatgtcgaaatgcaagaagacatttcagcggaattagaagctttgctccaaactgatcctgctaccggtttaactacagctgaagctcaaaaacggttgatagattttggtaaaaatgaattggctggatccaaaacgaacccaattctcaaatttctatcctttttcactggagcaattgcttacttaattgaagtagcttgccttttcgctgttattgtgaaacattggatcgatttcagtatcattttggcattgctgtttgtcaatgcttttattggtttcatagaagaggcacgtgccgaatctgctttagatgccttgaaacaaacgctcgcattgaaagcaaaagtttggcgtgatgcccaattcgttgaagttgacgtagctgaacttgttcccggtgacgtcatcagtcctcgcctcggagacattattcccgcggacgcccgtcttcttggaatttcagtaactggtggtgaaactgaaggatcgcttcaaatcgatcagtctgctttgaccggtgaatctcttccagttgagaaaaagaagggtagcaccgtttattcttcttcaattgtaaaacaaggtcaaatgttggcagtcgtcactaaaaccggatcaaatacttttatcggacgggcggcccacttaatttcgatcactgtggaacaaggacatttccaaaagattgttaattccatcggaaactttttgatcttagttaccgttgttttggtttctatcatcttcatttatcaaatggtaaaattccgcggaaccgaacaaggcaaatttattaccgtccttggtaacgtgcttgtattgacmattgctgccattcctgttggtttaccaactgttttatccgtcaccatggccgtcggcgcaaaacaattggctgctaaaaaagttatcgtaaaacgtcttacggctgttgaagaaatggcttcggtctcggtactttgttctgataagaccggtacattaacacttaatgagttaaccttcgatgaaccttacctctgccctggttacacgaaagacgatattcttttattttcttacctttcagctgaacctggtgcaaatgatccgattgaaaccgctgttcgttttgctgctgaaactgatttagaaatccttcaatctcggccaaataaacacgaagttcccggatataaagtcacaggatttgttccgtttaatccaaacacaaagatgtcatacgcaaccgttattgataataatacaaaagaagtttttaaagttgcgaaaggagctcctcaagttatcattaagcttgttggtggaaatgatgatgcagttcatgctgttaatagtttagccgctcgaggtcttcgtgcccttggtatcgctcgtactgtacctggagatcttgaaacatttgatctcgttggtatgattacacttctagatcctcctcgtccggattcagccgaaacaattagacgttgcggagaatatggagttgaagttaagatgattactggtgatcaattgattattgctaaggaagtagctcatcgtcttggaatgaatcgtgtaatcttggatgcaggatatctcgttgatcccgagaaatcagatgaagaagttacaaagaattgtgaacgcgccgatggttttgctcaagttattccagaacataaatatcgtgttgtagaacttttgcaaaaacgtggacttcttgttggtatgactggtgatggtgtaaatgatgctccagctctaaagaaagccaacgttggaattgcggtacatgggtgtacggatgctgccagatctgccgccgatatcgttttattagctcctgggctttctactattgttgatggtatcactgcgtctcgtgcgatttttcaacgaatgagatcttatgcactttatcgtatcacatccaccgttcactttttaatgttctttttctttatcactttaatcgaggattggactatgagagctatccttttgatcttgattgcactgttaaatgatggagctactctcgtcatttcggttgacaatgctaaaatttcagaacgtcctgataaatggcgtctcggacaattgattacattatcaatagttttgggtactttattaactgtggcttcattcacacatttttatgtcgctagagatgtattcaatatgagtcttggagaaattgaaacaattatgtatcttcacatttcttcatgtcctcattttgtcatcttttcgacacgtctttcgggatatttttgggaaaatcttccatcccctatattcaccattgcggttttaggtacacaagtatttgccatgtttatctcaatttatggagtacttgcagaaccaataggatgggcatggggggtatccattatcgggatttcattagggtactttgtcgttttagatttcgttaaagtaatgctcttcagatattggtcgtttgaacttactgccaaattatggccttctaaatcaagaaaaactaaattattaaatcgtaaagctgatgcaatttctaaagcaaaagttgctaaaactgtcgcaaaagttcgtaaagtcgtccttatttctagggttttattggcttttaaacaggcaaagacgactacgataagagcgattgaaattcaataa

SEQ ID NO: 107924 - protein, 917 aa, Glomus mosseae
MSSKKREIDHEITVSSSTSRDVEKKPAEIIEHKHVEMQEDISAELEALLQTDPATGLTTAEAQKRLIDFGKNELAGSKTNPILKFLSFFTGAIAYLIEVACLFAVIVKHWIDFSIILALLFVNAFIGFIEEARAESALDALKQTLALKAKVWRDAQFVEVDVAELVPGDVISPRLGDIIPADARLLGISVTGGETEGSLQIDQSALTGESLPVEKKKGSTVYSSSIVKQGQMLAVVTKTGSNTFIGRAAHLISITVEQGHFQKIVNSIGNFLILVTVVLVSIIFIYQMVKFRGTEQGKFITVLGNVLVLTIAAIPVGLPTVLSVTMAVGAKQLAAKKVIVKRLTAVEEMASVSVLCSDKTGTLTLNELTFDEPYLCPGYTKDDILLFSYLSAEPGANDPIETAVRFAAETDLEILQSRPNKHEVPGYKVTGFVPFNPNTKMSYATVIDNNTKEVFKVAKGAPQVIIKLVGGNDDAVHAVNSLAARGLRALGIARTVPGDLETFDLVGMITLLDPPRPDSAETIRRCGEYGVEVKMITGDQLIIAKEVAHRLGMNRVILDAGYLVDPEKSDEEVTKNCERADGFAQVIPEHKYRVVELLQKRGLLVGMTGDGVNDAPALKKANVGIAVHGCTDAARSAADIVLLAPGLSTIVDGITASRAIFQRMRSYALYRITSTVHFLMFFFFITLIEDWTMRAILLILIALLNDGATLVISVDNAKISERPDKWRLGQLITLSIVLGTLLTVASFTHFYVARDVFNMSLGEIETIMYLHISSCPHFVIFSTRLSGYFWENLPSPIFTIAVLGTQVFAMFISIYGVLAEPIGWAWGVSIIGISLGYFVVLDFVKVMLFRYWSFELTAKLWPSKSRKTKLLNRKADAISKAKVAKTVAKVRKVVLISRVLLAFKQAKTTTIRAIEIQ

SEQ ID NO: 107925 - DNA, 2829 bp, Glomus mosseae
  CDS (1)..(2829)
atggataaacgaaacatggattctgattctgaaaagtatacagaattttcaaaaactcaagaaaaagaatcaaacgatgaatccgttgaggaagaaactcctttgtcacaaaggaatagtgaagaacataatagcgaccatgaacatatacgaataacggatgatataccaccagaaatacaagaactcttgaatacagatccgaaaactggtttatcaacggaagtggcgcagtctcgtttagaaaaatttggcaagaacgaaattggagaatctaaaacaaatccctttttaaaatttttgtcgtactttaaaggatctatagcgtatctaatcgaattagcgtgtattgtggcagcaatagtacaagattgggttgattttggtataatactcgcgttattatttgtcaatgcaagcattggatttattgaggaatcacgtgctgaatccgctttagacgcgttaaaacaaacattagcgttaaaaacgagagtacgacgtgatggaaaatttgtcgaattaaactcgacagatttagtaccaggcgatatcattgcgttacgtttaggtgatattgtgcctgctgatgctaaattattgggtatcggtgttaatggttcaagaactgaagaaaggttgctagtggaccaatctgctttaacaggtgaaagtttacctttacgctgtcaaaaaggtgatagtgtttattcgagttcaacggttaagcaaggtcaaatgttggcgatggtttttaaaaccggagctgatacctacattggtcgtactgcttcattgataaacatgacagttgatcaaggtcactttcaaaaagtcataaataagattggtaatttcttgatatggatcaccgctattcttgttaccataatattcgtttatcaagtggtaaaatttcgaaatactccagaaggagatgtgttgaaaatattgcaacacattttagtattaacagttgccgcaataccagcaagtattttcctgatgatgtcattcaatcattttctcataataaagcagttaaaaaaagtgattgtaaaacgattaacttctattgaagaattggcttccgtatctgtactttgttccgacaaaaccggaacaatgacattaaatgaactcaaattcgatgaaccttggttagcttcggggtttacaaagtctgacatacttttgtattcctacctttgctctgaaccgggcgcaaatgatgcgattgaattggctgttatatccgcggcaaaacaaggacttgatattttaaaggatcatgatgatcaagatgatgatgttcctggctataaaattacatcttttatacctttcaatccttcaaaaaaatcatcacaagctaccgtggtaaatttggaaactaatgaaacctttcaaattgccaaaggtgcacctcaagtcattattaaacttgcaggtggaaatgaagaatcatcgcaagccgttaatgatttggccaaaagaggtttacgagcattgggtattgctaaaaccgatcctaaagataataatcgttggaaattgatcggattcattagtttattggatcctccaagaccggataccaaggaaactattgaaaaatgtagaaatcttggggtcaaaattaaaatgattacgggtgatcaaatgattattgctaaagaagtcgcccatagacttggtatgggaagagtcattttagatgcaaatcatctagttgattcaacaaaatcattacaggagatcacggaacattgcgaacgtgctgatggtttcgctcaagtcacacccgaacataaatttaaggtcgtggaattcttacaaaagaaaggttatttagtcgcaatgactggcgatggggttaatgacgctcctgcattaaagaaagccaacgttgggattgctgttcagggatgtaccgacgccgcacgttcagctgctgatatcgtcttgttggctccaggattatcaaccatcgttgacggcatttatacttcgcgtgcaatatttcagcgaatgagatcctatgcattatataggatcacatctactattcattttctactatttttcttcatcatcatcctagctttcgattggacattaccagctgtattattgatcttgatagcaatattgaatgatgcagctactatcgttatatcagttgataatgctcaaatttctttacttcctgataaatggcgtctcggtcaactaatttttttaagtttagtcttgggaactttcttgactggttttagctttgcacatttcttcatttttagagatgttatcggagttactccagaacaattacatactgtaatgtatttacatatttcaagtgcaccacattttttaatatttgcaacaagattaccgggacatttctgggaaaatattccttcaccattgtttgttacatcaatcattggtacacaaatttttgcattattgatttcggtatttggatggttatcttcatccattaatttgttaatggctgtaataattcttttggtatctttgggaatattatctttctcgattttattaaagtgcatgatatttaaaaattggtcgtttgaattaacggcaaggttatgtcctacttcaaaacgaagaactaaattagccgaaagaaaagaacaacatgcaaagaataaaagagttaatgaaaacttttctagattaaaaaaagtgttgattatgatgagagttattaaaaattttcgggaagcaccagatgaaaagaaaacggagtccagggatgatcaagaaaataatgatggtgatattaatagtgtttag

SEQ ID NO: 107926 - protein, 942 aa, Glomus mosseae
MDKRNMDSDSEKYTEFSKTQEKESNDESVEEETPLSQRNSEEHNSDHEHIRITDDIPPEIQELLNTDPKTGLSTEVAQSRLEKFGKNEIGESKTNPFLKFLSYFKGSIAYLIELACIVAAIVQDWVDFGIILALLFVNASIGFIEESRAESALDALKQTLALKTRVRRDGKFVELNSTDLVPGDIIALRLGDIVPADAKLLGIGVNGSRTEERLLVDQSALTGESLPLRCQKGDSVYSSSTVKQGQMLAMVFKTGADTYIGRTASLINMTVDQGHFQKVINKIGNFLIWITAILVTIIFVYQVVKFRNTPEGDVLKILQHILVLTVAAIPASIFLMMSFNHFLIIKQLKKVIVKRLTSIEELASVSVLCSDKTGTMTLNELKFDEPWLASGFTKSDILLYSYLCSEPGANDAIELAVISAAKQGLDILKDHDDQDDDVPGYKITSFIPFNPSKKSSQATVVNLETNETFQIAKGAPQVIIKLAGGNEESSQAVNDLAKRGLRALGIAKTDPKDNNRWKLIGFISLLDPPRPDTKETIEKCRNLGVKIKMITGDQMIIAKEVAHRLGMGRVILDANHLVDSTKSLQEITEHCERADGFAQVTPEHKFKVVEFLQKKGYLVAMTGDGVNDAPALKKANVGIAVQGCTDAARSAADIVLLAPGLSTIVDGIYTSRAIFQRMRSYALYRITSTIHFLLFFFIIILAFDWTLPAVLLILIAILNDAATIVISVDNAQISLLPDKWRLGQLIFLSLVLGTFLTGFSFAHFFIFRDVIGVTPEQLHTVMYLHISSAPHFLIFATRLPGHFWENIPSPLFVTSIIGTQIFALLISVFGWLSSSINLLMAVIILLVSLGILSFSILLKCMIFKNWSFELTARLCPTSKRRTKLAERKEQHAKNKRVNENFSRLKKVLIMMRVIKNFREAPDEKKTESRDDQENNDGDINSV

SEQ ID NO: 107927 - DNA, 3703 bp, Xenopus laevis
  CDS (177)..(3167)
gggctctgagttgtccctttctcctgctgagggaccaggagatgaactgttgagccacggctccagaagcaaaaagctcagctgcagacaaggggggatctgcccatcgtggggggacaaggagaactttgttaaacttacggacaacgtgagcccaggggggctgagaggcaaggatggagaacgcacacgccaagaccaccgaggaatgtctggcctattttggggtcaacgagaacactggcctgtcgcctgaaattgtcaagaagaacttcgagaagtatggacccaatgaacttccagctgaggaaggaaagtccatatgggaactggtggcagaacagtttgaagatttactggtcaggattctgttgttggccgcctgtatatcattcgtactggcctggtttgaagaaggtgaagagaccgtcacagcgtttgttgaaccattcgtcattctccttatcctcattgccaatgcagttgtcggcgtctggcaggaaagaaatgcagaagatgccattgaggccctcaaagaatatgaacctgagatgggcaaggtgtaccgtagtgacagaaagtctgtgcagagaatcaaggccagagaaattgtgccaggagacattgtggaagtagctgttggtgacaaagtcccagcagatatcagacttatcagcattaagtctaccaccctccgtattgaccagtccatcctcacaggagagtctgtttccgtcatcaagcacacagaagttgtccctgaccccagagctgtcaaccaggataagaagaacatgctgttctctggtaccaatgttggagctggcaaggctattggtgttgtcattgccacagggcccaacacagaaattggcaagatccgcgatgaaatggctgcaacagagcaagataagacccccctgcagcagaaactggacgagtttggagagcagttgtccaaagttatctctctcatctgcgttgctgtgtggttgatcaacattggacacttcaatgaccccatccacggtggctcttggataaagggcgccgtttactactttaagattgctgtggccttggctgtggctgctattcctgagggtctcccagctgtaatcaccacttgtctggctctgggtacaagacgtatggccaagaagaatgctattgtgaggagtttaccctctgtagaaaccttgggttgcacatctgtcatctgctcagacaagactggcaccttgaccaccaaccagatgtctgtctgcagaatgttcgtgcttgacaaagttgatggtgacatctgctccttaaatgagttctccatcacaggatccacctacgcccctgagggagaagttctgaagaatgataagactgtgaaagctggccagtatgatgggctggttgaattggccacaatctgtgcactttgcaatgactcttctcttgactttaatgagtccaaaggagtctttgagaaggttggagaagccactgagactgcactgacaactcttgttgagaaaatgaatgtgtttaacacagacgtgaggagcctgtccaaggtggagcgtgccaatgcctgcaactctgtgatcaagcaactgatgaagaaagagttcaccatggaattctcccgtgacagaaagtcaatgtctgtctactgcaccccagccaaagcttcccgagctgccgttggcaacaagatgtttgttaagggtgccccagagggtgttatcgacaggtgcaactacgtacgtgtgggcaccacccgtgttccacttacttcagctatcaaggatacgattttgactgtgatcaaggaatggggaacaggcagagacaccctgcgttgtcttgctctggctacaagggacaccccacccaagagggaagacatggtgcttgaggactccaccaagtttgttgactatgagactgatcttacctttgttggttgtgtgggtatgttggacccccctcgtaaagaagttatgggctcaatcaagctctgccgtgaggctggtatccgtgtcattatgattactggtgataacaaaggcacagctattgccatctgccgtcgtattggcatctttggtgaaaatgatgatgtgtctagacttgccttcactggacgtgagtttgatgacctccccccagcagaacaaagagaggcctgcaagcgtgcttcttgctttgccagagtcgagccctcacacaagtccaagatcgtagagttcctgcaatcctttgatgagatcacagctatgactggtgatggtgtgaatgatgccccagctctgaaaaaggctgagattggtattgctatgggctctggtactgctgtggccaagacagcctctgagatggtgttggccgatgacaacttctccacaattgtggctgcagtagaagaaggccgtgccatctacaacaacatgaagcagtttatccgctacctcatctcctccaatgtaggagaggttgtctgtatcttcttgactgctgctctgggtcttcctgaagctctgatccctgtgcaactgctgtgggtcaacttggtcacagatggtctgccagccacagccctgggctttaaccccccagatctggacatcatggacagggcacctcgtagccccaaggaaccccttatcagtggatggcttttcttccgttacttggccattggagcttatgtgggtgctgccactgttggagcagctgcctggtggttcatgtatgccgatgatggacctgaagttactttctaccagctgagccatttcatgcaatgcactgaggaaaatgttgagtttgagggtctggaatgcgaaatctttgagtctcctgtacccatgaccatggctctctctgtgctggtcaccattgaaatgtgcaatgccctcaacagtctgtcagagaaccagtctctgatcaggatgcccccatgggtgaacttctggctgttgggctctatttgcttgtccatgtccctccacttccttatcctctatgttgatccacttcccatgatcttcaagttgactcctctggacctcactaagtggcttgttgtcctgaagatttccatccctgtcatcctactggatgaacttttgaaatttgttgcccggaactacctggaagaaaaaaagtaaagtaaagggaactcaacgttgtactgattacaaaaaatcagatctcagcccaaatcctcatttttatttttctttcccccaaccaacaactcatcttcttcttcttcttcatcactgccaaacctttcccccaaaccccttctccagagtcttccaacttggggttctctaaacctggtcccgagggtgatggaattcatgggctgttgttctgtagccaagtgccttaatcttccatacatgaccctttttataaagcgacccccccataaccacaccaatatactgtacatatagaaccggtctccccaatccggacatcccagagctaaattctagtcgaactcggcgagagagaagaacacacggtcggtgttgtgtaaagtgcagtgtcacgttgttgattcctctccagccccgcgagggacttgtcgcttgtagcagagatacggacacgagaaaactacgaggaatctcttatagctatttattgaaattaaagaataatttaaactctgaaaaaaaaaaaaaaaaaa

SEQ ID NO: 107928 - protein, 996 aa, Xenopus laevis
MENAHAKTTEECLAYFGVNENTGLSPEIVKKNFEKYGPNELPAEEGKSIWELVAEQFEDLLVRILLLAACISFVLAWFEEGEETVTAFVEPFVILLILIANAVVGVWQERNAEDAIEALKEYEPEMGKVYRSDRKSVQRIKAREIVPGDIVEVAVGDKVPADIRLISIKSTTLRIDQSILTGESVSVIKHTEVVPDPRAVNQDKKNMLFSGTNVGAGKAIGVVIATGPNTEIGKIRDEMAATEQDKTPLQQKLDEFGEQLSKVISLICVAVWLINIGHFNDPIHGGSWIKGAVYYFKIAVALAVAAIPEGLPAVITTCLALGTRRMAKKNAIVRSLPSVETLGCTSVICSDKTGTLTTNQMSVCRMFVLDKVDGDICSLNEFSITGSTYAPEGEVLKNDKTVKAGQYDGLVELATICALCNDSSLDFNESKGVFEKVGEATETALTTLVEKMNVFNTDVRSLSKVERANACNSVIKQLMKKEFTMEFSRDRKSMSVYCTPAKASRAAVGNKMFVKGAPEGVIDRCNYVRVGTTRVPLTSAIKDTILTVIKEWGTGRDTLRCLALATRDTPPKREDMVLEDSTKFVDYETDLTFVGCVGMLDPPRKEVMGSIKLCREAGIRVIMITGDNKGTAIAICRRIGIFGENDDVSRLAFTGREFDDLPPAEQREACKRASCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRAPRSPKEPLISGWLFFRYLAIGAYVGAATVGAAAWWFMYADDGPEVTFYQLSHFMQCTEENVEFEGLECEIFESPVPMTMALSVLVTIEMCNALNSLSENQSLIRMPPWVNFWLLGSICLSMSLHFLILYVDPLPMIFKLTPLDLTKWLVVLKISIPVILLDELLKFVARNYLEEKK

SEQ ID NO: 107929 - DNA, 3353 bp, Xenopus laevis
  CDS (177)..(3254)
ctccctaagcacagagctgaatccgcttcatcctcagctgcctctctcctcctcctctcttctctagtcccctctttctttctgtctctcttccccttctttttggggctctggtgaccccccatttcccctgcaaaggattccggccacatcttgtccttgcctgagaaagagccatggggtacggacggtcagacagttaccgcgtagccaccacgcaggacaataaagatgaaaaatcccctaagaagggtaagggggtaccaaagaaagaaatggatgatctcaagaaagaggtggccatgacagagcacaaaatgtcagttgaagaagtatgcagaaaatacaatacagactgtgtgcaggggcttacactcagcaaagcagcagagattctggaacgtgatggacctaatgccctcacccctcctcccacaacccctgagtggataaagttttgccgccagttatttggagggttctccattctactgtggatcggggctattctctgcttcttggcttacagcatccagaagggtgtggaggatgatcctgcaggcgacaatctgtatctgggtatcgttttggcagctgtcgtgatcatcactggctgcttctcttattaccaagaagccaagagttccaaaatcatggagtctttcaaaaacatggtgccccagcaagcgctgattatccgcgagggggagaagatgcaggtaaatgccgaagaagtggttgttggggatcttgtggaaatcaaaggtggcgacagagtaccagctgatcttaggatcatctcatctcatggctgcaaagtagataactcctcactgactggtgaatctgagcctcagacacggtcacctgactgcacacatgataatccactcgaaacacgaaatgtcaccttcttctccaccaactgcgttgaaggtactgcccgtggagtagttgtcgctacaggggacaggacagtaatgggacgtattgctaccctggcttctggtctagaagtggggaagacccccatagccaaagagattgaacacttcatccacttgatcactggtgtggccgtattcctaggaataagcttcttcatcctctctctggtcctgggttactcttggctggaggccgtcatcttccttattggcatcattgtcgctaatgtgccagagggactgctggccactgtcactgtgtgtctgacactcactgccaaacgtatggcccgaaaaaattgtctggtcaagaacctggaggccgtagagaccctgggatccacctcaaccatctgttctgataagactggcaccctgacacagaaccgtatgactgtggcacacatgtggttcgataaccagatccatgaagctgacacaacagaggaccagtcaggagcatcatttgataaaagttcccaaacctggttggccttggctcaaattgctgctctctgcaatcgtgctgtcttcaaagctgggaatgataacatccctgtactgaagagggacgtggcaggtgatgcatcagagtctgctctcctaaagtgcattgagttgtcttgtgggtctgtgaaggcgataagagagaagaacaagaaggtggccgagattcccttcaactccaccaacaagtatcagctctccatccacgagacagaagaccccaatgataaccgctacttgcttgtgatgaagggagccccagagaggattctggatgtctgctctaccatcctaatccagggcaaagaacagccattggatgatgagcttaaagaggctttccaaaatgcttacctggagcttggtggactgggagagagagtacttggtttttgccacttttacttcccagaggagctctatcccaaaggctttgcttttgacacagaggaccagaacttcagcactgagaacatgtgttttgtggggcttatgtctatgattgaccctcccagggcagcagtgcctgatgctgttggcaaatgcagaagtgcaggtatcaaggttatcatggtaacaggtgatcatccaattacagccaaagctattgccaaaggagtgggaattatctcagagggaaacgagacagtggaggatatagcagccagactcaatattcccgtcagccaagtcaaccccagagatgccaaggcctgtgtcattcatggtaccgatctgaaggacatgcctgctgagaagatagatgagatccttcagaaccacaccgagattgtctttgcccgaacatctccccagcagaaactcattattgtggaaggatgccagcgtcagggtgctatagtggctgtgacaggggatggtgtgaatgactcacctgccctaaagaaggctgacattggggtagctatgggtattgcaggttcagatgtctcaaagcaggcagctgacatgatcctgctggatgataactttgcctccattgttactggtgtggaagaaggccgccttatctttgacaacttaaagaaatccatagcatacaccctgactagtaacattcctgaaatcactcccttcctgctcttcattatggccaatattccactgccactgggcaccatcaccatcctgtgcattgacttgggaactgacatggttcctgccatctccttggcatacgaagctgcagagagcgacatcatgaagcgccagccaagaaatcctcgcacagacaaactagtgaatgaaagattaatcagcatggcatatgggcagattggtatgattcaagctttgggtggcttcttcgcctactttgtaatcttggcagaaaatggcttcctcccatctcacttggttgggatccggttaacatgggatgaccgatcagtaaatgatctggaagatagctatggacagcagtggacatacgagcagaggaaaattgtggaattcacatgtcacacagctttctttgtcagtattgtggttgtacaatgggcagacgtcatcatctgtaaaaccaggaggaactctgtattccagcagggaatgaagaacaaaatcctcatctttggtctgtttgaagaaacagcattggctgcattcttgtcctactgccctggaatggacattgcactgagaatgtacccgctaaagcccagctggtggttctgtgccttcccatacagcttcctcatctttatatatgatgaaatccgaaaacttatccttaggagacacccaggaggctgggtagaaaaagagtcttattattaaattcacagagaagcaccttccaaacctggaccctatacgacctccaaatccctcccaccctactccacaaaagaagaaaaatacaaaaaaaaaaaaaaa

SEQ ID NO: 107930 - protein, 1025 aa, Xenopus laevis
MGYGRSDSYRVATTQDNKDEKSPKKGKGVPKKEMDDLKKEVAMTEHKMSVEEVCRKYNTDCVQGLTLSKAAEILERDGPNALTPPPTTPEWIKFCRQLFGGFSILLWIGAILCFLAYSIQKGVEDDPAGDNLYLGIVLAAVVIITGCFSYYQEAKSSKIMESFKNMVPQQALIIREGEKMQVNAEEVVVGDLVEIKGGDRVPADLRIISSHGCKVDNSSLTGESEPQTRSPDCTHDNPLETRNVTFFSTNCVEGTARGVVVATGDRTVMGRIATLASGLEVGKTPIAKEIEHFIHLITGVAVFLGISFFILSLVLGYSWLEAVIFLIGIIVANVPEGLLATVTVCLTLTAKRMARKNCLVKNLEAVETLGSTSTICSDKTGTLTQNRMTVAHMWFDNQIHEADTTEDQSGASFDKSSQTWLALAQIAALCNRAVFKAGNDNIPVLKRDVAGDASESALLKCIELSCGSVKAIREKNKKVAEIPFNSTNKYQLSIHETEDPNDNRYLLVMKGAPERILDVCSTILIQGKEQPLDDELKEAFQNAYLELGGLGERVLGFCHFYFPEELYPKGFAFDTEDQNFSTENMCFVGLMSMIDPPRAAVPDAVGKCRSAGIKVIMVTGDHPITAKAIAKGVGIISEGNETVEDIAARLNIPVSQVNPRDAKACVIHGTDLKDMPAEKIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFAYFVILAENGFLPSHLVGIRLTWDDRSVNDLEDSYGQQWTYEQRKIVEFTCHTAFFVSIVVVQWADVIICKTRRNSVFQQGMKNKILIFGLFEETALAAFLSYCPGMDIALRMYPLKPSWWFCAFPYSFLIFIYDEIRKLILRRHPGGWVEKESYY

SEQ ID NO: 107931 - DNA, 2727 bp, Bacillus cereus
  CDS (1)..(2727)
atgacagaggaggaactaccgatgtttaatttacaaagacaagaaacaaagcatgcttatgagcaagatagcatgaaaacaaataacgaattattagtggaggttgcaacacaagatgtaagctctgcgttaaaacttttagaaacaacacaagatggattatctaaacaagaagcgtctcgtagactttctttatatggtccgaacgaaatagctcataataaaatggcaccgtggtacattcaatttctgtcggcatttaaaaatccatttattttcgttttattagctcttggagcactctcctttttcacggatgatatgcaaggaacaattgtcgtatctgcaatggtactacttagtgcaacaattcggttttcccaagaatttcgttctcaaaaagctgccgataatttaaaagctatggttcgaacaactgcaagcgtatttagaataaatggatttgtacatgaaacaaaaaatgtaacgaatttaaatcgaaattacacaacagaaattccaattgaggaacttgtacctggcgatatcatttccctttcagccggtgatatcattccagctgatgtgcgtattgtatccgctaaagatttatttgttaatcaatcttctttaacaggggaagcacttcctgtagaaaaatacgaacactgctaccatacagaaaataagcatatcttaccgacaaacatgaaaaaaaattacaatccactcgatatggaaaacctttgtttcatgggaacaaatattgtaagtggtagcgcaaaagctgttgtcatctcaacaagtaccgatacgtatttcggctctttagccaataaggtaattggaaagcgtgtagaaacaaactttgataaaggtgtaaacaaagtaagctggctcttaattacattcatgcttattatggtacctattgttcttctcattaatggattcacaaaaggtgattggcaagaagctttcttcttcgctattgccgtcgctgttggccttacacctgaaatgttaccaatgattgtaactgctaatttagctaaaggtgccgttaaaatgtctaaacaaaaagtaattgtaaaacagctaaattctattcaaaacttaggtgctatgaacattctttgtacagataaaaccggaactttaacagaagataacgttgtccttgttcgtcacttagatcccaagggaaatgaatgcaatcgcgtcttgcaatttgcctatttaaatagtttctatcaaactggattgaaaaatttaatagataaagctgttattaagcatacagaggaaaacaatacatttaatccatcagcttttcaaaagctagatgaaattccattcgatttcgcccgccggcgtatgtcagtcatcgtaaaggatatttcaggtgaacatacaatggtttgtaaaggtgccgtagaagaaattttatcaatttgtaactacactgaagtggatgaaaaaatcgttccactcaccgaggaaatacgttcaaatgtcaaaaaaataagtgagacactaaatagtgaaggtatgcgggttattgctgtggcttataaaaaagatagaagaataaatgatacagagtacacagtaaaagacgaaactgatatgattctcgctggatatatcggctttttagatccaccgaaaccatctgcagcagctgcaattcaagcattacagaaacatggtgtacaagtgaaaattttaactggcgataacgaaattgttacaagaaaggtttgtaaagaagttggattagatatctgcgaaccaatcctcggttacgagattgattctttaccagataaagcattagcaagacttgccgaagaaacgactgtatttgcgaagcttaatcccatgcaaaaatctcgtattatacacgcattacaaggaaatggacacactgtaggttacatgggagacggcattaacgatgctgtagcattacgtgaagctgatgtcggaatatctgttgatactgctactgatattgcgaaagaagcttccgatattattctacttgaaaaaagtttaactatattagaagcagggattttagaaggacgtactacattcggaaatattttaaaatatattaagatgacagctagctctaacttcggtaatgtgtttagcgtgttagtagcaagtgctttcattccttttttaccgatgcttgccattcatcttttaattcaaaacttactttatgatatttcacaactttctattccatgggacaaaatggataaagagtttctagaaaaaccacgaaaatgggatactgcaaacttacgaaacttcattatttgtatcggcccaattagttctatatttgatattatcacatacgtagtcatgtggaatgtatttggtgcaaatacaccgagcgagcaatcattattccagtccggttggtttgtcgttgggttgttaacacaaactttaattgttcacatgataagaacacaaaagattccatttattcaaagtactgcatcaacaccagtcgttttattaaccgctcttattatggcaatcgggatttatattccattctcaccacttggtgcagccgttggtttacaagcattgccacttaactatttcccttggttagtaggaatactattaggctacgcttttttaacacaattcctgaaaaagctttatattaaaaagtttcatagctggttgtaa

SEQ ID NO: 107932 - protein, 908 aa, Bacillus cereus
MTEEELPMFNLQRQETKHAYEQDSMKTNNELLVEVATQDVSSALKLLETTQDGLSKQEASRRLSLYGPNEIAHNKMAPWYIQFLSAFKNPFIFVLLALGALSFFTDDMQGTIVVSAMVLLSATIRFSQEFRSQKAADNLKAMVRTTASVFRINGFVHETKNVTNLNRNYTTEIPIEELVPGDIISLSAGDIIPADVRIVSAKDLFVNQSSLTGEALPVEKYEHCYHTENKHILPTNMKKNYNPLDMENLCFMGTNIVSGSAKAVVISTSTDTYFGSLANKVIGKRVETNFDKGVNKVSWLLITFMLIMVPIVLLINGFTKGDWQEAFFFAIAVAVGLTPEMLPMIVTANLAKGAVKMSKQKVIVKQLNSIQNLGAMNILCTDKTGTLTEDNVVLVRHLDPKGNECNRVLQFAYLNSFYQTGLKNLIDKAVIKHTEENNTFNPSAFQKLDEIPFDFARRRMSVIVKDISGEHTMVCKGAVEEILSICNYTEVDEKIVPLTEEIRSNVKKISETLNSEGMRVIAVAYKKDRRINDTEYTVKDETDMILAGYIGFLDPPKPSAAAAIQALQKHGVQVKILTGDNEIVTRKVCKEVGLDICEPILGYEIDSLPDKALARLAEETTVFAKLNPMQKSRIIHALQGNGHTVGYMGDGINDAVALREADVGISVDTATDIAKEASDIILLEKSLTILEAGILEGRTTFGNILKYIKMTASSNFGNVFSVLVASAFIPFLPMLAIHLLIQNLLYDISQLSIPWDKMDKEFLEKPRKWDTANLRNFIICIGPISSIFDIITYVVMWNVFGANTPSEQSLFQSGWFVVGLLTQTLIVHMIRTQKIPFIQSTASTPVVLLTALIMAIGIYIPFSPLGAAVGLQALPLNYFPWLVGILLGYAFLTQFLKKLYIKKFHSWL

SEQ ID NO: 107933 - DNA, 2667 bp, Bacillus cereus
  CDS (1)..(2667)
atgagcaattggtacagtaagacgaaagatcaaacattgattgacctagaaacaaacgaacaaaacggtttaacagatgagattgtaagtgaacgtttaaagcaatacggttctaatgaattagctacaaaacaaaaacgcactttatggcagcgtattttcgcccaaattaatgacgtcctcgtatatgtccttattattgctgcccttatttctgcctttgtaggtgaatgggcggatgccagtattatcgcgcttgttgtagttttaaatgctgttatcggtgttgtccaagaatcgaaagcagaacaagctttagaggcattgaaaaagatggcaacacctaaagctatcgtcaagagaaatggtgaactaaaagaaattccatctgagcacgtcgttccaggggatatcgttatgctcgacgccggacgatatatcccatgcgatttacgccttattgaaaccgcaaatttaaaagttgaagaatctgctctaactggtgaatctgtccctgttgataaagatgcaatctaccacccttctatgcgaagtgatgagcaagtaccactcggcgatcaaaaaaacatggcctttatgtctactcttgtcacatatggaagaggcgtcggtgttgctgttgaaactggaatgaactcacaaattggtaagattgctacccttttacatgaagcagacgatgatatgacaccacttcaaaaaagcttagcacaagtcggaaaatatttaggctttgttgctgtagctatttgtatcgttatgtttctcatcggttttttacaaggccgggatacgttagaaatgtttatgactgctattagtttagctgtcgcagctattccagaaggcttgccagctatcgtttccatcgttcttgcaattggtgtgcaacgtatgattaaacaaaacgttatcattcggaaactaccagctgttgaagccctcggttctgtcacaattatttgttcagataaaacaggtacgttaacgcaaaataaaatgaccgttactcacttttatagtgataacacatatgatcgcttagaaagtttaaatgtaaataatgatgcgcaacgtctattgttagaaaatatggtgctatgtaatgatgcgtcttacaataacgaatcacaaacgggagacccgactgaaattgcacttctcgttgctggaaccacttttaacatgcaaaaagatcatttagaaaaaatacatgaacgtgttaacgaagtaccttttgattcagatcgtaaaatgatgtcaaccgtacatatgtacaatgaaagttactatagcatgacgaaaggcgctattgataagctcttacctcgatgtacccatatttttaaaaacggcaaaatcgagattttaactgattctgataaaaatcaaatattagaagctgccggatcaatgtctcaagaagctttaagagtactttcattcgcatttaaacaatacgattcaaacgatgtggatataaatcatcttgaagaaaatcttatctttattggtcttgtcggtatgattgatccaccacgaactgaagtgaaagattcaattaaagaatgtaaaaaagccggtattcgcacagttatgattactggtgaccataaagataccgcctttgcaattgccaaagaacttggcattgctgaagaaatatcggaaattatgattggaactgaattagataacgtttctgatacagaactagctagcaaaattaatcatttaaatgtattcgctagagtctctcctgagcataaagtgaaaattgtaaaggcattacgcgcgaaaggaaatatcgtttctatgactggtgacggtgtcaatgatgcaccatctttaaagcaagctgatgttggcgtagcgatgggcattacaggaacagacgttgcaaaaggggcagcagatgtcgtgttaacagatgataatttctcatctatcgtgaaagccgttgaagaaggtagaaatatttatcgcaacataaaaaaatcaattctcttcctactctcttgtaacttcggagaaattatcgctttatttttagccattttactcggctgggcaacaccactacgacctattcacattttgtgggtgaatttaattacagatacactgcctgcattatcacttggggttgatcctgaagacccagatgtgatgaaggaaaaaccacgacatgcaaaagaaagcttatttagcggcagcgttcctttcctgattttcaatggagttatcattggacttttaacgctaatagcttttatcgccggagcaaaattctatactggagatacaaatttatttcctcttttcccagagcgaattgatgacgatgctctattacacgctcaaacgatggcatttgtcgttcttagtttttctcagctcgttcattcatttaacttgcgttcaagaacgaaatcgattttttcaattgggatctttacaaataaatatttagtcttctccctccttatcggtgttcttatgcaagtttgtatcatctccatcccgccccttgcaaatatattcggtgtacatgcattaacgatgcgagattggggatttgttctcttattaagtatcattccgcttgttgtgaatgaaatcattaaattagtgaagaaaaactaa

SEQ ID NO: 107934 - protein, 888 aa, Bacillus cereus
MSNWYSKTKDQTLIDLETNEQNGLTDEIVSERLKQYGSNELATKQKRTLWQRIFAQINDVLVYVLIIAALISAFVGEWADASIIALVVVLNAVIGVVQESKAEQALEALKKMATPKAIVKRNGELKEIPSEHVVPGDIVMLDAGRYIPCDLRLIETANLKVEESALTGESVPVDKDAIYHPSMRSDEQVPLGDQKNMAFMSTLVTYGRGVGVAVETGMNSQIGKIATLLHEADDDMTPLQKSLAQVGKYLGFVAVAICIVMFLIGFLQGRDTLEMFMTAISLAVAAIPEGLPAIVSIVLAIGVQRMIKQNVIIRKLPAVEALGSVTIICSDKTGTLTQNKMTVTHFYSDNTYDRLESLNVNNDAQRLLLENMVLCNDASYNNESQTGDPTEIALLVAGTTFNMQKDHLEKIHERVNEVPFDSDRKMMSTVHMYNESYYSMTKGAIDKLLPRCTHIFKNGKIEILTDSDKNQILEAAGSMSQEALRVLSFAFKQYDSNDVDINHLEENLIFIGLVGMIDPPRTEVKDSIKECKKAGIRTVMITGDHKDTAFAIAKELGIAEEISEIMIGTELDNVSDTELASKINHLNVFARVSPEHKVKIVKALRAKGNIVSMTGDGVNDAPSLKQADVGVAMGITGTDVAKGAADVVLTDDNFSSIVKAVEEGRNIYRNIKKSILFLLSCNFGEIIALFLAILLGWATPLRPIHILWVNLITDTLPALSLGVDPEDPDVMKEKPRHAKESLFSGSVPFLIFNGVIIGLLTLIAFIAGAKFYTGDTNLFPLFPERIDDDALLHAQTMAFVVLSFSQLVHSFNLRSRTKSIFSIGIFTNKYLVFSLLIGVLMQVCIISIPPLANIFGVHALTMRDWGFVLLLSIIPLVVNEIIKLVKKN

SEQ ID NO: 107935 - DNA, 2739 bp, Nitrosomonas europaea
  CDS (1)..(2739)
atgacagatcaccgcgtcactgaccacactgaaaccttacagcagacagcatggcatgcgctgactctgccggaagtcaggcagatcctgcacaccgactcggccggtctgaaaacggacgaggtcaacgatcgctttgcccggttcggaccgaatagtctgatcccgcccaaacgccgcggaccactgctgcgcctgctgctgcaattccacaatgtcctgctgtatatcatgattgccgcagccgccattacggctgtactgggtcactgggtggatacaggcgtcctgctggcagccgtgatcatcaatgtcatcatcggtttcatccaggaaggcaaagcagaaacggcactcgattccatccgtgccatgctgtcaccacatgcgacggtcatccgagacggtactcgctatgagatcgatgcggccggactggtacccggcgatctggttctgctcgcttccggtgatcgggtgccggcggacatacgcctgatttcagtcaaagaactgcaggtcgaagaagctgcactgaccggcgaatcgctaccagtcagaaaacgaatcgagacagcactgccggacacgttacccggggatcgctacggcatggctttttccggcacactggtcgtttacggtcaggccagcgggatcgtcgtggcaaccggcagcgcaactgaactgggcaaaatcaatcgattgctggaagatactcagcatctgtccaccccattattacgccagatcgatcacttcggattcaaactggctgttttcatactggccgcttctgctgcgacttttctgttgggaaccctgtggcgtaaccatgcgccggcagaaatgttcatgatggcggtagctttgattgcttccgcaataccggaaggattaccggccatcatgacagtaacgctggcactgggtgtccagcgcatggcacggcgcaatgccattatccgaagactgcctgcagtcgaggcactgggatcagtgacagtcatctgctctgacaagaccgggacactgacgcgcaatgaaatgacagtgcagcggatcgtctgtgccgatcatacgatcgatgtcagcggagtcggttatgtaccgacaggtgaatacagtatcgatggacataccatcgaccctgcccattatccggcacttaccctggcgattcgttccggcgtgctgtgcaacgatgccttgttacgggaaaaggatggcctctggagcgtggaaggagatcccaccgaaggagctctgctgattctgggcgcaaagaacggtttttccaatcatcatgccaatacagcctggccgcgacgggacgtcatcccgttcgaatcccagcattccttcatggcaacgtaccaccatgacaatgagaatgaaccctggattttcgtcaaaggtgcgccagaacgcattctggatatgtgtaccacccagttgcagcagaatggtaaacagccgattgatatcgactactggcaacggatggtaagcgccacggctgctaaaggattacgcctgctggcactggcctgcaaacgatcagccccgcaggaagacagcctgaaaatcaatgatatgaaaacgggtttcactttacttgcgctggttggcatcatcgatcccccgcgtgaagaagccgttcaggccgtggccgaatgtcatcgggcaggtatacgggtcaaaatgattaccggggatcatgcagaaactgcccgtgctgtcggagcacaactggccatcggagccggcagaccggtactcaccgggatggaaatcgctgccatggatgatgataccttgcgtgacatcgtcatggatgtcgatatctttgcccgaaccagccctgaacacaaactgcgcctggtaaaagccctacaggccggtggtcaggtggtagcgatgaccggagatggagtgaacgacgcaccggcactcaaacgtgccgatgtcggtgtagccatgggaatgaaaggtactgaagccgccaaggaagcatccgacatggtactggccgatgacaactttgccaccatcgcttacgcagtacgcgaaggccgggttgtttacgacaatctaaaaaaattcatcctgttcatgctgcccaccaatggtggtgaagcgctcgtcatcatagccgccattctgtttgaattcaccctaccactcacaccggcacaggtgttgtggatcaatatggtgacagtcagtaccctagggctggcactggcttttgagccggcagaacgtaacatcatgaatcaccgcccaaggtcaccaaaagaagcgctactgtccggcttttttgtctggcgggttctgatggtatctgtattgatgatgattggcggactgggtctttttctgtgggagcagcacatcggggtcagcacggaaacagcccgcacgatggcagtcaatgccatcgtgatgtccgagatgttctatctgatcaatagtcgccatacctttgcatcagtccttcatctcgaagggctgaccggtaatcgttatgtcctgctggcgattgttgcctgcctgctgctgcagattacctatactcatctgcctaccatgcagtccatattcaattcgaccgatttgacgatgctgcaatggtgcaaatctatcgctgccggattgatggtgttttgtgtcatcgagattgagaaatcagtcatccggcatacccgccttgcttcagtcgtgacatcggcctga

SEQ ID NO: 107936 - protein, 912 aa, Nitrosomonas europaea
MTDHRVTDHTETLQQTAWHALTLPEVRQILHTDSAGLKTDEVNDRFARFGPNSLIPPKRRGPLLRLLLQFHNVLLYIMIAAAAITAVLGHWVDTGVLLAAVIINVIIGFIQEGKAETALDSIRAMLSPHATVIRDGTRYEIDAAGLVPGDLVLLASGDRVPADIRLISVKELQVEEAALTGESLPVRKRIETALPDTLPGDRYGMAFSGTLVVYGQASGIVVATGSATELGKINRLLEDTQHLSTPLLRQIDHFGFKLAVFILAASAATFLLGTLWRNHAPAEMFMMAVALIASAIPEGLPAIMTVTLALGVQRMARRNAIIRRLPAVEALGSVTVICSDKTGTLTRNEMTVQRIVCADHTIDVSGVGYVPTGEYSIDGHTIDPAHYPALTLAIRSGVLCNDALLREKDGLWSVEGDPTEGALLILGAKNGFSNHHANTAWPRRDVIPFESQHSFMATYHHDNENEPWIFVKGAPERILDMCTTQLQQNGKQPIDIDYWQRMVSATAAKGLRLLALACKRSAPQEDSLKINDMKTGFTLLALVGIIDPPREEAVQAVAECHRAGIRVKMITGDHAETARAVGAQLAIGAGRPVLTGMEIAAMDDDTLRDIVMDVDIFARTSPEHKLRLVKALQAGGQVVAMTGDGVNDAPALKRADVGVAMGMKGTEAAKEASDMVLADDNFATIAYAVREGRVVYDNLKKFILFMLPTNGGEALVIIAAILFEFTLPLTPAQVLWINMVTVSTLGLALAFEPAERNIMNHRPRSPKEALLSGFFVWRVLMVSVLMMIGGLGLFLWEQHIGVSTETARTMAVNAIVMSEMFYLINSRHTFASVLHLEGLTGNRYVLLAIVACLLLQITYTHLPTMQSIFNSTDLTMLQWCKSIAAGLMVFCVIEIEKSVIRHTRLASVVTSA

SEQ ID NO: 107937 - DNA, 2553 bp, Enterococcus faecalis
  CDS (1)..(2553)
atgaaatggtatcaactttcctcaacaaaagtaatcgagcagactaagacgaagcaaacgggtctttctagcgaagaacgtcagcaacgtttacaaacgaatggtccaaataaaattgaagaaaaacaacaactgaaaacgtggcaaaagctagccaaacattttacagatttactaatggtggtcttactcgctgccgcaattctaaaatttgccacaggcgaagtggtcgaaggaagtatcatttttctagtggtgcttgtcaatggctttgtcggttattggcaagagcgtaaagcagaagaatcattagacggattaaaacagatgatgggccaagaggcagtcgttctaattgatggacaaaaaacaaccgtttcttctgaaacattggttctgggagatgtagtcacgttacaagctggcgatgtagttccagcagatttgcgcttatttgatgttcataatctgatgattgaagaatcaattttgacaggcgaatcagaagccgtggagaaaattaccggttccttgaatgaggaattgccaacaggcgatcaaaagaatttggctttttcaggaactcttgtccaagcgggctcagccttgggcgttgtagtagaaacaggagattccactgaagttggaaaaattaatcacgcgttgcagtcagtagatcaaaaaacaacgccgctcgtgcggaaaatgcaccaattaaacaagcaaattttccaagggattatggtcttgatcgtgtttctgattttctttaccacttttcgtcatggcatggaatggagcctcttattttctgcgatgattgcattaattgtagcaatgattccagaaggcttacctgctgtgttaacgatgattttatcgatgggtgttcatgagatggctagagaaaatgcgattattaaaggcatgccttccgttgaaacattaggctcaatgacagttatctgttcagataaaacaggaacgctaactaaaaatgaaatgacggtaatggatgtagtgactgaagaaatgaccattgtcaaagagattatggccaactgtcaagaattgaaattacaagaccaacaaaaaatcgccgacttgcaggggaatcctaccgagttatctttgctacaatatgttgatcaggatcaactgtctttacgccctgtagaaaagaaaattccgtttagttcaagttataaatacatggccactcgccatccgcaagcagaaggttcaattatttatgtcaaaggtgcgccagaagtattgttacaactttctacgttatctgataatcaaaaaggtgcttggcaagcacaagctgcgcaattagcgcaaaaaggacaacgggtattaggtttcgcttataagacagttacgtcacaacaggaactgacacatgaaacattgtcaggattgacgtttgctggactggcaggcatcatcgatccgccaaaagaaagtgccattcaagccgtcaaagaatctcaagaagcaggtatttccgtcaaaatgattaccggagaccataaagatacagcgcaagccattggcgagcaagttggtttaaagcatacgaaaaaagtccttgaaggattagaaattgatgctatgtcagatgaagaattagctcagcacgttcaaaaagtcgatgtatttgcacgaacgacgccagaacataaattacgaattgtcacggctttacaaaacaatggtgaaattgtcgggatgaccggcgatggcgtgaacgatgcgccagcactaaagaaagctgatgtcggaattgccatgggaattaaaggaagtgaagtaaccaaacaagccgcagatatggttttggcagatgataatttccatacgattgctaaagccgtgaaagaaggacgccgcatttttgataacttgaaaaagacgattaccttcttcttgccaacctctttagcacaaggtttaattgttgtctgggcgcttttaatgaatcatcctctaccgctgacacctgtccagatattatgggtaaacatggtaactacgattactttgtcttatgcattaggttttgaaaaagcgagtgctgataccatgaaacgaccaccaagagatgtcaatgaaggcattttaacaaagtacagtatttttagaatcgtctatgtgtcggtactcattatggtaccaggttacctcatggcgttacaatttgagggccaagccttacagcaaacgttcctcttacaaagtatcgtcttagcgcaagcagcgtatatgatcaactgtcgtaagttggttgatccgtcgttaagcacaggctttttccaaaataaagtgttgtttgcttcattaggaatcctctttttactacaagcgctagtagtttactggccagtagcgcagcaattaattggcacaacttctttaaatggccttcaattagcaatgattttcgtccatgttgtgagtctgtttttccttgttgaaggggaaaaatatataaccaaacgattcatgacgaaagaaagccaaaaaactagcgaatgtcctcgctag

SEQ ID NO: 107938 - protein, 850 aa, Enterococcus faecalis
MKWYQLSSTKVIEQTKTKQTGLSSEERQQRLQTNGPNKIEEKQQLKTWQKLAKHFTDLLMVVLLAAAILKFATGEVVEGSIIFLVVLVNGFVGYWQERKAEESLDGLKQMMGQEAVVLIDGQKTTVSSETLVLGDVVTLQAGDVVPADLRLFDVHNLMIEESILTGESEAVEKITGSLNEELPTGDQKNLAFSGTLVQAGSALGVVVETGDSTEVGKINHALQSVDQKTTPLVRKMHQLNKQIFQGIMVLIVFLIFFTTFRHGMEWSLLFSAMIALIVAMIPEGLPAVLTMILSMGVHEMARENAIIKGMPSVETLGSMTVICSDKTGTLTKNEMTVMDVVTEEMTIVKEIMANCQELKLQDQQKIADLQGNPTELSLLQYVDQDQLSLRPVEKKIPFSSSYKYMATRHPQAEGSIIYVKGAPEVLLQLSTLSDNQKGAWQAQAAQLAQKGQRVLGFAYKTVTSQQELTHETLSGLTFAGLAGIIDPPKESAIQAVKESQEAGISVKMITGDHKDTAQAIGEQVGLKHTKKVLEGLEIDAMSDEELAQHVQKVDVFARTTPEHKLRIVTALQNNGEIVGMTGDGVNDAPALKKADVGIAMGIKGSEVTKQAADMVLADDNFHTIAKAVKEGRRIFDNLKKTITFFLPTSLAQGLIVVWALLMNHPLPLTPVQILWVNMVTTITLSYALGFEKASADTMKRPPRDVNEGILTKYSIFRIVYVSVLIMVPGYLMALQFEGQALQQTFLLQSIVLAQAAYMINCRKLVDPSLSTGFFQNKVLFASLGILFLLQALVVYWPVAQQLIGTTSLNGLQLAMIFVHVVSLFFLVEGEKYITKRFMTKESQKTSECPR

SEQ ID NO: 107939 - DNA, 2706 bp, Enterococcus faecalis
  CDS (1)..(2706)
atgtcagaagaaaagaaaacacaattgtctgaagcgttttacgcacaagacgacacagttgttttggagaaaatgaacacaacaactgatggattaagtgcacaggaggctcaaaagcgtttagaaacgtacggggaaaatgtgctagatgaagggaagaaaaaatcacttgccgtgaaattctttgagcaattcaaagattttatgattattgttttattagcggcagcggtcatttcagccgtcttttcccatgatgtggtagactcgattatcatcttagtggttgttatcttgaatgccatctttggggtcatccaagaagccaaagcggaacaagccattgaagcattaaaagaaatgtcttcaccaaatgctaatgttcgccgtgatggacacgtcattactgttaaaagcgatgaattagtgccaggtgacattgttttattagaagcaggggatgtcgttccagccgatttacgtttattggaagcgaatagcttaaaaattgaagaagcagcgttaaccggtgaatctgttccagttgaaaaagaagtaaccatcttagagggaaccgatattggtatcggtgaccgaatcaatatggcttattccaatagtaatgtgacgtatggacgtggtcttggcgttgtggttggcacaggaatgaatacagaagtcggtaaaattgctggcatgctagcaagcgaacaagaaacggaaacgcctttaaaacaaaacttaaaccaattgggtaaaatgttaacaattgccattttagtcattgcagcggtgatgtttgtggtaggaatgatgaatggtcgttcatggattgacatgttattaacgtcaatttcgttagctgtagcggcaattccagaaggattaccagcgattgtcacgattattttggctttaggtacccaaaaaatggccaagaaaaatgcgattgtccgtaagttaccagccgttgaaacattaggaagtacagacattatctgttcagataaaacaggtacgttaaccttaaatcaaatgaccgttgaagcgttgtatacagatggtcaagttttatctgcttccacagaaatccctgccgataatatggctttaaaaatcatgaactttacgaatgatacaaaaatcgctcaagatggttcattaattggtgacccaacagaaactgccttagtacaatttggtttagatcatgcgtttaacgtaaccgaaaaagtagcagctgaacctcgtgtggcagagattccttttgactctgatcgtaaattaatgactactgttcatgaattaaaaacaggtggcttcctagtttctgtcaaaggtgcaccagatgaattattgaaacgttgtacggaaatcttatcaaatggagaaacaagtccattagatgaaacaaaacgtcaagaaattttgaaaaccaacacctcattagcgaaacaagccttacgtgttttaggaatggcttataaatatgttgagacgattccagccgaaatgagttctgaacttgtggaaaaagatttaacatttgctggtttagtcggtatgattgacccagaaagaaaagaagctgcagatgctgtaaaagtcgcgaaagaagcgggtattcgtccaattatgattacgggtgaccaccgtgatacagcagaagcaattgcggcacgtttaggcatcatcaaagaaggcgacgacgatgcagtcattacaggcgctgaattaaatgaattgtcagatgaaaaattcgcacaagtcgtgggacactactctgtctatgctcgtgtttcaccagaacacaaggttcggattgttaaagcgtggcaacaagaaggaaaagtggttgcgatgactggtgatggcgtaaatgatgccccagccttaaaagctgctgacatcgggattggtatgggaattaccggaacagaagtatcaaaaggtgcttcagatatggtccttgccgatgataacttttcaacaattattgtggcagtagaagaaggacgtaaagtcttctcaaatatccaaaaaacgattcaatatttactttcagctaacttaggggaagtattaaccttgtttattgcaacaatgctcaattgggataccttgttacctgttcacttattgtggattaacttagtaacggatactttcccagcgattgcgttaggtgtggaaccagcagaacgtgatgtgatgagccatgaacctcgtggtaaaaaatcgaacttcttctctggcggcgttttaagcagtgttgtttatcaagggattacgcaaggggcattgactttgattgtgtacaaaatgtcaattatgttcccagcacataccgcagctaacacaaacttatcggcgcaagcgttgtatgatttacaacacggcgatgctttaaccatggccttcgctactttgggattaattcaattgttccatgcctttaatgtgaagtcgatttatcaatcaattttcaaagttggcttattccgcaacaaatcatttaactatgggattcttgtttcgttcttgctattagctgcaacgattgttattccaggatttaatgatttattcagcgtcacacatttagatgcatatcaatgggcaattgtagcaggtacttcttttgctatcatcccaattgtggaaattgtgaagttcttccaacgtaaagcaggtaaaggtgcttaa

SEQ ID NO: 107940 - protein, 901 aa, Enterococcus faecalis
MSEEKKTQLSEAFYAQDDTVVLEKMNTTTDGLSAQEAQKRLETYGENVLDEGKKKSLAVKFFEQFKDFMIIVLLAAAVISAVFSHDVVDSIIILVVVILNAIFGVIQEAKAEQAIEALKEMSSPNANVRRDGHVITVKSDELVPGDIVLLEAGDVVPADLRLLEANSLKIEEAALTGESVPVEKEVTILEGTDIGIGDRINMAYSNSNVTYGRGLGVVVGTGMNTEVGKIAGMLASEQETETPLKQNLNQLGKMLTIAILVIAAVMFVVGMMNGRSWIDMLLTSISLAVAAIPEGLPAIVTIILALGTQKMAKKNAIVRKLPAVETLGSTDIICSDKTGTLTLNQMTVEALYTDGQVLSASTEIPADNMALKIMNFTNDTKIAQDGSLIGDPTETALVQFGLDHAFNVTEKVAAEPRVAEIPFDSDRKLMTTVHELKTGGFLVSVKGAPDELLKRCTEILSNGETSPLDETKRQEILKTNTSLAKQALRVLGMAYKYVETIPAEMSSELVEKDLTFAGLVGMIDPERKEAADAVKVAKEAGIRPIMITGDHRDTAEAIAARLGIIKEGDDDAVITGAELNELSDEKFAQVVGHYSVYARVSPEHKVRIVKAWQQEGKVVAMTGDGVNDAPALKAADIGIGMGITGTEVSKGASDMVLADDNFSTIIVAVEEGRKVFSNIQKTIQYLLSANLGEVLTLFIATMLNWDTLLPVHLLWINLVTDTFPAIALGVEPAERDVMSHEPRGKKSNFFSGGVLSSVVYQGITQGALTLIVYKMSIMFPAHTAANTNLSAQALYDLQHGDALTMAFATLGLIQLFHAFNVKSIYQSIFKVGLFRNKSFNYGILVSFLLLAATIVIPGFNDLFSVTHLDAYQWAIVAGTSFAIIPIVEIVKFFQRKAGKGA

SEQ ID NO: 107941 - DNA, 2613 bp, Enterococcus faecalis
  CDS (1)..(2613)
atgatgaacaaaaaaacaatggatatgagaaaagcaaccaaagatcaagaattacgtaaattggctttgctttctgaacgggaattaatgatggaattacggacatctgaaaaaggactctcgaatgaagatgccgaaaaaagattagaggaatttggaccaaacgaagtttctgcacaaaagccaaccccagcaattattttatttttaagtgcattcaaagatccgtttgtctatgtcttagccttattgatggtcgtttcaactttaacgaaagatttcgaagccgctatcgtgatgggcgtgatgattttagccagtgtcttgattgcttttatacaagagtatcgttctcaaaaagcgagtttggatttaaaagaattaattgaaaataccgctgcagtgacacgggaagggattacgaaagaaattccaatggacgaaattgttccaggagacattgtaactttagctacaggagacatgattcctgcagatgccgtgttgatttggaccaaagatttattcgttaatcaatcgtcgctaacaggcgaatccatgcctgtcgaaaaatttgtggatgcaggtgtggatcgtcaacaaacagaggtttctgcattagatatgcaagacctagtgtttatgggcacagatgtcttgagtggacaaggaaaagcgattattttaaaaactgggcaacatacattttttggtgatattgctaaaaatgctacaacacaacgaggaaaaactagttttgacttaggcttagcaaaagtcagtaagtttttattacgaatggtaatgattttgtttccaatcgttttcttgattaatggtttaactaaaggtgcttggggcgaagcgtttttcttcgcgattgccgttgcagttggtttgacaccagaaatgttgccaatgattgttacgagtaacttagccaagggtgcattatccttatcgaaacataaagtcattgttaaagaattagcggctatccaaaatttaggtggtatggatgtgctctgtacagataagactggaacgattaccgaagatcgtgtagttttggttcaacatttgaatccattaggtgatttgagtgacgaggttctaaatttagcctacttaaattcttcttatcaaacaggttggaaaaatttaatggatattgccgttattaatttttatgaagagcatcaatggaaaacgccgtttaaaaatgtcactaaaattgatgaaattccttttgatttttctagacgccgcttaacggttgtcgtgaatgcagatgatcatcaattgatgattacgaaaggcgccgtggaagaaatggaagaagtgtgcacgcatgcgcaaattaatggcgaaattgtaccattaagcactgctgtacgagaagaactacgccgagtgaatgttcaaatgaacaaacaagggatgcgtgtgttagcggtagctgtaaaaaaagatgtccataaagaagcagtttattcagttgaagatgaaaaagagatgacattgattgggtttatgggttttcttgatccagcaaaagagtcagccgtcagcgctatccgctccttacatgaacatggtgtcaacgtgaaagtgctaacgggcgataatgacattgtcgccaaaaaagtctgtaaagatgtaggcattgaagtttcccatgtgttattaggttctcaaattgaagcaatgacagatgaagagttgcgggcgcaagtagaagaaactaatttatttgccaaattaaatccgatgcaaaaatctaaaattattgaattgctacaagcaaaaggtcatacggttggttttatgggggatggcattaatgatgcaccggcattacgaaaagctgatgtgggcatttcagtagatactgcagctgatattactaaagatgctagctcgattattttactggaaaaaagtttaaatgtactggaatctggtgtgattgaaggacgaaaagtatttagcaatatgatgaaatatattaaaattaccatcagttctaattttgggaatgtcttttcaattttagtagccagtgcctttttaccatttctaccaatgctttccttacaactcttgattcaaaatttgatttatgatgtggctcagttgacaattccttgggataatgtcgatgaagaagagttattaagccctgttcggtgggaaacgaacggactagcgaaatttacggtatgtattggcccggtaagtagtattttcgatattctaacgtatcttgtcatgtggtttgtgtttagtgccaatagtttggcaactcaacatttattccaaacaggttggtttatggtgggacttgttagtcaaacgttagttgttcatatggtccggacgcggaaaataccatttattcaaagtcgtgcgtcaatgcctgtgatgctaagtagtttaggcgcaatcttactcggtttcttgattgtagcaacgcctataagagaggtttttgactttgtgaaacttccggctaactactggccatggttctttggaatcatcattgcgtacatgttaactgttgaagtagctaaacgtttatatattaaaattaccaaggaatggatttag

SEQ ID NO: 107942 - protein, 870 aa, Enterococcus faecalis
MMNKKTMDMRKATKDQELRKLALLSERELMMELRTSEKGLSNEDAEKRLEEFGPNEVSAQKPTPAIILFLSAFKDPFVYVLALLMVVSTLTKDFEAAIVMGVMILASVLIAFIQEYRSQKASLDLKELIENTAAVTREGITKEIPMDEIVPGDIVTLATGDMIPADAVLIWTKDLFVNQSSLTGESMPVEKFVDAGVDRQQTEVSALDMQDLVFMGTDVLSGQGKAIILKTGQHTFFGDIAKNATTQRGKTSFDLGLAKVSKFLLRMVMILFPIVFLINGLTKGAWGEAFFFAIAVAVGLTPEMLPMIVTSNLAKGALSLSKHKVIVKELAAIQNLGGMDVLCTDKTGTITEDRVVLVQHLNPLGDLSDEVLNLAYLNSSYQTGWKNLMDIAVINFYEEHQWKTPFKNVTKIDEIPFDFSRRRLTVVVNADDHQLMITKGAVEEMEEVCTHAQINGEIVPLSTAVREELRRVNVQMNKQGMRVLAVAVKKDVHKEAVYSVEDEKEMTLIGFMGFLDPAKESAVSAIRSLHEHGVNVKVLTGDNDIVAKKVCKDVGIEVSHVLLGSQIEAMTDEELRAQVEETNLFAKLNPMQKSKIIELLQAKGHTVGFMGDGINDAPALRKADVGISVDTAADITKDASSIILLEKSLNVLESGVIEGRKVFSNMMKYIKITISSNFGNVFSILVASAFLPFLPMLSLQLLIQNLIYDVAQLTIPWDNVDEEELLSPVRWETNGLAKFTVCIGPVSSIFDILTYLVMWFVFSANSLATQHLFQTGWFMVGLVSQTLVVHMVRTRKIPFIQSRASMPVMLSSLGAILLGFLIVATPIREVFDFVKLPANYWPWFFGIIIAYMLTVEVAKRLYIKITKEWI

SEQ ID NO: 107943 - DNA, 2661 bp, Enterococcus faecalis
  CDS (1)..(2661)
atggaaaagaaaatgcgtcacttgggccatgactatagttacaaaaagtttgcccattcagaagtagaaaaagttttacaacgttttggctcaacttgggatggcattaaacaccaagatattgaagaattacaagaacgttatggccgcaataaaattatgaatgaaaaaaaagcttcgcggctgcgactttttataaaatcgtatatcacgccgtttactttggtgttactagcactagccacgatttcattttttacagaatatgtctatgctgcgccagaggaaaaagatgttactggcgtgttaattatgttagcgatggtcatcttaagcggcacgatgagttttgtccaatcagtcaaatcaagcaatgcagttgaaaaattacaaaatatgattaaagttacagcgacagtcattcgtgacaagaagcaaatggaaattcctattgaggaagttgtgtgtggcgacttagtccaactatccgctggcgatatgattccagccgatttacgtttaatccaatctaaggacttatttgtttcccaatcatccttgactggagagagttttcccattgaaaaacacgcgactcatcaaaaagatagtgatcaaattgatacagaatacgacaatcttttgtttttaggaacaaatgtaattagtggcactggtttgggcattgtcattaaagttggtaatcaaactttattcggaaggatggcttctgataacggagaagagcagcagcagacgagttttgaaacaggaattaataaaacaacgtgggtgctgattcgctttatgttggtcattacgccaactgtttttctaattaatgggttaacaaaaggtgattgggcggaagcgttaatgtttgcgattgccacagctgtcggcttgacaccagaaatgttacctatgattgtaacaaccaatttagtcaaaggttctcgagaaatggctaaagaaggcacgattatgaaaaatgtcaatgccattcaaaattttggcgggatggatgtactttgtacggataaaacaggtaccttaacacaagataaagtaattttagaataccactataatattgggtgccaagaagatcaaaaagtcttggatttagcatttctaaacagttattttcaaacaggtttgcgtaatttaatggataacgccgttattcaagcggcgacacaagaaagtgatatacaatcagatgatttttataaagtagatgaaattcctttcgatttcaatcgacgtcgaatgagtgtgattatcaaagagtttaaaacgcgagaaacacgcttaattaccaaaggggcggttgaagaaatgctcttggtctgcacacaggtacttttaaatggcgaaattgtgcccttaacagagacgctgcgtcaaaaaattaccaaagacgttgaagctttaaatcgagatggtttgcgcgttctagcaattgccgataaaaaagtcgaagcggctgaatgggagtatacaactaaagatgaatcagagttgattttacaaggctatcttgctttcttagatccaccaaaagaaacagcggcggcagctattcacgccttgcatcaacataatgtagctgtgaaagtattaacgggggacaatcagtatgtgacgcattctgtttgtaaagaagttggtctggctggcgaaaaaattattacaggaaatgaacttcaacaattaaaccaagaagaattaagaaaaaccgttcaagcgtataatattttcgccaaaattacgcctgaccaaaaagttcgtattgtaaatgcgttaactgaaaatggtcaaactgttggctttttaggtgatggaataaatgatgctggagcaatgcgtgctgctgatgtaggaatctctgttgatacagctgtcgatgtggcgaaagaatcggcggatgtaattttattgagaaaagatttaatggttttggaaaaagggattttatctggacggcgcgtgtttacgaacacgatgaagtacgtcaaattaacagcaagttctaattttggcaatgttttttccgtgatcccagcaagtatctttttaccatttttaccgattgctccgattcaatcgctattattaaatctaatttacgatacttcgtgtatgtcagttccttgggacaaagtagatgaagaatacgtagaaaaaccaaaaaaatgggaaccaaaatcaattggtaattttatgcgttggtttggcccaacgagttctatttttgatattgttacctatttatttatgtatttcattgtgtgtccggctatcctaggtggctcattctttgaattaaatggagcagatcaattgctctttatcggtattttccatgcagggtggttcattgagtccttatggtcccaaatgctcgtcttgcatttcctacgaacagaaaaaatgcctttccttcaaagtagtgcttctggaattatgacgttagtcactacagcagggattgttctcggaactgttttaccctttaccgctttcggtgcagaactaggatttgtcggtttatcaccaagctatttcttgtatttaatcccgacaattgttgcttatttagcactggttgcgttcattaaagttttatacgtcaaacgttacggtcaattactgtaa

SEQ ID NO: 107944 - protein, 886 aa, Enterococcus faecalis
MEKKMRHLGHDYSYKKFAHSEVEKVLQRFGSTWDGIKHQDIEELQERYGRNKIMNEKKASRLRLFIKSYITPFTLVLLALATISFFTEYVYAAPEEKDVTGVLIMLAMVILSGTMSFVQSVKSSNAVEKLQNMIKVTATVIRDKKQMEIPIEEVVCGDLVQLSAGDMIPADLRLIQSKDLFVSQSSLTGESFPIEKHATHQKDSDQIDTEYDNLLFLGTNVISGTGLGIVIKVGNQTLFGRMASDNGEEQQQTSFETGINKTTWVLIRFMLVITPTVFLINGLTKGDWAEALMFAIATAVGLTPEMLPMIVTTNLVKGSREMAKEGTIMKNVNAIQNFGGMDVLCTDKTGTLTQDKVILEYHYNIGCQEDQKVLDLAFLNSYFQTGLRNLMDNAVIQAATQESDIQSDDFYKVDEIPFDFNRRRMSVIIKEFKTRETRLITKGAVEEMLLVCTQVLLNGEIVPLTETLRQKITKDVEALNRDGLRVLAIADKKVEAAEWEYTTKDESELILQGYLAFLDPPKETAAAAIHALHQHNVAVKVLTGDNQYVTHSVCKEVGLAGEKIITGNELQQLNQEELRKTVQAYNIFAKITPDQKVRIVNALTENGQTVGFLGDGINDAGAMRAADVGISVDTAVDVAKESADVILLRKDLMVLEKGILSGRRVFTNTMKYVKLTASSNFGNVFSVIPASIFLPFLPIAPIQSLLLNLIYDTSCMSVPWDKVDEEYVEKPKKWEPKSIGNFMRWFGPTSSIFDIVTYLFMYFIVCPAILGGSFFELNGADQLLFIGIFHAGWFIESLWSQMLVLHFLRTEKMPFLQSSASGIMTLVTTAGIVLGTVLPFTAFGAELGFVGLSPSYFLYLIPTIVAYLALVAFIKVLYVKRYGQLL

SEQ ID NO: 107945 - DNA, 2646 bp, Enterococcus faecalis
  CDS (1)..(2646)
atggaagcttacaagcaatctgtcgatactgtcacaaaagaagtttcagtcaatactgaaactggtttaacacaacaagaggcccaacaacggctgaaagaaaatggccgcaatcaatttgaagaggctaagaaggattctgtgttaaagaaatttattcacagtttatctgattttacaacgattattttattagttgctgcggcaatttcgttttatacagcaatcgtaacagaacatggcgaatattttgaaggaatcttaattattgcaattgtgattatcaatgctgttttagccattgttcaagaaggaaatgctgaaaaatctctggcggctttacaagacatgaacaagcaaagtagtgcagtcttacgagatggcaaggtaatcgaagtcgatgctgaagaactagtagtaggagatgttctagttcttgaagctggttctatgattacagccgatgcacgacttattcaagcttctcaaatgcgcgtagaagagtcagcactaacaggtgaaagtgaacctgttgaaaaagatcctacatacgtggggcatgacgatgatggcttaggagatcaaataaatatgattttcaaaggctgtaccgttgtgaatggccgcggacgagcagtagtaactgcaacaggaatgaatacggaaatgggtaaaattgctgggttactgaataacagcgatcagcaaaaaacaccattacaaaaacgcttgaatcaattaggcaaacgtattagtttgttagccttaggggctgcagcaattgttttcattattggtgaactgcaaggagaaccgcttcttgaaatgtttatgacagccgtttccttagcggtggcagctgtaccagaaacactaaccgtgattgtaacgttaaccttagcatatggtgttcaaaaaatggctaagaaacatgcgattattcgtcgattgccagcagtagaaacgctaggaactgcgaatgttatctgttctgataagacaggaacactgacacaaaataaaatgcgcgtccgccgagtatggcatcgtggtgatgaagtaacggatacggaagatgccatgaccgatgaagccatggaagtactgaaaatggctgctttatgtacagatgtcattgtggaaaaagaaggcgatgaattaactgttacagggaatccgacagaagcggcaattgttcgtgctgtcgaagaaaattatcatactaaagaagaacttgaagaaaaatatcctcgtattggtgaaattccctttgattcagaacgaaaaatgatgactacggtccatcaatgggggaaaaagtacatctcaattactaaaggagcctttgatgtgttactacctcgttttggtttcggagatgtcgatcaagcggctattgttaatgatcgtttcggaaaacgagcgttacgagttattgctgtcggttatgccgtatatgatgaaccacccaaggaaattacatcagaggctttagaaaaaaatcttcgcttgttaggcttaattggcatgattgatccaccacgtccagaaagtaagggcgccattgctcgtgcgaaaaaagctggaattaaaacagtcatgattactggtgatcacgtggtaacagccagtgcaattgctaaagaattaggaattttaaaagataaaagtgaagccttatctggttcagaactgaaaaaaatgagtgatgaagaattagataaacgtgttaaagatttatccgtttatgcacgtgtaacccctgaagataaaattcgaattgttcaatcatggcaacgttctggcgctgttgtagcaatgaccggagatggcgtgaatgatgcgccagccttgaaagctagtgatgtcggttgcgcaatggggattactggaacagatgtggcccaaggtgcttcagatatgattttgacggacgataactttgcaactattgttgatgcagtggcgcaaggacgtgccgtgtaccgaaatattcgtaaagccattaacttcttattaagctgtaatatttctgagatttttattgttttaattgccatgttacttggttggggtgcgccatttactgcagttcaactgttgtttgttaacgtggtcgcggatgggttacctggttttgcattaggaaaagaaccagcggaaaaaggaattatggatgaggcaccaatccctaaaaacgaagggatttttgcacgaggcttatggcaaaagattgggattaatgcagcagtgttcacagtcattactttgtttggtttttacctaggtgcctttgtaccaggtgtttcagcctatgtttcaaacagctatgaagttggacaaacagtggcatttttaatcttagcttattcctctatcttacatgtctttaatgttcgtagtgcgaactctgttttccgtgtaaaattatcaagcaacaagtcgctctttgaaatggtcgttttagcattactaattaccacaaccattgctttattaccattcacacaagaactatttggattagtgcatattagtttaaatcattggatgttagcaattttcctatcctttgtgccaattttcgtcaatgaaatgattaagttccatttctctgaagtcgaagaggaagaagaagtgatttaa

SEQ ID NO: 107946 - protein, 881 aa, Enterococcus faecalis
MEAYKQSVDTVTKEVSVNTETGLTQQEAQQRLKENGRNQFEEAKKDSVLKKFIHSLSDFTTIILLVAAAISFYTAIVTEHGEYFEGILIIAIVIINAVLAIVQEGNAEKSLAALQDMNKQSSAVLRDGKVIEVDAEELVVGDVLVLEAGSMITADARLIQASQMRVEESALTGESEPVEKDPTYVGHDDDGLGDQINMIFKGCTVVNGRGRAVVTATGMNTEMGKIAGLLNNSDQQKTPLQKRLNQLGKRISLLALGAAAIVFIIGELQGEPLLEMFMTAVSLAVAAVPETLTVIVTLTLAYGVQKMAKKHAIIRRLPAVETLGTANVICSDKTGTLTQNKMRVRRVWHRGDEVTDTEDAMTDEAMEVLKMAALCTDVIVEKEGDELTVTGNPTEAAIVRAVEENYHTKEELEEKYPRIGEIPFDSERKMMTTVHQWGKKYISITKGAFDVLLPRFGFGDVDQAAIVNDRFGKRALRVIAVGYAVYDEPPKEITSEALEKNLRLLGLIGMIDPPRPESKGAIARAKKAGIKTVMITGDHVVTASAIAKELGILKDKSEALSGSELKKMSDEELDKRVKDLSVYARVTPEDKIRIVQSWQRSGAVVAMTGDGVNDAPALKASDVGCAMGITGTDVAQGASDMILTDDNFATIVDAVAQGRAVYRNIRKAINFLLSCNISEIFIVLIAMLLGWGAPFTAVQLLFVNVVADGLPGFALGKEPAEKGIMDEAPIPKNEGIFARGLWQKIGINAAVFTVITLFGFYLGAFVPGVSAYVSNSYEVGQTVAFLILAYSSILHVFNVRSANSVFRVKLSSNKSLFEMVVLALLITTTIALLPFTQELFGLVHISLNHWMLAIFLSFVPIFVNEMIKFHFSEVEEEEEVI

SEQ ID NO: 107947 - DNA, 3637 bp, Trypanosoma brucei
  CDS (78)..(2816)
aacgctattattagaacagtttctgtactatattgacctgtaacatctaaggtagtaaaggccaaaggaatatacaaatgggggatactggaccaaagggtgttccgggaaccaacgacgccggtgaagtgcacaagccacagaaaccgcaacgccgccaatctgtgctatcaaaggctatcagtgagcaccgtgagggtgatgatggcagtgtaccactggtgccgccctcgaagggattgacatccgcagaagcagaggagttgttgcttaaatacggtcgtaacgagcttccggaaaagaaaacacccagttggctgatatttttgcggaatctatggggccctatgccgattgttttgtggattgtcataataatccagtttgcgttacagcactttgctgatggtgccgtcctgctcggtattcagctcgctaacgctctcattgggtggtatgagacgataaaagctggtgatgcggtcgctgcactgaagaactctttgaaacctattgcgaccgcttaccgtgacggtacctggcagcagatagacgccgcattactggttcccggtgaccttgtgaagcttgggtctggttccgccgttcccgctgactgcacgattaacgaaggtgtgattgacgttgacgaagcagcactgaccggtgagtcacttcctgtgacgatgggaacggaacacatgccgaagatggggtcgaatgtcgtacgtggtgaagttgatgcgacggtgcaatacacaggtcagagcaccttttttggcaagacggcaacgctacttcagtctgtggaggctgacattggcagtatccgtataattctcatgcgtgtgatggtcatctcgtcgagtttctcgttcgtactttgcttgatttgcttcatctatctgatggtaaatttcaagcaaaagttccgtgatgccttgcagttcgctgttgtagtgcttgtggtatccattcctattgctttggagattgttgtgacgaccactctcgctgtgggttcaaagaagctgtcgaagcacaaaatcattgtgacgagactgacagccattgagacaatgtctggtgtgaacatgctttgctctgacaaaaccggtactctgacgttgaacaagatggagattcaggaacagtgcttcacatttgagaagggtcacgatctgcgttcactgcttgtactttccgcgcttgcagcaaagtggcgtgagcctccccgtgatgcactggacacgatggtacttggtgctgcagatctggacgagtgcgacaactacgagcagcttgagttcgtgccatttgatccaacgacgaaacgaacggccgctacattggttgataagcgaagtggtgagaagttcagtgtgacgaaaggcgcaccacacgttattatagagatggtgcacaatcaagatgagatcaatgactctgtggtcgatatcattgacaaattggcgtcgcgcggtatccgatgcctctctgtggcgaaaacagactccgcgggtcgttggcatctctgtggaatcctgacgttcctcgatcccccgcgcccggacacgaaggagacaattcgccgtagtaggcagtatggcgtggatgtaaagatgatcactggtgaccatgtgctcattgcgaaggaaatgtgccgcatgctggaccttgatccgaacatcctaaccgccgagaagcttcccaaggtggatgtcaacgatatgcccagcgaccttggcgagaagtacggtgacatgatgctgagtgtcggcgggttcgcacaggtcttccccgagcacaagtttttgatcgttgaggcgcttcggcagcgcgggtacacgtgcgcgatgactggtgatggtgtgaacgacgcgcctgccctgaaacgtgcggacgtcggtattgctgtacagggcgcgacagacgccgctcgtgccgcggcagacatggtgctgacagaccctggtttgagtgttgttgttgatgcgatgtttgtatcgcgccaggtgttccaacgtatgttgtcttttctaacataccgtatttccgccacaatgcagttggtgtgcttcttttttatcgcctgcttctcgttgacacctcacgactatggaattgagaaccccgaattccaggttttctacctcccagtgatgatgttcatgctgatcacgctcctgaacgacgggtgcctgatgaccattggatatgaccgtgtggtgccctcgaagcttccgcagcgttggaacattcctgttgtgttcacaagcgctataattatgtctgttgttgcctgtgcctcgtctctactactgctgtggatggctcttgatgcttatgatgagaaaaggtaccccaactcttggtttggcaaactcaacattccttccttgaaggagggcaaaatagttactctcctgtacctcaagatatcgatttctgacttcttgactctattctcctcacgtactggtggaaggttctttttctcgatggctccgggcactatactgctggtcggtgcggtgatctcactggtaatctcgacgatcgccgcctcggtttggaagaaatcaagttctgatggtgttcctgtcgagggtcttgcacgaggtgaaactgttgcggatagattgtatccactttgggtttggatatattgcattttgtggtggatcgtccaagatgtcgtgaaggttttgactcacatgctaatggaggccttcgacatatttggctgtgtgtctcgtgcaagcggtgggaaagaaattgtttataatgctaagtcgtctaaggaacctatttaaaaatattaaatttttttttctcctttcggaacaatcacattgaattttttttataaggcagcgcttttctcgtttggtttgtgctaatatggaggcgcgtgtttgtgttattttccttttcgcgaattggggttagaaatttggtatctgttggccttcattttaatcagggatgcttagtaagtttttgtgtatgttttttttctttgaatgagcgtgatggcgggtgggtgaaggtggggaatcacgaagctgttgtggggttgaacagtgcgctttcgttgttgccccatcctcattatttcccttatatgttggctttattaatttttttcttttctttaatgaaaagacatataacggtctttattgtgagtattttatgtgtacgacatggctgtgatgggtaactctagaggtggggtattgttgttggagagaatattcttttcatgcatccttttttgcgatgtttcagtgcattaacttgtgggaaagcggatttttttttggtatcgttccgtcgttataatccaatttcccctcgcaaccgtggacgtggcgagctgcatgcgtgtggtattgttctcattcatgtgcatttcaacagttgcctgatgttctcctgtccattagcggcagcgtaaacctctaattttgtcaccccagtcgcacgcttaagcagtagcatgagtgtatgctgagaaataaaagatcttttccttaattcttttttttttaatcgtaaacgctttgtttgtttgtttggtggtggtggtggtggttctcgcgcggtcgactccgaaaaaaaaaaaaaaaaa

SEQ ID NO: 107948 - protein, 912 aa, Trypanosoma brucei
MGDTGPKGVPGTNDAGEVHKPQKPQRRQSVLSKAISEHREGDDGSVPLVPPSKGLTSAEAEELLLKYGRNELPEKKTPSWLIFLRNLWGPMPIVLWIVIIIQFALQHFADGAVLLGIQLANALIGWYETIKAGDAVAALKNSLKPIATAYRDGTWQQIDAALLVPGDLVKLGSGSAVPADCTINEGVIDVDEAALTGESLPVTMGTEHMPKMGSNVVRGEVDATVQYTGQSTFFGKTATLLQSVEADIGSIRIILMRVMVISSSFSFVLCLICFIYLMVNFKQKFRDALQFAVVVLVVSIPIALEIVVTTTLAVGSKKLSKHKIIVTRLTAIETMSGVNMLCSDKTGTLTLNKMEIQEQCFTFEKGHDLRSLLVLSALAAKWREPPRDALDTMVLGAADLDECDNYEQLEFVPFDPTTKRTAATLVDKRSGEKFSVTKGAPHVIIEMVHNQDEINDSVVDIIDKLASRGIRCLSVAKTDSAGRWHLCGILTFLDPPRPDTKETIRRSRQYGVDVKMITGDHVLIAKEMCRMLDLDPNILTAEKLPKVDVNDMPSDLGEKYGDMMLSVGGFAQVFPEHKFLIVEALRQRGYTCAMTGDGVNDAPALKRADVGIAVQGATDAARAAADMVLTDPGLSVVVDAMFVSRQVFQRMLSFLTYRISATMQLVCFFFIACFSLTPHDYGIENPEFQVFYLPVMMFMLITLLNDGCLMTIGYDRVVPSKLPQRWNIPVVFTSAIIMSVVACASSLLLLWMALDAYDEKRYPNSWFGKLNIPSLKEGKIVTLLYLKISISDFLTLFSSRTGGRFFFSMAPGTILLVGAVISLVISTIAASVWKKSSSDGVPVEGLARGETVADRLYPLWVWIYCILWWIVQDVVKVLTHMLMEAFDIFGCVSRASGGKEIVYNAKSSKEPI

SEQ ID NO: 107949 - DNA, 3484 bp, Homo sapiens
  CDS (181)..(3000)
atgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggttgcacgttttcaaaaaatacctaatggtgaaaatgagacaatgattcctgtattgacatcaaaaaaagcaagtgaattaccagtcagtgaagttgcaagcattctccaagctgatcttcagaatggtctaaacaaatgtgaagttagtcataggcgagcctttcatggctggaatgagtttgatattagtgaagatgagccactgtggaagaagtatatttctcagtttaaaaatccccttattatgctgcttctggcttctgcagtcatcagtgttttaatgcatcagtttgatgatgccgtcagtatcactgtggcaatacttatcgttgttacagttgcctttgttcaggaatatcgttcagaaaaatctcttgaagaattgagtaaacttgtgccaccagaatgccattgtgtgcgtgaaggaaaattggagcatacacttgcccgagacttggttccaggtgatacagtttgcctttctgttggggatagagttcctgctgacttacgcttgtttgaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaagggtgttgtcattggaacaggagaaaattctgaatttggggaggtttttaaaatgatgcaagcagaagaggcaccaaaaacccctctgcagaagagcatggacctcttaggaaaacaactttccttttactcctttggtataataggaatcatcatgttggttggctggttactgggaaaagatatcctggaaatgtttactattagtgtaagtttggctgtagcagcaattcctgaaggtctccccattgtggtcacagtgacgctagctcttggtgttatgagaatggtgaagaaaagggccattgtgaaaaagctgcctattgttgaaactctgggctgctgtaatgtgatttgttcagataaaactggaacactgacgaagaatgaaatgactgttactcacatatttacttcagatggtctgcatgctgaggttactggagttggctataatcaatttggggaagtgattgttgatggtgatgttgttcatggattctataacccagctgttagcagaattgttgaggcgggctgtgtgtgcaatgatgctgtaattagaaacaatactctaatggggaagccaacagaaggggccttaattgctcttgcaatgaagatgggtcttgatggacttcaacaagactacatcagaaaagctgaatacccttttagctctgagcaaaagtggatggctgttaagtgtgtacaccgaacacagcaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcgccagtcgtctgggattgtattccaaaacttcccagtcagtctcaggagaagaaatagatgcaatggatgttcagcagctttcacaaatagtaccaaaggttgcagtattttacagagctagcccaaggcacaagatgaaaattattaagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtctgcaatcgaagagggtaaagggatttataataacattaaaaatttcgttagattccagctgagcacgagtatagcagcattaactttaatctcattggctacattaatgaactttcctaatcctctcaatgccatgcagattttgtggatcaatattattatggatggacccccagctcagagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgagctacgagacaatgtgattacacctcgagacacaacaatgaccttcacatgctttgtgttttttgacatgttcaatgcactaagttccagatcccagaccaagtctgtgtttgagattggactctgcagtaatagaatgttttgctatgcagttcttggatccatcatgggacaattactagttatttactttcctccgcttcagaaggtttttcagactgagagcctaagcatactggatctgttgtttcttttgggtctcacctcatcagtgtgcatagtggcagaaattataaagaaggttgaaaggagcagggaaaagatccagaagcatgtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaaaaaaaaaaaaaaaaaaaaa

SEQ ID NO: 107950 - protein, 939 aa, Homo sapiens
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVWLWERSGQQLVEIHPHLETGLPLTEDVSCV

SEQ ID NO: 107951 - DNA, 2613 bp, Lactobacillus plantarum
  CDS (1)..(2613)
atgcagaattatcagaatgcaccattcaaacctacccccgagtccggtttaacgaccacagcggtgacgacccagctaactaaattcggcaaaaatgaattagtggctgcgcgccccgtaccgttatggcgtaaaatttggcaacatatgagcgacgtttcatcgctagtgttattatttgcagttggtttagccacgtacttggctcttgcccagaatgggggctggacaaagaccattgtgattggcgccattttagttattaatgtctgtattggtttgtaccaagaagcttccgcagaaaagtcgttggcggcactgaagtcaatgagtttacccacagctaatgttcgacgggatgggaaggtacaaacgattgcggcaccagaaatcgttcccggtgatttagtgctactaaaagcgggtgaccaggttccagccgatgcggtcgtgttagaggccacgaacttagccgttgatgaggcagtcttgacaggtgaaagtgaagctgttgaaaaaagtatttatcaggacaccggtgagttggatgataactgtcaagtgtatgcgggaacggccgtcacagccggtactgcattgattcaggtcttaacgaccggaatggccacagagttaggtcaaattgcaggtttgttgaacaagacgaagcaacgggccacgccattacaggggcggcttaatcggctatcaagctggttaacgacatttgccgtcttaggtggtattacgatttttgcgctgagtgtttgggtgcaaaaccaaggtttggccgatagcttgatgattggggtttcattagcggtcgcggccgtgccagagactctgccgatcatcgtgaccattagtctttcacacggtgttcgacggatggcagacagaaatgccatcatgcgccgagttagtgccgttgaaacgattgggagtgtcgatgtaatcgcgtctgacaagaccggaaccttgacgcaaaatcgaatgacaattacaaagtattggacgccgaccacgggcattatgacgaccgaacagcccttgccatcagcgggacaaacattgatgcgttacttaggattagcgacgaatgccgagattaaccacgttgacggtgaagaacaagccattggggacgcaacggaattagccgttattcgttggctggctcagcatgatttagatcggcccagcttggaggcgcagaccccacgaattgcggaagacccgtttgactcaactaagaagatgatgacgacggtgcatgaattagcgcatggtcgacggttagttatcgtcaaaggggcttgggatcggttaccactgaagcctgaccaagctagcctagctgctggacaagtggcccatgatgaatttgggcaggcggcgctgcgcgttttagctgttggctatcgcatcattcccgcggatgtccaaactactgactgggacgacctgacagctgacctccaattggcaggattgattggtttgattgatccaccacgaccagaagtgattccggccattcgagcagccaaacaggcgggtatttttccagttatgatcacgggagatcatttggttactgcgaaggctatcgctgaggaaattggcattttaacccctgggctgcaagcaattagcggtgatgagttacgccaattgagcgatgaagaattgacggctcaaatcgatcagattgcagtgtacgcccgagtgtcgccgagtgacaaaattagaatcgttcaggcttggcaaagtcttggtaagacggttgcgatgaccggtgatggtgtcaacgatgcgccggcattgaaagcggcggatgttggcattgcaatgggaattacgggtaccgaagtatctaaagaagccgctgacatggtgttaacggatgataattttgcgacgatcatggcagcagttaaggaaggtcggacagtttatcagaatatcattaaagccgttgaattcttggtaggtgtcaactttgcacaaatcttcttgatggttggtgcagtcctcttcggttggggggcgccactgttagcagaacaattgctgattattaacgtacttgctgatgggattccaggattctttattagccaagagccaggtgaaccccaagctatgcaacaaccaccagtatccaatgacgaaagtattttagctcggggccttggtcaacggttgtttatccgggcagctacttttaccgtactaaccctcggaatttacgcgtttggccgctttggcttaacaaatggtcaagccccagtcgggatgacgatggtctttctagtattggcattaggatcaatgatcgacatctatgcaattaaggatcgccgaccactcagctggtcaagcatgatgcgtaatccaatgctgaaccgaggattgctgttaggaattctggtggtcttggcaattgcagtgataccaccgttccgtagtttctttagcttagtgacactaccagcgttaggctggttaacggtgctagtagctacgctgattccaacattcgtgctggaattgaataagcgctggcaggcgcggcgacagtcacgattagtcgtgaatactgctgaataa

SEQ ID NO: 107952 - protein, 870 aa, Lactobacillus plantarum
MQNYQNAPFKPTPESGLTTTAVTTQLTKFGKNELVAARPVPLWRKIWQHMSDVSSLVLLFAVGLATYLALAQNGGWTKTIVIGAILVINVCIGLYQEASAEKSLAALKSMSLPTANVRRDGKVQTIAAPEIVPGDLVLLKAGDQVPADAVVLEATNLAVDEAVLTGESEAVEKSIYQDTGELDDNCQVYAGTAVTAGTALIQVLTTGMATELGQIAGLLNKTKQRATPLQGRLNRLSSWLTTFAVLGGITIFALSVWVQNQGLADSLMIGVSLAVAAVPETLPIIVTISLSHGVRRMADRNAIMRRVSAVETIGSVDVIASDKTGTLTQNRMTITKYWTPTTGIMTTEQPLPSAGQTLMRYLGLATNAEINHVDGEEQAIGDATELAVIRWLAQHDLDRPSLEAQTPRIAEDPFDSTKKMMTTVHELAHGRRLVIVKGAWDRLPLKPDQASLAAGQVAHDEFGQAALRVLAVGYRIIPADVQTTDWDDLTADLQLAGLIGLIDPPRPEVIPAIRAAKQAGIFPVMITGDHLVTAKAIAEEIGILTPGLQAISGDELRQLSDEELTAQIDQIAVYARVSPSDKIRIVQAWQSLGKTVAMTGDGVNDAPALKAADVGIAMGITGTEVSKEAADMVLTDDNFATIMAAVKEGRTVYQNIIKAVEFLVGVNFAQIFLMVGAVLFGWGAPLLAEQLLIINVLADGIPGFFISQEPGEPQAMQQPPVSNDESILARGLGQRLFIRAATFTVLTLGIYAFGRFGLTNGQAPVGMTMVFLVLALGSMIDIYAIKDRRPLSWSSMMRNPMLNRGLLLGILVVLAIAVIPPFRSFFSLVTLPALGWLTVLVATLIPTFVLELNKRWQARRQSRLVVNTAE

SEQ ID NO: 107953 - DNA, 2655 bp, Lactobacillus plantarum
  CDS (1)..(2655)
atgagtacaaaaccaaagtatcaacaagcgttatccgccgtttatgaggaactaggcactgatgaacacggcttacagcaaagtgctgcgacgcaacggttagaacaatatgggccgaatgcgttgaatcagcaaaaagcgacttccttgttgcaaaaatttattgcgcagttcaaggatttcatgattatcgtcctgttagtggccgccttgattgccgcctttactggggaagccgtcgatgccgttatcatcttattggtggtggtattaaatgcgattttcggtgtcttccaggaatcgaaagcggaagaggccatcaacgcgttgaaggaaatgtcagcgccggacgcgactgttttacgggatggtcagctgcaaacggtcaagagtgacgcgttggttcctggggatgttgtgtcgctagaagccggggatatcgttcccgcggatttacgattaattgagagtgcgtcattgaaggttgaagaatcggcgctgacgggtgaatctgtcccagttgagaagcaggcggagatgattgccgatggggaattaccaatcggggaccggttaaacatggcgtacatgaatagtaacgtgacgtatggtcgggccactgggattgtggtggcgactgggatgcagaccgaagtaggtcgaattgccggcatgattgaagcggccgatgagacgaccacaccactgcaagcgaacttgacacagttaggtaagtcgctgacgattttaatcttagttattgccgcagtggtatttggtatcggaatgctgcgtggtcaagagagtttgatcaacatgttattgacggcgatttcgttagccgtagccgcaattccagaagggttgccggcaatcgttacgatcacgttagcgttaggaacccagcggatggccaaacggcatgcgttagtacgaaaattacccgcagttgaaacgttgggaagtaccgatattattgcctctgataagaccggaacgttgacgcaaaacaaaatgaccgttgaaaagttggtcgtcaaccaggaactggtggacgcgcgcgctactgaattgccgcttgatagccatttagcgcaagtgatgattttaagtaatgatacgaagatcatgccggatgggttagcaggtgacccaacggaaacagcgttgattcaatataatttggatcagggttatccagtcgatcagttattgacggaccgcccccgagtaacagaagtcccctttgattcggaacgtaaattgatgtcgacggtgcaccccttagaagatggtcgcttcttagtagccgtcaagggggctcctgatgaattactcaaacgggtcactcagattgaaagtaacggtgacgttcagccattaaccaagacaagccgtgaccagattctaactgttaatcatgaattggcaacgcaagccttacgggtcttagcatttgcttataaagtgatcaccacggttccgacgactgttaatacggagacgttagaaaatgacctggtctttgccgggatggtcggcatgattgatccagaacggccagaagttgaacaagccgttgcagaagctaaatcagctggaattcggccgttgatgatcacgggtgaccaccgtgataccgccgaagcaattgccgtccgtcttggtatcattaacgctggcgaagatgacgctgtgattactggtgccgagttagatgcaatgagtgatgcggaattcggcaaaaaggtcggcgattactcggtgtatgcccgggtggcgcctgaacacaaagttcgaatcgtgaacgcatggcaaaaacgaggcaaagttgttgctatgactggtgatggggtcaacgatgcgcccgccttgaaggctgctgatatcggtattggtatgggaatcactgggacggaagtttccaagggggctagtgacatggtcttggctgatgataacttcgccacgatcgtggttgctgtcgaggaaggccgaaaagtgttcgccaatattcaaaaggcgattcagtaccttttgtcagcgaacttaggggaagtcttaaccttgttcgtgatgacgatgttgggctggcaaatcttggcaccagtgcatatcttatggattaatttagtgaccgataccttgccagcaattgccttaggcgttgaaccaactgaaaagaacattatgcagcataaaccgcgcgggagaaattctaatttcttctcaggtggggtcttcagcagtattatttatcaagggctactggaaggtggcattacgttgctcgtgtactggttagctttgacgtatccggttcacgcaacggcctcattagctcatgctgatgcgttaacgatggctttcgcgacccttggcttgattcagttgttccacgcgtttaattctaaatccattcatgaatcgttgtttacggtcggcttgttccgaaacaagttctttaattgggcgattctaattgcatttgtgatgctggcgatgacaatcgtcgttcccggtctgaatgggttattccacgtgagtcacttggatgcttaccaatggggaatcgtggccttagcttccttatcgatggtcgtgattgttgaaattgttaagttcttccaacgtcgacacatgcggcgcgcataa

SEQ ID NO: 107954 - protein, 884 aa, Lactobacillus plantarum
MSTKPKYQQALSAVYEELGTDEHGLQQSAATQRLEQYGPNALNQQKATSLLQKFIAQFKDFMIIVLLVAALIAAFTGEAVDAVIILLVVVLNAIFGVFQESKAEEAINALKEMSAPDATVLRDGQLQTVKSDALVPGDVVSLEAGDIVPADLRLIESASLKVEESALTGESVPVEKQAEMIADGELPIGDRLNMAYMNSNVTYGRATGIVVATGMQTEVGRIAGMIEAADETTTPLQANLTQLGKSLTILILVIAAVVFGIGMLRGQESLINMLLTAISLAVAAIPEGLPAIVTITLALGTQRMAKRHALVRKLPAVETLGSTDIIASDKTGTLTQNKMTVEKLVVNQELVDARATELPLDSHLAQVMILSNDTKIMPDGLAGDPTETALIQYNLDQGYPVDQLLTDRPRVTEVPFDSERKLMSTVHPLEDGRFLVAVKGAPDELLKRVTQIESNGDVQPLTKTSRDQILTVNHELATQALRVLAFAYKVITTVPTTVNTETLENDLVFAGMVGMIDPERPEVEQAVAEAKSAGIRPLMITGDHRDTAEAIAVRLGIINAGEDDAVITGAELDAMSDAEFGKKVGDYSVYARVAPEHKVRIVNAWQKRGKVVAMTGDGVNDAPALKAADIGIGMGITGTEVSKGASDMVLADDNFATIVVAVEEGRKVFANIQKAIQYLLSANLGEVLTLFVMTMLGWQILAPVHILWINLVTDTLPAIALGVEPTEKNIMQHKPRGRNSNFFSGGVFSSIIYQGLLEGGITLLVYWLALTYPVHATASLAHADALTMAFATLGLIQLFHAFNSKSIHESLFTVGLFRNKFFNWAILIAFVMLAMTIVVPGLNGLFHVSHLDAYQWGIVALASLSMVVIVEIVKFFQRRHMRRA

SEQ ID NO: 107955 - DNA, 2739 bp, Lactobacillus plantarum
  CDS (1)..(2739)
atgataaaagatgacaatcagtcgttaacctctaatgaagagcaaaacgacacccagaaccctcccgatgcggataacttatggcagcttgatgaatcagccttagccgcaaagtacgccaccgatcctgagaatggattgagcactgctgaagctgccgaacgtttacaacataacggtcgcaacgaactggagaccaagcgtacgtctcggttcgtccaattcatcaagcagtttaataacagtattatctacattttagccgcagcagcggtcttaacgttcttcatgcaccactattccgattctatcgttattggactggttattattgccaatgccatcattggttatgtccaagaacgccaagctggcaacgcgctagaacggattcgtgaaatgctgatttccaagaatttcgtcatccgtgatgggaaaaaactggaaattgacgcccgcgaattagtcgttggtgacttagtcaacttagaagccggtgacgcggttcctgccgatatgcgcttgatttcagcggacaactttaacgtccaagaatccgtgctgacaggggagactaatcccgtggagaaacaagaagaaccgatgacagagaccacgctggctttggctgaccgtaagaatatggtttacgcgtcaaccgcggtgactagcggttcggccgttggaatcgtaacggctaccgccgaagataccgaaatcggtcatatccagcagtctgttagtgacgtcaaacaaaccactaccccactgatgcgtaatctgaactcactgggggttggcttatcaatcgccatcgtggtggcggccgtcctattattcctattaggaatggtcatggatacctatagtttgccaactttactaattgcggttattacgatggtcgttggttctatgccagaaggactgcccgctagtacctcggtggtcttagccatgggaacccggcagatgacgaagaaaaacgtcattgtcaagtcactacccgccgtggaaactttaggtgccgtagatatcgttaacaccgataagactgggacgttgacgaaaaatgaaatgacggtcactaaggtcgtgacgcctgagcatacgtttgatgtgacgggggtcggttatgatgataatggtggcgttaacttcgatggccatctcaagctcaatggcaacaaagtcgactggcaccaagataacgcgatggaatggctcgttaagattgccggccaaacgaccgacgccgagctacacttcgaaaacaatcgctgggaactgaccggtgaaccaaccgatggtgccttgacgacgctgtatcgtaaaatgactggtcatggtcctgaggttgaagaagttgactcgctaccattcgattccgccttccgtttttctgctcgcctggccgacttagatggtcaacgcttactaatggtcaagggctcacccgcgactgtcctgcgtttaactgaccaagctaaccaaacggcatactgggatgacgccatggacgacttaaccgccgatggtttgcgcgtggtggcgctggcttaccaagaagtcgatgatgacgtgactaccattgatgcacaagccattggtgggctgcatttagctggcttagtcggaatcattgacccgcctcgtgaagaagcggctaccgcgatcgccgaattacggcaagcgggcgtgcaagttaaaatgattacaggggaccaccctgatacggcgatggcaattgccaacaagttgaacttggccgccaatgtcaaagtgattactggtcctgaaatcgacgcgatggacgatcagcagttacaagcacacatcgatgattataacgtcttcgcacgggcaacaccgaataacaaattacggattgttcgtgcccaacaggccaataatcacgtcgtttcgatgactggtgatggggtcaacgacgccccggccctcaagcaagccgatattggggttgctatgggaatcaaggggaccgaagttgctaaggaatccgccgatatggtcctggccgatgatgactttgctgatatcgtcgccgccgttcgtgaagggcgccacgtcttcgataacattcgtaagacgattcgcttcttactcccaactagtttcgcggaaggcctcgttgtcatcattagtattttaatgggccacgaacttccgctgtatccgacgcaattactgtggatcaatatggtgtccgcgctgaccatccagtttgcgttcatctttgagccacccgaggccggcatcatggcccggggtccccggaatgttaagtctgggttgttgtcaaaattagattactttgaaatcggctatgtctccttcctaatttctggattggggatcttcgcctacaactacttgaccgcacttggattaccaaacgtcgtcggtagtaccatgtcactgaacatcatcatctttggtaagattttctacctcttcaacttgcggaatgaccaccccgtcatttccaagtacttcttccaaaataagatggcgttctacatcattggtattctgattctcttacaactgggaatcatttacctaccattcatgcaatccgtcttccatacgactagcatcaacttctggtatggttggggcatcccgattatctgtgggatcgtcgtcttgattgtgaccgaggtcgggaagtttattcggttccgatggatgggaaaagatggcgtgattgattag

SEQ ID NO: 107956 - protein, 912 aa, Lactobacillus plantarum
MIKDDNQSLTSNEEQNDTQNPPDADNLWQLDESALAAKYATDPENGLSTAEAAERLQHNGRNELETKRTSRFVQFIKQFNNSIIYILAAAAVLTFFMHHYSDSIVIGLVIIANAIIGYVQERQAGNALERIREMLISKNFVIRDGKKLEIDARELVVGDLVNLEAGDAVPADMRLISADNFNVQESVLTGETNPVEKQEEPMTETTLALADRKNMVYASTAVTSGSAVGIVTATAEDTEIGHIQQSVSDVKQTTTPLMRNLNSLGVGLSIAIVVAAVLLFLLGMVMDTYSLPTLLIAVITMVVGSMPEGLPASTSVVLAMGTRQMTKKNVIVKSLPAVETLGAVDIVNTDKTGTLTKNEMTVTKVVTPEHTFDVTGVGYDDNGGVNFDGHLKLNGNKVDWHQDNAMEWLVKIAGQTTDAELHFENNRWELTGEPTDGALTTLYRKMTGHGPEVEEVDSLPFDSAFRFSARLADLDGQRLLMVKGSPATVLRLTDQANQTAYWDDAMDDLTADGLRVVALAYQEVDDDVTTIDAQAIGGLHLAGLVGIIDPPREEAATAIAELRQAGVQVKMITGDHPDTAMAIANKLNLAANVKVITGPEIDAMDDQQLQAHIDDYNVFARATPNNKLRIVRAQQANNHVVSMTGDGVNDAPALKQADIGVAMGIKGTEVAKESADMVLADDDFADIVAAVREGRHVFDNIRKTIRFLLPTSFAEGLVVIISILMGHELPLYPTQLLWINMVSALTIQFAFIFEPPEAGIMARGPRNVKSGLLSKLDYFEIGYVSFLISGLGIFAYNYLTALGLPNVVGSTMSLNIIIFGKIFYLFNLRNDHPVISKYFFQNKMAFYIIGILILLQLGIIYLPFMQSVFHTTSINFWYGWGIPIICGIVVLIVTEVGKFIRFRWMGKDGVID

SEQ ID NO: 107957 - DNA, 2265 bp, Clostridium tetani
  CDS (1)..(2265)
atggctgcacctacagctaaagtaatgagagatggaaaaataaaagttataaatgctatggaactggttattggagatgtaatcttaatagaaagtggagatagggttccagcagattctattatattagataattattctcttatgctagatgaatctttactaactggagaatctgtaggtgttaataaaaatggaaagggcaaaaataaagatatttacatgggaaccatagttttaaaaggaaaagctatggcaaaaattatggcaacaggtatgaatactgaaatgggtaaaatagcaggtatgttagataacatagaaaaggataaatctccacttaaagaaaaactaaattctcttgggaaggtactagttgtaatatgcctaattatttgtatagtagtaactgtagttggcataatgagagggaataataaatatgaaatgttacttttaggagtaagtttagcagtggcagcaattccagaaggactacctgctattgttacagtgtctttagcactaggagtatttagaatgctaaagaagaatgcattggttagaagattgccagccgtagagaccttaggatgtacttctataatatgtagcgataaaactggaacattaacagaaaataaaatgaaggtaaaggaagttttttataataatagcttaaaagctttagaggaagacaagactattgaagataagctttttaaaaagattgttacatattgtaatgattgtaatttagattttactcaaaaggatataaataaaggtatttttggagacccaacagaagtagctttaataaaagcctgctttaaaaatacaaaggatgtaaaatctatattagatatagggaagaaagtgtatgaggaaccctttgattctaataggaagattatgtccgtagtggtaagagaacaaggaaataatacattatatataaaaggggctccagagagaataatagaaagatgcaaatacattcacattaatggaagaatagagcctttaaaagaaacttacaaaaaaaatatattaaaggcagtagaagatatgtcattaaaagctttaagatgtatagcagtaggttataaacttattgaaggatctaattttaaggggtctaatttagaaaaagatattgtttttgtaggaattggtggaatgatagacccacctagaaaagaagtagaggacgcagtttataaatgtagaatggctggaataatgcctgttatgataactggagaccataaaaatacagcctatgctataggtaaggaactgggcatagccaattcttataaacaagtaataacaggagaagaattagataagcttagtgataaaaaacttgaagatataattgataatataaaaatatttgcaagagttagtccaaatcataagctgagaatagttgaaaccttcaaaaggggaaatagagtagtagcaatgactggagacggcgtaaatgatgctccagcagttaaggaagcagatattggtatatccatgggaatgactggcacagatgttacaaaggaagcatcttctatgatacttttggatgataattttaaaactattgtagacgcagtagaagagggaagagttatatatgataatataagaaagtttataagatatttactatcctgcaatttgggtgaagttctaacagtatttttagcttctataatgaatcttccaacaccgctacttcctatacaaattttatttgtaaatttagccacagatggtttacctgctatggctttaggagtagatcctgcagatatagatattatgaaacaaaaaccaagaggaaaggatgagagtatattttccagagggttaaaggaaaagatattaataaggggaagtttaataggtatatgtacggttctttccttttacatggcatatgcttataatatggatttaagaacatgtagaaccattgccctaagtaccttaatactatctcaattaatacatgtatttgaatgtagatcggaaagacattctatatttgaaataaagtatttaaccaatatttatttaataatggcagtagctgtatccatagtgatgctattttgcgttatatatattccattttttcaaaaaacctttcatacttcaagtataagtttaagtcagtggtttatagtaatatttttctcaggaatcatatcacttataaacagtatatatcttttaattagaaatagaaaaagataa

SEQ ID NO: 107958 - protein, 754 aa, Clostridium tetani
MAAPTAKVMRDGKIKVINAMELVIGDVILIESGDRVPADSIILDNYSLMLDESLLTGESVGVNKNGKGKNKDIYMGTIVLKGKAMAKIMATGMNTEMGKIAGMLDNIEKDKSPLKEKLNSLGKVLVVICLIICIVVTVVGIMRGNNKYEMLLLGVSLAVAAIPEGLPAIVTVSLALGVFRMLKKNALVRRLPAVETLGCTSIICSDKTGTLTENKMKVKEVFYNNSLKALEEDKTIEDKLFKKIVTYCNDCNLDFTQKDINKGIFGDPTEVALIKACFKNTKDVKSILDIGKKVYEEPFDSNRKIMSVVVREQGNNTLYIKGAPERIIERCKYIHINGRIEPLKETYKKNILKAVEDMSLKALRCIAVGYKLIEGSNFKGSNLEKDIVFVGIGGMIDPPRKEVEDAVYKCRMAGIMPVMITGDHKNTAYAIGKELGIANSYKQVITGEELDKLSDKKLEDIIDNIKIFARVSPNHKLRIVETFKRGNRVVAMTGDGVNDAPAVKEADIGISMGMTGTDVTKEASSMILLDDNFKTIVDAVEEGRVIYDNIRKFIRYLLSCNLGEVLTVFLASIMNLPTPLLPIQILFVNLATDGLPAMALGVDPADIDIMKQKPRGKDESIFSRGLKEKILIRGSLIGICTVLSFYMAYAYNMDLRTCRTIALSTLILSQLIHVFECRSERHSIFEIKYLTNIYLIMAVAVSIVMLFCVIYIPFFQKTFHTSSISLSQWFIVIFFSGIISLINSIYLLIRNRKR

SEQ ID NO: 107959 - DNA, 2493 bp, Clostridium tetani
  CDS (1)..(2493)
atgttaatatacatacttttagcagcagctttaatttcaggttttttaggtgaaactagtgatgcaataataattttcctagttattatactgaattcagtaattggtgtggttcaggaatcaaaggcagaaaaggcattagaagctttaaaaaagatgtctacacctaaggcaatggttagaagagaaggagaacttagagaaattccttcagaggaagtagtacctggagatataataattttagatgcaggaagatatgttccctgtgatttaagacttatagaaaccgcctcattaaaggtagaggagtcagctttaacaggagaatctgttccagtagataaggatgcaaacttagttttaagtggagaggatacagccttaggagatcaaaagaatatggcttttatgtccactttagctacctatggaagaggagttgctatagcagtagctacaggtatggatactgaaattggtaaaatagcaaaaatgttagatactgaagaaaaaaatttaaccccattacaaaagaaattagaagaactcggaaagactttaggattaggtgcattagctgtttgtgctttaatgtttggcgttggtttacttcaaaaaagagatatgtttgaaatgttcttaatagctataagtttagcggtggcagcaataccagaaggacttccagctatagtaactatagttttagctatgggagttcaaaaaatgataaagaaaaatgccatagtaagaaagcttccagcagtagaaaccttaggagctgttaatgtaatttgctcagataaaacaggaaccctaactcaaaataaaatgaccgttactaaattttatgcagacacatattatggagatatatctacattagatatagaaaaatctggtcataaacttttattggaaaatttaatactgtgtaatgatgcaacttactcagaagataaacaaacaggagatccaacagaaatagcattattagaagcaggatataaatatggtataaaaaaggaagagttagaggaggttcaccaaagagtaaatgaattaccttttgattctgatagaaaattaatgactacagtcaataaatatgataatgaaatatatgttatgacaaagggagctatagacaatttatttaatatatgtactcatgtttatagaaatggtgagattgtagagcttacagaggatataaaaaatgagttcatggaaggtgctaataatatgtcagaagatgctctaagggttttaggcggagcatataaaaaaatatctcaagatgaaataaattcagataatttagaaggaaatttaacattaataggacttgtaggaatgatagaccctccaagagaggaagttaaagattctataatggaatgtaaaaaatcaggaataaaaactgtaatgattacaggggaccataaggatacagctttagctattgcaaaggaattagccatagcagaagataaatctcaggctgtatttggaaaagaattagataaaatgtctgatgaagagttaagccaaagaatagataatttaagagtttttgcaagagtttctccagaacataaggttagaatagtaaaagcctttaaagaaaagggaaatatagtatctatgacaggagatggagttaatgatgcaccttctttaaaaatagcagatgtaggtgttgctatggggattacaggaacagatgtagcaaagggagcttctgatgtaatacttacagacgataatttttctactatagtttcagcagtaaaagaaggaagaaatatatttaataacattaaaaaatctataatctttttactatcttgtaatataggggaaattatatctctattctttgctatacttttaggatggccagcaccattaagaccaattcatcttttatgggttaaccttataacagatactttaccagcgttatccttaggaatagacccaggagatcctgatgtaatggatgaaaaaccaagagatccaaaagctagtctttttgcaggaggaacaggaacatttttaatattaaatggattgttaataggatttttaacactggcggctttcatagttggagttaaagtgtatacaaatagcactacactatttcctttaatccctgaggatgtatcaaaagaagcattgactcatgctcaaactatggcttttgtagttttaagtgtatctcaattatttcactcacttaatttaagacaccctaaaaaatccatattccaattgggcatatttactaataagtatttaattggagctataatttttggtatagtattacaagatatagttataacaatacctttcttagccaatatatttaaagtatatgatctattgctaaaggactggttattggttggaatactttctataatacctttaattgtaaatgaaatagctaaaatatttataagagccagatctaaatag

SEQ ID NO: 107960 - protein, 830 aa, Clostridium tetani
MLIYILLAAALISGFLGETSDAIIIFLVIILNSVIGVVQESKAEKALEALKKMSTPKAMVRREGELREIPSEEVVPGDIIILDAGRYVPCDLRLIETASLKVEESALTGESVPVDKDANLVLSGEDTALGDQKNMAFMSTLATYGRGVAIAVATGMDTEIGKIAKMLDTEEKNLTPLQKKLEELGKTLGLGALAVCALMFGVGLLQKRDMFEMFLIAISLAVAAIPEGLPAIVTIVLAMGVQKMIKKNAIVRKLPAVETLGAVNVICSDKTGTLTQNKMTVTKFYADTYYGDISTLDIEKSGHKLLLENLILCNDATYSEDKQTGDPTEIALLEAGYKYGIKKEELEEVHQRVNELPFDSDRKLMTTVNKYDNEIYVMTKGAIDNLFNICTHVYRNGEIVELTEDIKNEFMEGANNMSEDALRVLGGAYKKISQDEINSDNLEGNLTLIGLVGMIDPPREEVKDSIMECKKSGIKTVMITGDHKDTALAIAKELAIAEDKSQAVFGKELDKMSDEELSQRIDNLRVFARVSPEHKVRIVKAFKEKGNIVSMTGDGVNDAPSLKIADVGVAMGITGTDVAKGASDVILTDDNFSTIVSAVKEGRNIFNNIKKSIIFLLSCNIGEIISLFFAILLGWPAPLRPIHLLWVNLITDTLPALSLGIDPGDPDVMDEKPRDPKASLFAGGTGTFLILNGLLIGFLTLAAFIVGVKVYTNSTTLFPLIPEDVSKEALTHAQTMAFVVLSVSQLFHSLNLRHPKKSIFQLGIFTNKYLIGAIIFGIVLQDIVITIPFLANIFKVYDLLLKDWLLVGILSIIPLIVNEIAKIFIRARSK

SEQ ID NO: 107961 - DNA, 2499 bp, Bradyrhizobium japonicum
  CDS (1)..(2499)
atgaccaagccaccgaacaaccaggcgagccaattctggcgcctgccgacggatgcgctctgcacccggctcggctgctccttgcagggcctgactgcgaccgaggccgccgaacgcctcggccgtttcgggccgaacagcgacgcgccgccgcgcatcgagggggcggcgcgtgcagtcctgcgccggctgctggagccgctgtcgctgatcctgctggtcgccggcatcgtctcgatgctgaccggcgacgacgtcggcgggctcatcatcgtgctgattctcgcgggctcgatcgggctcgacaccatccaggagggccacgcggtccgcgccgccgagatcctccgccgttcggtggcgctcaaggccgaggtcaggcgcgacggcgccttctgcgagatcgacgtcgaccacgtcgttccgggcgacctcctgcgtgtccgcgccggcgacatcatcccggcggatgggttgatcctggagagtaccgccttcacggccggggaagccgcgctcaccggcgagccctatccggtgcagaagcgcgccggcgccgccaccgaccccgacgacacctcgaacgcactgttccgcggcgccgtggcgcagacgggcgaggcgatcgcgctcgtcgtcaggaccggccgcgacaccgtgttcggcgcggccgcctccgcgctcgccgagacgcaggccccctccccgttcgagcgcgatttgcgcgagttcggcctcgtgatcgcgcgggccacgctcgcgctggtgctggtcgtgctcaccgtccgcgtcgtgttcggccggccagtgctcgattcgctgctgttcgcggtcgcgctcgcggtcgggctgacgccggagctgctgccgatgatcactacggtgacgctgtcgcgcggcgcacttcggatggccggccgcaaggtgatcgtgaagcggctggccgcgatccacgacctcggggccatgacggtcctgtgcaccgacaagaccggcacgctgacatcggccgagatcacgctcgcccggagcctcgacgccgagggcaaggacaacgcccgcgccgcgcagctcggcgccatcgcggcatcgctcggcggcgatcgcggctcgctcgatgccgcgctcgtcgccggccggccggacgccgcacagggctggaccttggccggacggcaggccttcgacttctcgcgccggctgggatcggtgctcgcgaccggccccgaaggcacgctgctcatcgtcaagggcgcgccggaagccgtgctcgcattgtgcacgatggacgagcgcgcgcgcacggctgcgctggcgcgcgtgcgtgagctcgcgagcgagggcctgcgcaccgtggcgatcgcctcgcgggcgtggagcggcgtgctgcgcgaggtcgagacggaggacgagaccgatctcgccttcgagggcttttgcgccttcgccgatccgccgaagccgacggccgcggccgcaatcgcgcagctcgcggcgcgcggcgtgggcctgaagatcctctcgggcgacgaccccgtggtggtgaagcggctcgcgagcctggtcggactgaaccccgagcgcgtactgtcggggaccgacgttgcggcgctcagcgacgcggcgctcgccgtgcaggtgcgctccacggacgcgttcggccgcctcgcgccggaccagaagtcgcgcatcgtgagggcgcttcaggcgggcggcgaagtggtcggcttcctcggcgacggcatcaacgacgcaccggccctgaaggtcgccgacgtcggattgtcggtcgacggcgcgaccggtgtggcgcaggccgccgccgacatgatcctgctggcttcggatctcgaggtcgtcgccgacggcgtcgcggaaggacggcgcaccttcgccaacatcctcaaatatgtccgcatgggcgcaagctcgaatttcggcaacatgctgtcgatggcgatcgcctcgatggtgctgccgttcctgccgatgctgccgacgcagatcctgctcaacaacctgctgtacgatctctcggagctcggcattcccttcgaccgggtctcggcgcaggcaacggcgcagccgcaggtgtggagcatgtcgaacctggcgcgcttcgccgcgatcatgggaccgctgtcgtcggtgttcgacttcctgaccttcggcgccctcatcatgctgtttcacgcatcgcccggcgagttccgcaccgcctggttcatcgaatctatggcgacgcagatcctggtgatcttcgtcatccgcaccaacggccgaccgtggcgcaattggcccgatccagtgctgtcggcctcgtcgctgatcgccttgctggtcgcgatggtcgtgccgttcaccccggtcggcacctggttcggctttgtcgcgccgccgccgttgatgatggccggcatcgcgctgctcgtcgtcgtctatctcgcctgcgccgagctgctgaagcccttcgcgatccgcagcaaacgcaagcgatag

SEQ ID NO: 107962 - protein, 832 aa, Bradyrhizobium japonicum
MTKPPNNQASQFWRLPTDALCTRLGCSLQGLTATEAAERLGRFGPNSDAPPRIEGAARAVLRRLLEPLSLILLVAGIVSMLTGDDVGGLIIVLILAGSIGLDTIQEGHAVRAAEILRRSVALKAEVRRDGAFCEIDVDHVVPGDLLRVRAGDIIPADGLILESTAFTAGEAALTGEPYPVQKRAGAATDPDDTSNALFRGAVAQTGEAIALVVRTGRDTVFGAAASALAETQAPSPFERDLREFGLVIARATLALVLVVLTVRVVFGRPVLDSLLFAVALAVGLTPELLPMITTVTLSRGALRMAGRKVIVKRLAAIHDLGAMTVLCTDKTGTLTSAEITLARSLDAEGKDNARAAQLGAIAASLGGDRGSLDAALVAGRPDAAQGWTLAGRQAFDFSRRLGSVLATGPEGTLLIVKGAPEAVLALCTMDERARTAALARVRELASEGLRTVAIASRAWSGVLREVETEDETDLAFEGFCAFADPPKPTAAAAIAQLAARGVGLKILSGDDPVVVKRLASLVGLNPERVLSGTDVAALSDAALAVQVRSTDAFGRLAPDQKSRIVRALQAGGEVVGFLGDGINDAPALKVADVGLSVDGATGVAQAAADMILLASDLEVVADGVAEGRRTFANILKYVRMGASSNFGNMLSMAIASMVLPFLPMLPTQILLNNLLYDLSELGIPFDRVSAQATAQPQVWSMSNLARFAAIMGPLSSVFDFLTFGALIMLFHASPGEFRTAWFIESMATQILVIFVIRTNGRPWRNWPDPVLSASSLIALLVAMVVPFTPVGTWFGFVAPPPLMMAGIALLVVVYLACAELLKPFAIRSKRKR

SEQ ID NO: 107963 - DNA, 2553 bp, Bradyrhizobium japonicum
  CDS (1)..(2553)
atgagcgccacggaagccaaaagaccggccgggctgagcgaggtcgaggctcgggcgcggttggaagaggacggcgccaacgaattgcctcggcccgaacgacgcagtccgctccgcatcgtcatggaagtgctgcgcgagccgatgctcgtgctgctgctttgcggtgggctggtctacctcgtgctcggcgatctcagggaagcgctgatcctcttggtcttcggtgcgatgtcgatcgtgatcacggtggtgcaggagacccggaccgagcgcgttctggaagccttgcgcgacctgagcagcccgcgcgcgctcgtggtgcgggacggtgcgcgtcggcgcatcccgggccgcgaggtcgtgcgcggcgacctgctcgtcctcggcgaaggcgaccggattccggccgacgccgcgttggtggacgcgcgcgatctgcagatcgacgagtcgctgctgaccggcgagtcggtgcccgtccgcaagcgggctgccggcaaggccatgtcagccgatcagcggccgggcggcgaggatcagcccttcgtgtattcaggttcgctcgtcgtgcgcggcgaggggctggcgctggtcgaggccaccggcccgcgcagcgagatcgggaagatcgggctgtcgctgcgcggcttgcaaaccgagccgccccggcttcggcaacagaccgcaagactggtgcggctctgcttcctcggcggcgcggtcgtcagcgtggccgccgtcgcgctctacggagtcttgcgtggggactggctgcaagcgctgcttgcgggcatcgccatcggcatggcgatgttgccggaagaatttggcgtcgtgctcacggtcttcatggcgatgggagcctggcggatttcgcaggcgcgcgtcctgacgcggcgagccgcagccatcgaggtcctcggctctgcgaccgtgctgtgcaccgacaagaccgggacactgacgcagaaccagatgtccgtcgcggagttgcggctgctcgacggggcacgcatgcgtccggagagcgccgggcgggatgacgccaggcctgaattcatcgagctggcgcgttgcggtgccctggcgagctctccggaaccgttcgacccgatggagaaggctctgcatctgttcgcgcaggacgccttgcggggaggcgatgcgccggacggcgaccggacgctggtgcgtacctacggtctgcgccccgagctgctggccatgacgcaggtctggcgcacggccggccgggcggacctcgtcgcatgcgccaagggcgcacccgaggcgatcgcgcgcctgtgcaggatgaacgctgctgatcaggattcggtgcgagatgccgccagcgcgatggcgagggacgggcttcgcgtgctggggatggccgttgccgcctgcgatgacgcttcactcccgccgacccaggaggatttcgcgtttcgatttgtcggcttggtcgggcttgccgatccgctgcggccccatgtcccggaggcggttcgcgaatgccgcgcggcggggatccgcgtcgtcatgatcacgggcgattatccggcaaccgccgttgccatcgcgaaccaggccggactcgatgtccgtgacgtcatgaccggcgatcaggtcaggctggcggatgatccggagctcgcgaaacgcgtcgggcatgtcaacgtgttcgcccgggttttgccggagcagaagctgcgcatcgtccaggcgatgaagctcaacggcgagatcgtggcgatgaccggcgacggcgtcaacgacgcgccttcgctcaaggccgcccacatcggcatcgcgatgggagggcgcgggaccgacgtcgcgcgagaggcgtcggcgatcgtgctgctcgacgacgatttcggttcgatcgtgtcggctattcgtctgggccgccgcatctacgacaatctgcggaaggcgatggccttcatcttcgccgttcatgtcccgatcgcgggacttgcgctgctgcccctggtcttcgggctgccgctgatcttcagtccggtgcacatcgcatttctggagctgatcatcgaccccgtatgctcgctggtgttcgaggcggagcgggacgagcgcgatgcgatgacgcgtccgccgaggcggcctgatgccgcgctgttctcgtgggcactggttggctggagcgtgcttcagggggccctcgcatttgccctgaccgccatcatattcgtcggcgcgcttcgctccggcctcgtcgccgacgaggcgaggacgctcgctttcgtgacgctcgtcgtctgcattgtcgctctggtcctggtcaatcggtccttcagcgcatcgttcgcgtccgcgttcttccgtccaaatcccgcattgacctggatcttcgcgggggtggctctcgttctcgccaccgcgctgctctggccgccggcctccagcctgttccgctttggtccgctgcatgcggacgatctgatgatcgcgctcggcgcggggctgctggtgctgacggtgctcgaattgctgaaaccgctgtgggcgcggcggcttcggttctag

SEQ ID NO: 107964 - protein, 850 aa, Bradyrhizobium japonicum
MSATEAKRPAGLSEVEARARLEEDGANELPRPERRSPLRIVMEVLREPMLVLLLCGGLVYLVLGDLREALILLVFGAMSIVITVVQETRTERVLEALRDLSSPRALVVRDGARRRIPGREVVRGDLLVLGEGDRIPADAALVDARDLQIDESLLTGESVPVRKRAAGKAMSADQRPGGEDQPFVYSGSLVVRGEGLALVEATGPRSEIGKIGLSLRGLQTEPPRLRQQTARLVRLCFLGGAVVSVAAVALYGVLRGDWLQALLAGIAIGMAMLPEEFGVVLTVFMAMGAWRISQARVLTRRAAAIEVLGSATVLCTDKTGTLTQNQMSVAELRLLDGARMRPESAGRDDARPEFIELARCGALASSPEPFDPMEKALHLFAQDALRGGDAPDGDRTLVRTYGLRPELLAMTQVWRTAGRADLVACAKGAPEAIARLCRMNAADQDSVRDAASAMARDGLRVLGMAVAACDDASLPPTQEDFAFRFVGLVGLADPLRPHVPEAVRECRAAGIRVVMITGDYPATAVAIANQAGLDVRDVMTGDQVRLADDPELAKRVGHVNVFARVLPEQKLRIVQAMKLNGEIVAMTGDGVNDAPSLKAAHIGIAMGGRGTDVAREASAIVLLDDDFGSIVSAIRLGRRIYDNLRKAMAFIFAVHVPIAGLALLPLVFGLPLIFSPVHIAFLELIIDPVCSLVFEAERDERDAMTRPPRRPDAALFSWALVGWSVLQGALAFALTAIIFVGALRSGLVADEARTLAFVTLVVCIVALVLVNRSFSASFASAFFRPNPALTWIFAGVALVLATALLWPPASSLFRFGPLHADDLMIALGAGLLVLTVLELLKPLWARRLRF

SEQ ID NO: 107965 - DNA, 2826 bp, Synechococcus elongatus
  CDS (1)..(2826)
atgacctcctccaacgcctcctccaacattgatcgtgactccgtttggcatgctctgagtgccgatgaagccattagccaccttgggagcgatcgccaacaggggttgagttttgcagaagtgcaacggcgacagacccaatatggccgcaatgaacttgttgacaatggccgccgcccccgctggcagatcttcacggatcagtttcgcaatgtgatgctgatcatgctgctggtggtggcgttcatctctggcacattggagattctcgaatccctccaagaaaacaggattcccttgcccaaggatgcaaccgcaatcctggtggtggtgattctcaatgccattttggggtacgtccaagaagcccgtgctgaggaagctctagcagccctgaaaaatatggcggcacccaaggtgcgtgtcctgcgcgaaggcaaagtcatggacattgactcccctgaactggttgtcggggatattttctttttggaaactggggtaaaagtggctgccgatggtcgccttctagaaaccgtcaacctgcaaatccgcgaggctgcccttacaggtgaagcagaagctgtcagtaaagatgctgcgaaaattttacccattgatactgaagtgggcgatcgcgccaatctagtgtttgcaggcacagaggttagccaagggcgaggggtcgccgtcgtcaccgcgatcggcatggataccgaactggggaaaattgctgctgccctccaaggggtcgagcaggaacccacaccactgcaaaaacggatgaccgagctgggaaatcgcttagtggggttttccttggtgctggtgagcattgttgtgattgcgggggggctgtacgatccttcactgctgcggcatctcattgaagtttccctgagtatggcagtggcagtggtacccgaaggcttgcctgctgtgattaccgtcacccttgccttgggaacgcaacggatggtgaaacgccatgccctgattcgtcggctgccggcagtggagacgttgggaagtgtgacagtcatttgctccgacaaaaccggtaccctcacccaaaacaaaatggtcgtgcaggcgatcgccacaacgtcctatcgcgccaaggtgagtggcaatggctatgaacctaagggggacttttacgacgccaataccgatgaccccttagccctgtacgaacggcacctactgctgctcgccggggcactgtgtaatgatgccctgcttaaacaacacgcagccgaatgggtgatcctcggtgaccccacagaaggctccctgctccccttggccgctaaggggggcattgatctgaaagtgctacgggaaacagcggagcgggttgccgagtttccctttgatgccaatcgcaagcgcatgagtacgttctatcgccgtgagtctgttcctgatcttcccgccaaggaaccctactggatgatcaccaaagggtcgcccgaattgatcctagaacgctgccaatggcggcaggtgggacaggacattcaacccctaacactggcggagcgccaagagattctcgctgaaaacgatcgctttgccgctcagggtctacgggtcttggggatcgcccatcgctactggtcagagttaccgccgccagagagcgtcgagaccagtgagcaggggttaacttggttggggctggtgggcattcttgatcctcctcgcccggaggtgctggaggccgtcgccacctgtcgcactgccggcattcgcccgattatgattacgggcgatcatcaactgactgcccaggcgatcgccagtcaaattggcatctgtgagtggggcgatcctaccctcaccggtcggaccattgaaaaaatgagtagcgaggaattggatgctgtcactcccaccgtcagcgtctatgcccgggtctccccagaacataaactgcgaattgtcaaatcgctgcaacgtcacggtgagattgtggccatgactggcgatggtgtcaatgatgcccctgcccttaaacaagcggatatcggggtagccatggggattacgggtactgacgtcaccaaggaagccagtgacatggtgctcttggatgataactttgccaccattgtggctgctaccgaggaagggcgagtcatttacagcaatatccgtcgctttattagatacattctcggctccaacattggtgaagtaattacaatcgcctgctcacccctcctgggactaggaggtgttcctctaacgcccttacagattctctggatgaacttggttaccgatggcctgcctgcccttgcccttgccgttgaaccgggagatcccgatgtcatgaagcgccctcccgttaagccgaacgagagcatttttggccggggcttgggttcctatatgattcgcatcggtttgatcttggcgctcgttggcatttccctaatggtatgggcctacagctacgccagtgaacatttagaggggggactggatcccagacgttggacaaccatggtctttaccaccctctgcctggcccaaatgggtcacgccctcgccgctcgttcaagtacacgactgaccattgaaatgaaccccacctccaacccctttgtttgggcatcggtcattttgacaacgattctacaactcctgttgatctatgcaccacccctgcggcagttttttggcacctacctgctctcgggaactgagctagctgtgtgtattggctttagcatgcttgtctttgtgtgggtagagctcgagaaactggtgttgcggctattcaataaaggccaagaactcaagctattggaataa

SEQ ID NO: 107966 - protein, 941 aa, Synechococcus elongatus
MTSSNASSNIDRDSVWHALSADEAISHLGSDRQQGLSFAEVQRRQTQYGRNELVDNGRRPRWQIFTDQFRNVMLIMLLVVAFISGTLEILESLQENRIPLPKDATAILVVVILNAILGYVQEARAEEALAALKNMAAPKVRVLREGKVMDIDSPELVVGDIFFLETGVKVAADGRLLETVNLQIREAALTGEAEAVSKDAAKILPIDTEVGDRANLVFAGTEVSQGRGVAVVTAIGMDTELGKIAAALQGVEQEPTPLQKRMTELGNRLVGFSLVLVSIVVIAGGLYDPSLLRHLIEVSLSMAVAVVPEGLPAVITVTLALGTQRMVKRHALIRRLPAVETLGSVTVICSDKTGTLTQNKMVVQAIATTSYRAKVSGNGYEPKGDFYDANTDDPLALYERHLLLLAGALCNDALLKQHAAEWVILGDPTEGSLLPLAAKGGIDLKVLRETAERVAEFPFDANRKRMSTFYRRESVPDLPAKEPYWMITKGSPELILERCQWRQVGQDIQPLTLAERQEILAENDRFAAQGLRVLGIAHRYWSELPPPESVETSEQGLTWLGLVGILDPPRPEVLEAVATCRTAGIRPIMITGDHQLTAQAIASQIGICEWGDPTLTGRTIEKMSSEELDAVTPTVSVYARVSPEHKLRIVKSLQRHGEIVAMTGDGVNDAPALKQADIGVAMGITGTDVTKEASDMVLLDDNFATIVAATEEGRVIYSNIRRFIRYILGSNIGEVITIACSPLLGLGGVPLTPLQILWMNLVTDGLPALALAVEPGDPDVMKRPPVKPNESIFGRGLGSYMIRIGLILALVGISLMVWAYSYASEHLEGGLDPRRWTTMVFTTLCLAQMGHALAARSSTRLTIEMNPTSNPFVWASVILTTILQLLLIYAPPLRQFFGTYLLSGTELAVCIGFSMLVFVWVELEKLVLRLFNKGQELKLLE

SEQ ID NO: 107967 - DNA, 2793 bp, Streptococcus mutans
  CDS (1)..(2793)
atgagtagcacagaacaagaaacgatgcagggaatagaaaaacttgtatctgatgatgtttatgaagctgcacaaaccagttcaaatggacttgaggcttctcaagttcaaaagcggcaagagttatatggtctcaatcggttgaatgaagtcaagggagagcctgtttggctgaaatttattaaaaattttaccagtatgatggcactcttgctctgggcaggcggtgcagttgccttctttagcgggacaattgaattggggattgccatttggcttgttaatgttattaatggtcttttctcatttttccaagagtatcgggccagtcaggctactgaagccttgaaaaagatgctcccttcatacgccagagtcatccgtgatggtagggagagtaagattttagcagaagaactggttcccggagatgtcatgctgattgaggaaggagatgccatttcggcagatgggcgtattatcttttctactgatttgcaggtcaatcagtctgctttgacgggtgagtccaatcctgttcggaaaaataattatcctgttcttgattcagacacggaaaatttggaatttaaaaatatggtttttgctggaactagtgtatcaaatggcagtgccaaagttgtggtaacgaaaatcgcaatggcaaccgaatttggtaaaattgctgatttgacccaatcaatggaagatgaaaaaagtccgctgcaaaaggaattggacttattaactaagcagatttctttgattgcggtaactattggtatctttttcttgctggcttctgttttctttgttaaacaacctttagcccaagcctttatcttttctctgggaatgattgtcgcttttatcccagaaggacttttgccaacagttactttgtcccttgccatggccgttcagagaatggccaaggagcatgccttggttaagaaattatcttcagtagaaaccttgggtgcgacctcagtcatttgttctgataagacgggaaccttgacccaaaatgaaatgacagtcaaccatgtttggactttaaatcatgaatacgaagtgacaggtcaaggttatgcttctgatggacatttagaaagaaataatcaggaagttacagttgccaatgaagagggtttagagttcttactgagagcagcagcactttgttccaatgcacgtgttctagcacctagtgatggaaatcctcgttatacggttctaggagatccaacagaagcctgcttaaatgttgtggctgaaaaagcagggattgacttaactgaaaatgaaacttgggcacaaagagtgagagaattaccgtttgattccagccgtaagcgaatgacgactgtgcatcgactaaaacaacctgtaaatggttcgtccttcatttcaattaccaaaggagctcctaaagagacctctgagctttgtaacaaggtttatgagaatggtcagctgagagatttgactgatacagatcgggaagctattttagcggctaatgatgattatgcgcgtcaaggtttgcgtgttttagcagttgcctatcgtaatctagaagaagtagctgaccttcccaaagccttgtctgactatagtccagaagtcattgaagaggatatggtttttcaaggtttagtggttatggcagatcctccgcgtgaagaagtggcagcggctgttgagttatgccgtaaggcaagcattcgtattgtcatggttacaggagattatggtttaacagctgtcagcattgccaaacggattggtattgtccaaggggaaaatcctcgtgtggttactggcctagaattaaaagatatgtcagatgatgacttgaaacaggccttatcagatgaagttgtctttgcccgtgtagcgcccgaacaaaaatatcgtgttgttaccaatctgcaagctttgggacatgttgttgctgtaacaggtgatggtgtcaatgatgccccagccttgaaaaaagctgatattggagtggcaatggggattacagggacagatgttgctaaggaatctgcggatatgattttgacagatgacaattttgcttctattgtacgcgctgttgaagaggggcgtgctgtctataccaacattcggaaattcctgacttatatctttaatagtaatacctcggaggccgtgccttctgcagcttttcttttttccaaaggaggtattcctttacctttaaccgttatgcagattttagcgattgacctaggaacggatatgattcctgcccttggtttaggcgtcgaagaagctgaagatgggattatggaacgtccccctcggcgtccaacagaccgtctgctcaacaaaggtttattgataaaggcctttatttggtatggccttttagaagcagctattgctatgggagctttcttctttacttatgctattggcggcggtttaagtgggcatttggcgtcatcaggtcagctctatcagcaggcaacaacaatgactcttggtgctattatcttttgccagttgggaatggtgatgaatacacgtactgaaaaggcctctatctttaaagtgaaactcttttcaaataaggtcattaattttggtatgatgtttgaaattttcttattctgtcttttagcttacctaccatttttacatggtctcttcaacacggcggcaataggtgtgtggcattggctctatttgattctctgtccaattccagttttgtttattgaggaagctcgtaaggcttatatgagaagaaaacactaa

SEQ ID NO: 107968 - protein, 930 aa, Streptococcus mutans
MSSTEQETMQGIEKLVSDDVYEAAQTSSNGLEASQVQKRQELYGLNRLNEVKGEPVWLKFIKNFTSMMALLLWAGGAVAFFSGTIELGIAIWLVNVINGLFSFFQEYRASQATEALKKMLPSYARVIRDGRESKILAEELVPGDVMLIEEGDAISADGRIIFSTDLQVNQSALTGESNPVRKNNYPVLDSDTENLEFKNMVFAGTSVSNGSAKVVVTKIAMATEFGKIADLTQSMEDEKSPLQKELDLLTKQISLIAVTIGIFFLLASVFFVKQPLAQAFIFSLGMIVAFIPEGLLPTVTLSLAMAVQRMAKEHALVKKLSSVETLGATSVICSDKTGTLTQNEMTVNHVWTLNHEYEVTGQGYASDGHLERNNQEVTVANEEGLEFLLRAAALCSNARVLAPSDGNPRYTVLGDPTEACLNVVAEKAGIDLTENETWAQRVRELPFDSSRKRMTTVHRLKQPVNGSSFISITKGAPKETSELCNKVYENGQLRDLTDTDREAILAANDDYARQGLRVLAVAYRNLEEVADLPKALSDYSPEVIEEDMVFQGLVVMADPPREEVAAAVELCRKASIRIVMVTGDYGLTAVSIAKRIGIVQGENPRVVTGLELKDMSDDDLKQALSDEVVFARVAPEQKYRVVTNLQALGHVVAVTGDGVNDAPALKKADIGVAMGITGTDVAKESADMILTDDNFASIVRAVEEGRAVYTNIRKFLTYIFNSNTSEAVPSAAFLFSKGGIPLPLTVMQILAIDLGTDMIPALGLGVEEAEDGIMERPPRRPTDRLLNKGLLIKAFIWYGLLEAAIAMGAFFFTYAIGGGLSGHLASSGQLYQQATTMTLGAIIFCQLGMVMNTRTEKASIFKVKLFSNKVINFGMMFEIFLFCLLAYLPFLHGLFNTAAIGVWHWLYLILCPIPVLFIEEARKAYMRRKH

SEQ ID NO: 107969 - DNA, 2682 bp, Streptococcus mutans
  CDS (1)..(2682)
atgttcaaaaaacaaaaaagggacagtttttacgtccaagatgaaaaaactgtcctatctggcctagaatcttctaagaagggattgaccagtactcaagctaaacagcgcttagctgattatggctacaatgaattggaagaagatgaaaaacgtactattcttgccaaattcattgatcaatttaaggatttgatgattatcattttgcttgttgccgcagcgctttcggttatcactgaaggaatgggggggctaacggatgccatcattattctagttgttgttgttttaaatgcagccttcggtgtctatcaggaaggacaggcagaagcagccattgaggccttaaaatctatgtctagtccacatgcacgtgttcggcgtgatggccatgttactgaaattgattccaaagaattagtaccaggtgatgtcgttcttcttgaagctggtgatgtggttccggcagatatgcgtcttttggaagcagcttcgttgaaaattgaagaggcagccttaacaggtgagtctgtgccagttgaaaaaagtgtaactgttgcaattgcatcagatgctggtattggtgatcgtttgaatatggcctatcaaaattcaaatgttacttatggtcgtggtatgggggttgtgaccaatactggtatgtacacagaagtcggccatattgctggcatgttagctaatgcagatgaaacagatacgccattaaaacagagtttagataatctatccaaggtattgacatatgttatcattattattgcgattattacttgcctagttggtatctttgttcgtcatgaagagcctcttgaaggtttgatggttgctgttgctttggctgttgctgccattcctgaaggacttccagccattgtaacagttgtcctttcacttggtacgaaaacacttgccaaacgtcagtccattgttcgtaaattaccagctgtagaaacgcttggttctactgaaatcattgcttcagataaaaccggtacgctgaccatgaatcaaatgactgttgagaaagtctattataatggtagattagttgatgctaatgatgacattgacgttaataatatggctcttcgcgttatgaactttgctaatgacagtaaggttgatgccaatggtaaattaattggtgatcctactgaaacagctcttgttcaatatggttttgatcataatttcgatattcgcgaagtacttaaagctgaactacgtgtcgctgaattgccatttgattctgatcgtaagctcatgtcaacgattcataaacttgatggtgagaaatatctgattgctgtcaagggagcaccggatcaattgctcaaacgtataacgcaaattgagatagatggtagtattcgtccaatcactgaggacgataaaaaagccattcttgatatgaacaagtcgcttgccaaacaggcgcttcgtgttctcatgatagcttacaaatacgagtctgaaattccaaaattagaaacggcagtcgttgaaaatgatttgatttttgctggtcttgtggggatgattgacccagagcgtccagaagcggctgaagctgttcatgtggctaaagaagccggcattcgtccaatcatgattacaggtgatcatcaagatactgctgaagccattgccaaacgtttgggaattattgatgatgatggaattgatcatgtcttcactggtgctgaactcaatgaactttctgatgaagaattccaaaaagttttcaaacagtattcggtttatgcgcgcgtgtcaccggagcataaggttcggattgtcaaggcttggcaaaatgatggtaagattgttgctatgacaggtgatggggttaatgatgcgccatctcttaaaacggctgatattggtattggtatgggaatcacaggtactgaagtatctaagggtgcttctgatatggtgcttgccgatgataactttgcaaccattattgttgcggttgaagaaggacgtaaggtcttctccaatatccaaaaatcaattcagtacctgctatctgccaacatggctgaagttttcaccatcttctttgcaactctctttggttgggatgtgcttcaacccgttcatctgctctggattaatttggtgacagatactctgccagccatcgctcttggtgttgaaccggctgagcctggtgtgatgacccataaacctcgtggacgcaagtcaagcttcttctcaggtggtgttatgggagccattatctatcaaggtattctacaaactcttcttgtacttggcgtttacggctgggcagttttctttcctgaacatgcgacacgtacagaaattcatgcagatgctcttaccatggcctttgcaacacttggtttgattcaattggtacatgcttataatgtcaaatcggtttatcagtccatttttaaggttggtttctttaaaaacaaaacatttaactgggctttgccgactgctttgattattatgcttgctaccattgtcattccaggatttaatagattcttccatgtgtctcacttgtcggtgacccaatggtgtgttgttgtgggaggtagtttggccatgtttgttattgttgaaattgtaaaagccattcaacgggtacttggtcaagatcaaaaagcgatttaa

SEQ ID NO: 107970 - protein, 893 aa, Streptococcus mutans
MFKKQKRDSFYVQDEKTVLSGLESSKKGLTSTQAKQRLADYGYNELEEDEKRTILAKFIDQFKDLMIIILLVAAALSVITEGMGGLTDAIIILVVVVLNAAFGVYQEGQAEAAIEALKSMSSPHARVRRDGHVTEIDSKELVPGDVVLLEAGDVVPADMRLLEAASLKIEEAALTGESVPVEKSVTVAIASDAGIGDRLNMAYQNSNVTYGRGMGVVTNTGMYTEVGHIAGMLANADETDTPLKQSLDNLSKVLTYVIIIIAIITCLVGIFVRHEEPLEGLMVAVALAVAAIPEGLPAIVTVVLSLGTKTLAKRQSIVRKLPAVETLGSTEIIASDKTGTLTMNQMTVEKVYYNGRLVDANDDIDVNNMALRVMNFANDSKVDANGKLIGDPTETALVQYGFDHNFDIREVLKAELRVAELPFDSDRKLMSTIHKLDGEKYLIAVKGAPDQLLKRITQIEIDGSIRPITEDDKKAILDMNKSLAKQALRVLMIAYKYESEIPKLETAVVENDLIFAGLVGMIDPERPEAAEAVHVAKEAGIRPIMITGDHQDTAEAIAKRLGIIDDDGIDHVFTGAELNELSDEEFQKVFKQYSVYARVSPEHKVRIVKAWQNDGKIVAMTGDGVNDAPSLKTADIGIGMGITGTEVSKGASDMVLADDNFATIIVAVEEGRKVFSNIQKSIQYLLSANMAEVFTIFFATLFGWDVLQPVHLLWINLVTDTLPAIALGVEPAEPGVMTHKPRGRKSSFFSGGVMGAIIYQGILQTLLVLGVYGWAVFFPEHATRTEIHADALTMAFATLGLIQLVHAYNVKSVYQSIFKVGFFKNKTFNWALPTALIIMLATIVIPGFNRFFHVSHLSVTQWCVVVGGSLAMFVIVEIVKAIQRVLGQDQKAI

SEQ ID NO: 107971 - DNA, 2685 bp, Streptococcus agalactiae
  CDS (1)..(2685)
atgttaaaagaacagaaaaaatccttgttttacacacaaggtcaagaagaggttctaacgtctttagaatcttctcgtgaaggattatcaacgacagaagcgaaaaatcgcttagagatgtatggtcgcaatgagcttgaagaagggaaaaaacgtagtctaatagctaagttttttgaccaattcaaagatttaatgattattatcttactggttgctgcagctctctctgttattacggaaggtatgcatggcttaacggatgcattgattatcttggcggttgttatcttaaatgcagcttttggtgtttatcaagaggggcaagccgaagcagctattgaagccctcaaagatatgtcaagcccaattgcgcgtgttcgtcgtgatggtcatactattgaggtggattctaaagaactagttcctggtgacctcgttatgttagaagcaggagatgttgttcccgcagatttacgacttttagaagccgcgtctctaaaaattgaagaagcagctctaactggtgagtcagtacctgttgagaaagacatatctcaagtagtagcagaggatgcaggtattggtgaccgtgtgaatatggcgtatcaaaattcaaatgtcacgtatggtcgaggatatggtgttgttactaacacagggatgtatactgaagttggtaaaattgcggacatgttggcaaatgctgatgaatctgaaacaccattgaaacaaagtttagttcaactttctaaattattgacttacttaatcgtgattattgcggttattactttcttagtggggatatttgtccgtaaagaaggttggattgaaggattgatgacttcagttgctttagcagttgcagctattccagaagggcttcctgcaattgttacgattgtcttatcaatgggaacaaaaactcttgctaaacgcaattctatcgttcgtaaactccctgcagttgaaactttaggttctacagaaatcattgcatcagataagactggaactctgacaatgaatcaaatgactgtcgaaaaagtgtatactaatggtgttctccaatcatcttcggaagaaatttcagttgataataacactttacgtattatgaatttctccaacgatactaagattgatccttcaggaaaattaattggtgacccaacagagactgcactggtacaatttggtttagataagaattttgatgtccgtgaagttttgaaaaatgaaccacgtgtagctgagttaccatttgattcagatcgtaagttaatgtctacgattcataaagaatcagatggtcgctactttatcgcagtcaagggtgctcctgatcaattattaaaacgagttactaaaattgaagataatggcttggttcgtgatatcacggctgaagataaagaggctatcctaaataccaataaagaactcgcaaaacaagctcttcgtgtcttgatgatggcttataaatatgaaacacaaattccaagtttagagactgatattgttgagtcagatttagtattctcaggtttagtgggaatgattgaccctgagcgtccagaagcggcagaagctgttcgagttgctaaagaagcaggaattcgtccgattatgattaccggggaccatcaagatactgcagaagctattgcaaagcgtctaggtattattgatgcaaatgacacagaagatcatgtctttacgggtgctgaacttaatgaattaagtgatgaagagtttcaaaaagtatttaaacaatattctgtctatgcacgtgtttctcctgaacataaagtgcgtatcgtgaaagcttggcaaaacgatggcaaagtcgttgccatgactggtgatggtgttaatgatgctccatcgctaaaaacagcagatattggtattggtatgggaataactggtacggaagtttccaaaggtgcttctgatatggtccttgctgatgataattttgcaactattattgtggctgttgaggaaggacgtaaagtcttctcaaatatccaaaaatctattcagtatcttctttcagccaacatggcagaggtatttacaattttctttgcaactttattaggatgggatgtacttgcaccggttcaccttctttggattaacttggtaacagatactcttccagccatcgctcttggagttgagccagctgaaccaggagttatgacacataaacctcgtggtcgccagtcaaacttctttgatggtggtgttatgggagctattatctatcaaggtattttacaaactatcttagtacttggtgtctatggttgggcattgatgtatccagaacatgctggttatcgcatgattcacgcagatgcccttacgatggcctttgcaacgcttggtttaatccaattggtacatgcatttaacgttaagtcagtttaccaatcaatctttacagttggagcttttaaaaatagaacctttaactggtctattccagtagctttcattcttttgatggtgactattgttgttcctggatttaataaacttttccatgtaactcatttaagttcaacacaatggttaactgtagttatcggaagtttattgatggtagtgttaacggaaattgttaaatttatccaacgtaaattaggacaagacgaaaaagctatttag

SEQ ID NO: 107972 - protein, 894 aa, Streptococcus agalactiae
MLKEQKKSLFYTQGQEEVLTSLESSREGLSTTEAKNRLEMYGRNELEEGKKRSLIAKFFDQFKDLMIIILLVAAALSVITEGMHGLTDALIILAVVILNAAFGVYQEGQAEAAIEALKDMSSPIARVRRDGHTIEVDSKELVPGDLVMLEAGDVVPADLRLLEAASLKIEEAALTGESVPVEKDISQVVAEDAGIGDRVNMAYQNSNVTYGRGYGVVTNTGMYTEVGKIADMLANADESETPLKQSLVQLSKLLTYLIVIIAVITFLVGIFVRKEGWIEGLMTSVALAVAAIPEGLPAIVTIVLSMGTKTLAKRNSIVRKLPAVETLGSTEIIASDKTGTLTMNQMTVEKVYTNGVLQSSSEEISVDNNTLRIMNFSNDTKIDPSGKLIGDPTETALVQFGLDKNFDVREVLKNEPRVAELPFDSDRKLMSTIHKESDGRYFIAVKGAPDQLLKRVTKIEDNGLVRDITAEDKEAILNTNKELAKQALRVLMMAYKYETQIPSLETDIVESDLVFSGLVGMIDPERPEAAEAVRVAKEAGIRPIMITGDHQDTAEAIAKRLGIIDANDTEDHVFTGAELNELSDEEFQKVFKQYSVYARVSPEHKVRIVKAWQNDGKVVAMTGDGVNDAPSLKTADIGIGMGITGTEVSKGASDMVLADDNFATIIVAVEEGRKVFSNIQKSIQYLLSANMAEVFTIFFATLLGWDVLAPVHLLWINLVTDTLPAIALGVEPAEPGVMTHKPRGRQSNFFDGGVMGAIIYQGILQTILVLGVYGWALMYPEHAGYRMIHADALTMAFATLGLIQLVHAFNVKSVYQSIFTVGAFKNRTFNWSIPVAFILLMVTIVVPGFNKLFHVTHLSSTQWLTVVIGSLLMVVLTEIVKFIQRKLGQDEKAI

SEQ ID NO: 107973 - DNA, 2793 bp, Streptococcus agalactiae
  CDS (1)..(2793)
atggcttctacaaataatgtttcagatacaaacacatgttttgctaaagaggagttagaagagattttcgaagaattagggacaactcaaggtggtttatcagatgaagaggttgctgtacgtcagaaaaaatatggtttaaacctgttatctgaagtagagcaagaatcaattattttattgtttctgaaaaattttactagtcttatggcaatactattatgggttggaggatttgtggctattgtttctaatagcttagagctaggtcttgccatttggatggttaatgtgattaatggtatttttagtttcattcaggaataccgtgcaagccaagcaacacaagctctcaagaaaatgttaccatcttattcacgtgttcttagaaaaagctcagaagaaaagatattatcagagcaactagtcccaggcgatattgttcttattgaagaaggagatcgtatttcagcagatggtcgcttgattaaaacaacagatttgcaagtaaaccaatcagctttgacaggggaatcaaatcctatttataaagatagcaatgttgaaaacgaccagtctaaaacattgattgaatgtgataatatggttttcgcaggaacgacggtctccagtggtagcgcaacaatggttgttacggcaattggaatgcaaactcaatttggtcaaatcgctgatttaacacaagggatgaaatcagaaaaaagccctcttcaaagagaacttgatcggttgaccaaacagatttctatcatttcaattacggtaggaattatctttttcttagcagcgactttttttgttaaggagccagtgtcaaaatcatttatctttgccttggggatgatcgttgcatttatcccagaaggtttactacctaccgttacactttctctagctatggcagtccaacgaatggctaaagaacacgcacttgtcaaaaaactttcttcagttgaaactcttggagcaacctcagttatctgttctgataagactggtacattaacgcaaaatgaaatgaccgtcaatcatttgtggcaaaatggaaagagttaccaagtgacaggactgggttatgctccagaaggacagattctttttgaaggtgacaatatttgctttggtaatagtgatagaggagacttagaaaaacttattcgttttgctcatctctgtagcaacgctcaagtattaccaccaaatgatgaacgttcaacttatactgtacttggagatccgacagaagcttgtttgaatgttttattggaaaaatcagggataaacagacaagaaaatcgtaagtttgcaccacgtttgaaagaattaccttttgactcggttagaaaacgcatgacaactattcatagcttaggaggcgatgaaaaggataaaaaaatttcaatcacaaaaggtgcgccgaaagaaatacttgatttatcagattatgtcttatctgatggcaaagttatccccttaaataaggaagaacgtaataaaatacagttggctaatgatacatttgctaaagatggacttcgcgtcttagctgtttcatactgcgatattgaaggcttttcaaaagaacaatggacgcaagaaaatttggaacaacacatggtgttcatagggttgatagcaatgagtgatccacctcgtgaaggcgttcgcgaagctattgataaatgtcatgcagcaagcattcgtattattatggtgactggagattacggattaacggcactgagtatcgctaaaaatattggtattattcgtaacgatggtgctaaagtaatttcaggtttagagttatcagaaatgacggatagccaattgaaaaaagaattgtcaggtgaagccgtttttgctcgtgtagcaccagaacaaaaatatcgagtagtaacgatattacaggagatgggtgaagtagtagcagttacaggagacggggtcaatgatgcgcctgcgctaaaaaaatccgatattggtgtagccatgggtgttaccggtactgatgttgctaaagaatcagctgatatgattctgacagatgatcattttgcttctattgtacatgccgtggaagaagggcgggctgtttatcaaaacattaagaaattcttgacgtatatttttaatagtaatactcctgaggcggttccgtcggcattcttccttttttctaaaggttttattcctttaccattgactgtaatgcaaatacttgctgttgatttgggaaccgatatgcttcccgctttaggtctaggcgtggaaccaccagaaacagatgttatgaatcgtcctccaagacggctaacagatcgcttattggacaaagggctacttataaaatctttcctttggtacggcactattgaatccgtattagctatgggtggttttttctgggctcattacttacgttatggtaattttacttttttcgtcgcaaacggcataccgtacagggaagcgacaactatgacacttggagctattatctttagccagataggtatggttatgaatagcagaacgagctatcaatctattaaaacactatctatttttggtaataaattaattaattttggtataataatggagattttagcatttttagtcttagtatacgtgccactattccataacttattcaacacagcaagcctaggtttatcacattggctctatttaataggctgcccgtttatcatgataggtttagatgaagttcggaaattattcagcagtagaaagaataaacggtga

SEQ ID NO: 107974 - protein, 930 aa, Streptococcus agalactiae
MASTNNVSDTNTCFAKEELEEIFEELGTTQGGLSDEEVAVRQKKYGLNLLSEVEQESIILLFLKNFTSLMAILLWVGGFVAIVSNSLELGLAIWMVNVINGIFSFIQEYRASQATQALKKMLPSYSRVLRKSSEEKILSEQLVPGDIVLIEEGDRISADGRLIKTTDLQVNQSALTGESNPIYKDSNVENDQSKTLIECDNMVFAGTTVSSGSATMVVTAIGMQTQFGQIADLTQGMKSEKSPLQRELDRLTKQISIISITVGIIFFLAATFFVKEPVSKSFIFALGMIVAFIPEGLLPTVTLSLAMAVQRMAKEHALVKKLSSVETLGATSVICSDKTGTLTQNEMTVNHLWQNGKSYQVTGLGYAPEGQILFEGDNICFGNSDRGDLEKLIRFAHLCSNAQVLPPNDERSTYTVLGDPTEACLNVLLEKSGINRQENRKFAPRLKELPFDSVRKRMTTIHSLGGDEKDKKISITKGAPKEILDLSDYVLSDGKVIPLNKEERNKIQLANDTFAKDGLRVLAVSYCDIEGFSKEQWTQENLEQHMVFIGLIAMSDPPREGVREAIDKCHAASIRIIMVTGDYGLTALSIAKNIGIIRNDGAKVISGLELSEMTDSQLKKELSGEAVFARVAPEQKYRVVTILQEMGEVVAVTGDGVNDAPALKKSDIGVAMGVTGTDVAKESADMILTDDHFASIVHAVEEGRAVYQNIKKFLTYIFNSNTPEAVPSAFFLFSKGFIPLPLTVMQILAVDLGTDMLPALGLGVEPPETDVMNRPPRRLTDRLLDKGLLIKSFLWYGTIESVLAMGGFFWAHYLRYGNFTFFVANGIPYREATTMTLGAIIFSQIGMVMNSRTSYQSIKTLSIFGNKLINFGIIMEILAFLVLVYVPLFHNLFNTASLGLSHWLYLIGCPFIMIGLDEVRKLFSSRKNKR

SEQ ID NO: 107975 - DNA, 2655 bp, Oceanobacillus iheyensis
  CDS (1)..(2655)
atgaaatggtatcaattagatgtagaaaaagtagagcagaagctccaagtaatttcaaatcgcggtctaaataacaaacaagcagtggaaagaagaaaacaacatggcgaaaacatattagaatctaaaaagcaagtttcaaattggattctattttttaagcaatttcaagattttatggtattggttttgttagccgcaacattaatcgctggtttacttggagaatatattgatgcaattgcaattatggtgattgtattaataaatggatgtattggtttttttcaagaacaaaaagcagaaaactcactagaaaaattaaaagagctatctgcaccgattgctagtgtattacgtgaaaaacagtgggaaaaaatatcttctcgagatatcgttgtcggagatgtagtacgcattaatagtggagatcgtataccagctgatattcgtataattaagtctaacggtctggagaccgaggaatctgcattgactggagaatccctacctgtaagcaaacatgcgacagcaataactgctgataacctagatgttcaagaccaaacgaatatgggatttatgggaacaatggttactcgtggttctggaacaggtgttgttgttgggacgggtatgaagacagtgatgggtcagatagcatctctcattcaaggcacgaaaaaaacaataactccacttgagatgaaacttgctgaattggggaaaattttgattgttgttgctctcttattgactgtgctggtagtaggagtaggggtagtacaaggccatcctatgtacgaaatgtttttggcaggtgtctcacttgcggtagcagctattccggaaggactccccgcaatcgtgacagtggcgttgtctcttggagtacaacgaatgatacgaaagaaagcaattgtacgtaaattatcagcagtagaaacattaggatgtgcgtctgttgtttgttccgataaaacaggaaccatgacggaaaatcaaatgaccgttaaagaaatgtatttgaatggggaatatttatatgtaacaggagatggctatcaaactcaaggtgacttctttttgaataagaataaagtggaacgaacgcatccaaacttagagacaatgttactgtatggattgatatgtaaccattctcaattaatggtgaaaaaaggaaaaaacttcattgacggagatccaacagatggagctttattagttgcagcacgaaaattagggctgcaagctgatagaaaagaagattatcatgttataaaagaattaccatttgattctgatcgcaaacgaatgagtgtagtcgttgaagataagaatgggatgaagatgcttattacaaaaggagctcccgatgtactattaccacgctctacctataatttagatgaaaatggacgttcactattaaaaaaagaagacaccagagcgattgaggaagctgtttatcatatggcaggaaaagcgcttcgtacaattgcgattggggtgcgtattttaccgaataatatggatatagacagtgcaatgattgaaaatgaactaacatttatcggattgtatggattaatggatccacctagaaaagaagtgaagtcagcgatacgagaatgtaaagaagcaggtattaaaacggtaatgataacaggagatcatgcacatactgctcgagcaattgctagtcatttacaattgataccagaaaacgggctcgtatttgaaggtaaacaattaaacaacatgtcggatcaggaattggaaaatataatagaggatgcatacgtttttgctagggttactccagaacataaattacgaattgtaaaagcttttcaaaataaaggacatatagttgcaatgactggagatggagtaaatgatgctccggcaatcaaagcaagtgatatcggaataagtatggggattaacggtactgatgtaaccaaagaagcttcatccctcgtattaatggacgataactttgcaactattaaatcagcaatcaatgaaggcagaaacatctatgaaaatatacggaaatttatacgatatcttttagcatcgaatgttggagagatactagtcatgttatttgctatgttactagcattaccgttacccctcgttccagtacaaatactttgggtgaatttagtgacggatggattacctgcaatggctcttggggtggataaagcggaaggcgatgtaatgaagcgtgggccaaggaatccaagagaaggtattttttcaagaggattaggttataagattgtatcacgagggattttgatagggattgttacacttattgctttcatggttacgtatcaaaataatccagagcatttaatttatgcgcagactactgcatttgctacattagtagttgcacaattgattcatgtatttgattgtcgtagtgaacattcggtttttgcaagaaatccatttggaaatatgtaccttgtttatgccgtgctttcctcattattattgttatttgttgtgatttactgggcaccgcttcaacctattttccatacaactgctctcagcattatagattggctgttagtcgttgggttaggagcaataccgactgtactttttggttattcaaaaaaataa

SEQ ID NO: 107976 - protein, 884 aa, Oceanobacillus iheyensis
MKWYQLDVEKVEQKLQVISNRGLNNKQAVERRKQHGENILESKKQVSNWILFFKQFQDFMVLVLLAATLIAGLLGEYIDAIAIMVIVLINGCIGFFQEQKAENSLEKLKELSAPIASVLREKQWEKISSRDIVVGDVVRINSGDRIPADIRIIKSNGLETEESALTGESLPVSKHATAITADNLDVQDQTNMGFMGTMVTRGSGTGVVVGTGMKTVMGQIASLIQGTKKTITPLEMKLAELGKILIVVALLLTVLVVGVGVVQGHPMYEMFLAGVSLAVAAIPEGLPAIVTVALSLGVQRMIRKKAIVRKLSAVETLGCASVVCSDKTGTMTENQMTVKEMYLNGEYLYVTGDGYQTQGDFFLNKNKVERTHPNLETMLLYGLICNHSQLMVKKGKNFIDGDPTDGALLVAARKLGLQADRKEDYHVIKELPFDSDRKRMSVVVEDKNGMKMLITKGAPDVLLPRSTYNLDENGRSLLKKEDTRAIEEAVYHMAGKALRTIAIGVRILPNNMDIDSAMIENELTFIGLYGLMDPPRKEVKSAIRECKEAGIKTVMITGDHAHTARAIASHLQLIPENGLVFEGKQLNNMSDQELENIIEDAYVFARVTPEHKLRIVKAFQNKGHIVAMTGDGVNDAPAIKASDIGISMGINGTDVTKEASSLVLMDDNFATIKSAINEGRNIYENIRKFIRYLLASNVGEILVMLFAMLLALPLPLVPVQILWVNLVTDGLPAMALGVDKAEGDVMKRGPRNPREGIFSRGLGYKIVSRGILIGIVTLIAFMVTYQNNPEHLIYAQTTAFATLVVAQLIHVFDCRSEHSVFARNPFGNMYLVYAVLSSLLLLFVVIYWAPLQPIFHTTALSIIDWLLVVGLGAIPTVLFGYSKK

SEQ ID NO: 107977 - DNA, 2832 bp, Mycoplasma penetrans
  CDS (1)..(2832): transl_table=4
atgaacaaaaatcttaatgaatcgttatcaaacctctccacaaatattgaagaaggtttaagtactcaagaagttgaatttaggttaaagaaatatggacctaataaaattgctgagtctaagaaagttaaatttattactagagtcttggaacaatttaaaaatccaatgattctactattgctaattgctgcaatcatatctttattaattgcttatgtaccatcatttaaaactgatactggtgctactcaaattgaaagactagtagaaaaagtagaacctttcatcatttttctaattgtttttattaactgtatttttggagcagtccaagaagctaaatccgaaaaagcagtagactctttaaacaaaatgattatttcaaaagccaaagtataccggaatgatgattttgatgtaattaattctgatcaattagttccaggagatattattgtcttagaagcaggagattctgttccagctgatggaattattattgaatcaacactatttaaaactcaagaatctgttctaacaggtgaatcattaccaattgataaagatcctacttttgtatttgatattaatactccaattgcagatagaaaaaactgtgtttattctggaactaatgtaattaatggtaaagctaaagtattagttactagcactggaatgaatactgaaattggtaaaattgctagtttaattaaaaatgctgaaaatgatgtttctaagattgaaaagaaaattaaaaaattaagtaacattttaggaattgctgcttttgtagtaatggtgttagctttcttactatcaatcttttatttaaatggaattgatactattaaatacacttgagcaaatggatttaaattaggaatatcaattgcaatagctgcaatccctgaaggtttatttgcaattatgacagtagtattctctttaggtattaagagaatgattaagcaaaatgctttaattaaaaaaattcaaactgtagaaactttaggaaatgtttcaattatttgtagtgataagactggtacacttactcaaaataaaatgaaagttattaaagtttttgatggtaaaaaatcttattcagatgttttagaaatcaaagataaaaaagtactagaatatgcaatgttgtgtaatgacagtaatgatgatgatggaattatagttggagatccaacagaaacttcattagtaaatgctggaattgcaactggtttaaattttgaagaaattcaagataaatacccaagagcacaatatatcccatttgattcagatagaaagatgatgacaacagttcataaaattggatctgaatatgtagttattactaagggtgcatttgatgaaattactaaagttgctaaaaatgtagataagagcttctttgaagaaaatgaaaaaatgagtaataatgctttaagagtattagctattgcttataagaaaattaaaactcttcctaaaaagaacagtttattagaaactgaattgaatgtattagcattatttggaattcaagatcctccaagaccaaaagttaaacattcaattgaattagttaaaaaagctggaattattccaattatgattactggagatcatgcaaacactgcaagtgcaattgcaactgaacttggaattttagttgataataaaaaagtaattactggtgctgagttagcaaaattatctgatgaagaatttgctaacaatattggtgattatgctgtttatgctagagtttcaccagaagataaaattagaattgtaaatgcttgaaaaaaacataacaaaattgttgcaatgactggtgatggtgtaaatgatgcgcctgctttaaaagctgctgatgttggatgtgctatgggaattaatggtacagaagttagtaagcaagctgctgacatgatattaacagatgataactttagtacaattgtggaagcagttagagaaggtagaggggtaattgataacttaaaaagagttatgttattaatgtttactacaaacattgtttcattcttagtaacttttttaggaatctttatcttccattattcacctttttctgcaattcaaatcctttgaattaatttagtaactgaaagtttaccttcaattgcattgggtgctcaaaaaccaaaaccatatataatggatttctctcctaaaaataaaaacaatttagtagatattaagatgcttactaaaattgtggttcaaggattaatgttttcagcaattgctttaataatgtactttgtaactgctggtatctttgttggtcatgattacaatttatttgttaatgctttaaaagcaattgaatcatctacagatttaactgctgaccaaagagcagcattattcaatatgcaaatgagtggtagtttatctgctttcatagtagtaactttctcacaatcatttaatggatttaatttaatgtctaaacaatctattattaaatctaagtgagaagatgcaagatacatggttttagctttcttagtttctgcagttctattaatttttgtgatcctaattcctagattaaatgatatctttaactctaactcttacttgtttagtgaatcagtttctagatatataaattcagatttaactttaggtggtcaaataagttcttcttataattacttattctttattgcttttgtaatggcttttgttccaacagtgatttttgagttagccaaattattctataactcaaaaggttataagcaaattgaaaagaaatttgtttgattacaaaaatgaaatgctatttaa

SEQ ID NO: 107978 - protein, 943 aa, Mycoplasma penetrans
MNKNLNESLSNLSTNIEEGLSTQEVEFRLKKYGPNKIAESKKVKFITRVLEQFKNPMILLLLIAAIISLLIAYVPSFKTDTGATQIERLVEKVEPFIIFLIVFINCIFGAVQEAKSEKAVDSLNKMIISKAKVYRNDDFDVINSDQLVPGDIIVLEAGDSVPADGIIIESTLFKTQESVLTGESLPIDKDPTFVFDINTPIADRKNCVYSGTNVINGKAKVLVTSTGMNTEIGKIASLIKNAENDVSKIEKKIKKLSNILGIAAFVVMVLAFLLSIFYLNGIDTIKYTWANGFKLGISIAIAAIPEGLFAIMTVVFSLGIKRMIKQNALIKKIQTVETLGNVSIICSDKTGTLTQNKMKVIKVFDGKKSYSDVLEIKDKKVLEYAMLCNDSNDDDGIIVGDPTETSLVNAGIATGLNFEEIQDKYPRAQYIPFDSDRKMMTTVHKIGSEYVVITKGAFDEITKVAKNVDKSFFEENEKMSNNALRVLAIAYKKIKTLPKKNSLLETELNVLALFGIQDPPRPKVKHSIELVKKAGIIPIMITGDHANTASAIATELGILVDNKKVITGAELAKLSDEEFANNIGDYAVYARVSPEDKIRIVNAWKKHNKIVAMTGDGVNDAPALKAADVGCAMGINGTEVSKQAADMILTDDNFSTIVEAVREGRGVIDNLKRVMLLMFTTNIVSFLVTFLGIFIFHYSPFSAIQILWINLVTESLPSIALGAQKPKPYIMDFSPKNKNNLVDIKMLTKIVVQGLMFSAIALIMYFVTAGIFVGHDYNLFVNALKAIESSTDLTADQRAALFNMQMSGSLSAFIVVTFSQSFNGFNLMSKQSIIKSKWEDARYMVLAFLVSAVLLIFVILIPRLNDIFNSNSYLFSESVSRYINSDLTLGGQISSSYNYLFFIAFVMAFVPTVIFELAKLFYNSKGYKQIEKKFVWLQKWNAI

SEQ ID NO: 107979 - DNA, 2931 bp, Corynebacterium efficiens
  CDS (1)..(2931)
atgatgaggtcgatttcggcggtctgctcggttacgccccggtcattcccgtcaataccgtctccaaccacgccttcgtccaccggggtggtttcatcccggcgccggtccacgggttccgcaactagaacgacgcttgtcgacgcgcaccaccccactcatcacgcccggcactgtgtggatgcggacgtagactggtggtgtcagatccccgacctccaggagatatgcaccatgtcacagccgcccgaggttcgaacccccacagatgacaggccgccactgaccgcaccccatgcactcggcgcggatgaggtcctggagcatctggaggtggatacccgggggctgagctcggaacacgcagcgcagctactcgaccattacggcccgaatgaactgcgccaggccgaaccggaaacggttctgcaacggctgttccggcagatcaatgacccgatgatctatgtcctcatcggcgcagccctgctgaccgcactgttgggccattggacggacaccatcgtcatcgccgcggtggtggtggtcaacatgatggtcgggttcatccaggagggtaaggcagccgatgccctggcctcgatcagggagatgctctcgccggaatccaccgtcttacgcgatgagcactggaccacgatcgacgccaccaccctggttcccggtgacatcatccggttctccgccggggatcgtattccagcggatgtgaggatcatatccgccaccaatctgcaggtggaggaggcggcgctcaccggcgaatcgaatccagtggtcaaatcaccggaaccggtggaggaggaggccggtatcggtgaccgcacctccatgggtttctcctccaccaccgccctgaccggaacaggcaccggtgtggtcaccgccaccggcaatgacaccgagatcggccgcatcaccaccatgctggaccaggtggacagtgtggataccccactgacgcggaccatgtcgaggttctccgcgacgctggccgtcgtctgcgtggtcctggctgtcatcatgctggtggtgtcctggctggtccacggcaccccctttgagcagctcatcatgtccgccatcggtttcgcggtggccgcgatcccggagggtctgccggctgtcatcgccatcacgctcgccctgggtgtgcagtccatggcgggccgtaatgccatcacccgtcagctgaactcggtggaaaccctcggctcggtcaccaccatctgctccgacaagaccggaaccctgacccgcaatgagatgaccgtgcgcgccctggtcaccgcccgcggttcctatgaggtcaccggcgatggttatgaaccggtgggaaccatctcagaccgcgacaccggtgaggaggtgcacccgggggatgcagctgatattcacgccctggcgcaggtggcagccaatgtctgcgatgcgcagatccgcgaggtggacggcgcctggcagctggtgggtgaacccaccgacggtggtatccgggccttcgccatgaaaaccggtgtggaacctgcgccgaggctcgccgaggtccccttcgattcctcctacaagtacatggccaccctccacgagggcgacggcgagcagatcatgctggtcaagggcgcccccgaccgtctgttggaccgcagcacacgccagggggaaggggcaccgctcgaccgggcgttctgggaggcgcgcatcgaggagctgggttcccgtggtctgcgagtgctcgccgcagcccggcgcgccctgccggtgcttgtcgacgatttctcccccgacacggtggaccagggtgagctcaccttcctcggtgtctacggcatcatggatccaccccggaccgaggtgatcggtgccatcgacacggtgcagaaggcgggtgtccgggtgcggatgatcaccggggatcatgcctccaccgccagcgctatcgcccgggaggtgggaatccagggtaagcgggtgctcaccggccgggagatcaccgaggccacggatgaacaactgcgcgagctggtccgcgacacaggggtgtttgtccgaaccagccccgaacacaagctccgcatcgtccgggcactgcaggccaacggcgaggtcgtctccatgaccggtgacggtgtcaatgatgccccctccctgaaacaggcggatgtgggtgtggccatgggtatcaagggcacggaggccaccaaggacgcggcggatatcgtgttggcggacgacaacttcgccacgatcgcacgtgccatggagatgggccggacgatctatgacaacctgcgcaaggccatcgtgttcatgctgccgaccaacggtgcgcaggggctggtgatcttcgtgtccatgctgttcggtctgcagctgccgatcactcccctgcaggtgctctggatcaacctgatcacctccatcaccttatcgctggcgttgtcgtttgagcctgcggagcccgacatcatgaagcgtcaaccccgcgatcctaaggccaatatcctcgaccgcgaggctttcatccgcatcatctatgtgtctctcctgctgggtgccatgacgttcggggcgttctcgctggctctcgacaacggtgccaccctcgaacaggcccggacgatcgcagtgaatagtctcgcggtggggcagatcttctacctgtttgtcacccgcttctcccgggtgcatgccttcagaagagcgctgttcacgggcaaccaggtctcctggttgtgtgttggcatcatgctcgtgctccagctgggcttcgtctacctgcccttcatgaatgccgccttcggcaccgcccccgtgtcactggattcctggctggtgcccgtcgccgccggtgtggccatcttcgtggtggtggaggtggagaaattcgtgcggaggaggacggcctag

SEQ ID NO: 107980 - protein, 976 aa, Corynebacterium efficiens
MMRSISAVCSVTPRSFPSIPSPTTPSSTGVVSSRRRSTGSATRTTLVDAHHPTHHARHCVDADVDWWCQIPDLQEICTMSQPPEVRTPTDDRPPLTAPHALGADEVLEHLEVDTRGLSSEHAAQLLDHYGPNELRQAEPETVLQRLFRQINDPMIYVLIGAALLTALLGHWTDTIVIAAVVVVNMMVGFIQEGKAADALASIREMLSPESTVLRDEHWTTIDATTLVPGDIIRFSAGDRIPADVRIISATNLQVEEAALTGESNPVVKSPEPVEEEAGIGDRTSMGFSSTTALTGTGTGVVTATGNDTEIGRITTMLDQVDSVDTPLTRTMSRFSATLAVVCVVLAVIMLVVSWLVHGTPFEQLIMSAIGFAVAAIPEGLPAVIAITLALGVQSMAGRNAITRQLNSVETLGSVTTICSDKTGTLTRNEMTVRALVTARGSYEVTGDGYEPVGTISDRDTGEEVHPGDAADIHALAQVAANVCDAQIREVDGAWQLVGEPTDGGIRAFAMKTGVEPAPRLAEVPFDSSYKYMATLHEGDGEQIMLVKGAPDRLLDRSTRQGEGAPLDRAFWEARIEELGSRGLRVLAAARRALPVLVDDFSPDTVDQGELTFLGVYGIMDPPRTEVIGAIDTVQKAGVRVRMITGDHASTASAIAREVGIQGKRVLTGREITEATDEQLRELVRDTGVFVRTSPEHKLRIVRALQANGEVVSMTGDGVNDAPSLKQADVGVAMGIKGTEATKDAADIVLADDNFATIARAMEMGRTIYDNLRKAIVFMLPTNGAQGLVIFVSMLFGLQLPITPLQVLWINLITSITLSLALSFEPAEPDIMKRQPRDPKANILDREAFIRIIYVSLLLGAMTFGAFSLALDNGATLEQARTIAVNSLAVGQIFYLFVTRFSRVHAFRRALFTGNQVSWLCVGIMLVLQLGFVYLPFMNAAFGTAPVSLDSWLVPVAAGVAIFVVVEVEKFVRRRTA

SEQ ID NO: 107981 - DNA, 2988 bp, Bifidobacterium longum
  CDS (1)..(2988)
atggatgatctcaaagatcaatccgcagtgtccacgaccgcaacgaacggggtcgtggaatcggaagaggtgcgcgcacaggaagcgctattgggggataccgatccaagtctgaccagcgccgacgacgtggccaaagccctgaacgtcgacccatcccacggcctgagcgaggaagaagccaagcgccgactggccaaattcggcccgaacgagctcgccagcgccccgcccgtaccgaaatggaagaaattcctggcccaattccaagatccgctggtctacctgctgatcgcggccactattatctcggtgatcgcttggttcatcgaaaaagccaatgcgcagcccggcgcggaaggcggcgaagtgctgccgttcgacgccatcgtgatcatcttgatcctgattgtcaatgctgtgctcggctatatgcaagaagccaaggccgaggcggccgtcgaagcgctcgcacaaatgacggccccgcagacctcggtgctgcgcgatggcaaggtcatgcgcatcaacaccgccgacgtggtccccggcgacatcatcgtccttgcggaaggcgattcggtctccgctgatggccgactggtcaacgcggccagcctgcgcatcgccgaggcttcactgaccggcgaatccgtgccggttggcaagaagccggacacactcaccgaagccaaggcgctgggcgaccgcgccaacatgatcttcaacggcacttccgtgacgcaaggcaccggccgcgcaatcgtgaccggcaccggtatgaatacgcaggtcggcaagatcgccgacatgctctccgccaccgaagatgagaaaactccgctgcagaaggagatggattacgtctccaagatcctcggcattgcggtgtgcgtcatcgctgtcgtggtgctggtggcgctcgccgtgctggaaggcttcaacgacgtccatgacgtgattgattccttgctgttggctgtctcgctggctgtggccgccgtgccggaaggcttggccgccatcctgaccgtggtgctggcgcttggtgtgcagcgtatggccgcgcacaacgccatcgtcaagaaactgcattcggtggagaccttgggctccgcttccgtgatctgctcggataagaccggtacgctgacccgcaacgagatgaccgtggaacgtgtggtcaccccgtccggcgaagtgcagatcactggcaccggttacgcgccggaaggccgcatggttatgaccggcggcgtcagtcctgaatccgagcaggcccagattgtggccgatgaagtcgtcgccacgctcgtggccggcacgctcgcgaacgacggcgaactacgcgaggagaacggccgttgggagattgtgggcgaccccaccgaagtctcgctgatcgtggccgcacgcaaggtcaaggccgatcgcaagatcaagcgatacacgcgcgttggcgagattccgttcacctccgaacgcaagcgcatgtccatcatcgccaaggacagcaccgattcagacaagctcaccgtgttcgccaagggcgcgcccgacgtgctgttgagctactgcacgcgcatccgcgtgggtggtcaggtccgtaagctcaccgaaggcgatcgccagtcgattctcgccaccgtcgaacgtctctcctccgaggcctaccgtacgcttggcgaggcctgccgtccgctggaaaccggttctttggctgatgtgcccggtgtaagcgtcaacgctgcaggccaggtgtccgacatcgccgatcaggccgaagccattgaaaccgatctcatctggaatggcatggtcggcattatcgatccgccgcgtactgaggtgcgcgactccgtgaccgaggcccatcgtgccggcatccgcacggtgatgatcaccggcgaccacccgctgaccgccgcccgcatcgcctccgaccttggcatcatcgccaaggatggcaaggccctgaccggcgaccagctcgaccagctgcccgatgaggccgcgctcgacaaggccacgtccgaagtgtccgtgtacgcgcgcgtggcccccgagcacaagctcaagatcgtcgaatccttgcagcgccaaggcaacatcgtggccatgaccggcgacggtgtgaacgatgccccggcagtcaagtccgcggacatcggcgtggccatgggcatcaccggcaccgaagtgaccaagcagagcgccaagatgattctggcggacgacaacttctccaccatcgtggccgccgtacgcgagggtcgcgtgatcttcgacaacatccgcaagttcctgcgctacctgctgagttccaatgtgggtgaggtgttcaccgtgttcctcggtgtggtgtttgccggcttcctcggcatccgccagccggaaaccgtgggcgtcaccgtgccgctgctcgccacacagttgctgtggatcaacctgctgaccgatgccgcgccggcgttggctatgggcgtggacccgcagaccgacgatgtgatgggtcgtaaaccgcgtaaggtgacggaccgcgtgattgacgcctccatgtggggcgacatcatctacatcggcgtcatcatggccatcgtcacgctgattggtatggacatgcacctgtccggcggcttgttcaccgaccgctcggtggatgccatcggccatgaagcgcagatgaccgaggcccgtacgatgggcttcacgattctggtgtttgcccagctattcaacgcgctgtcctcccgttcgcatctgcagtccgcattcgtgggtctgttctccaacaagtggctatggggtgcgattggtttgtccgtggcgctgcagctcgtggtgatttacgtgccgttcctcaacggtccgttcggcaccgtggcattgagcccgatggcttgggtggaatgcatctgcctggccgcaatcgtgctgattgcctccgaactgcgcaagattgtgctacgcgcgatggccaagcgttaa

SEQ ID NO: 107982 - protein, 995 aa, Bifidobacterium longum
MDDLKDQSAVSTTATNGVVESEEVRAQEALLGDTDPSLTSADDVAKALNVDPSHGLSEEEAKRRLAKFGPNELASAPPVPKWKKFLAQFQDPLVYLLIAATIISVIAWFIEKANAQPGAEGGEVLPFDAIVIILILIVNAVLGYMQEAKAEAAVEALAQMTAPQTSVLRDGKVMRINTADVVPGDIIVLAEGDSVSADGRLVNAASLRIAEASLTGESVPVGKKPDTLTEAKALGDRANMIFNGTSVTQGTGRAIVTGTGMNTQVGKIADMLSATEDEKTPLQKEMDYVSKILGIAVCVIAVVVLVALAVLEGFNDVHDVIDSLLLAVSLAVAAVPEGLAAILTVVLALGVQRMAAHNAIVKKLHSVETLGSASVICSDKTGTLTRNEMTVERVVTPSGEVQITGTGYAPEGRMVMTGGVSPESEQAQIVADEVVATLVAGTLANDGELREENGRWEIVGDPTEVSLIVAARKVKADRKIKRYTRVGEIPFTSERKRMSIIAKDSTDSDKLTVFAKGAPDVLLSYCTRIRVGGQVRKLTEGDRQSILATVERLSSEAYRTLGEACRPLETGSLADVPGVSVNAAGQVSDIADQAEAIETDLIWNGMVGIIDPPRTEVRDSVTEAHRAGIRTVMITGDHPLTAARIASDLGIIAKDGKALTGDQLDQLPDEAALDKATSEVSVYARVAPEHKLKIVESLQRQGNIVAMTGDGVNDAPAVKSADIGVAMGITGTEVTKQSAKMILADDNFSTIVAAVREGRVIFDNIRKFLRYLLSSNVGEVFTVFLGVVFAGFLGIRQPETVGVTVPLLATQLLWINLLTDAAPALAMGVDPQTDDVMGRKPRKVTDRVIDASMWGDIIYIGVIMAIVTLIGMDMHLSGGLFTDRSVDAIGHEAQMTEARTMGFTILVFAQLFNALSSRSHLQSAFVGLFSNKWLWGAIGLSVALQLVVIYVPFLNGPFGTVALSPMAWVECICLAAIVLIASELRKIVLRAMAKR

SEQ ID NO: 107983 - DNA, 4073 bp, Arabidopsis thaliana
  CDS (140)..(3022)
gtgtctcataataaggtagtgccactactactatagcggttttatcatcttctacgcttcgatttcgtcgtcctcctcccaacaaagtttgttaggaaacgaatactcgaacagccatttcttctctatttctcgtgcgatgacgacgactgtggaggacaatcgcgaggtcctcgaggctgttttgaaagaagcggtcgatctggaaaatgtgccaattgaagaagtatttgagaatctgagatgtagcaaggaaggtctcactacacaagctgctgatgaaagacttgctctctttggccataacaaactcgaagagaaaaaggaaagcaaattccttaagtttttaggctttatgtggaaccctctttcctgggtgatggaagctgctgctattatggctattgcgcttgctaatggaggaggaaaacctcctgattggcaagactttgttggtattatcactctgcttgtgattaactccaccatcagtttcattgaggagaacaatgcaggaaacgctgcagctgctctcatggcccgtctagccccgaaagcaaaggttcttcgagatggaaggtggggtgagcaggatgctgcgattctcgttcccggtgatataatcagcatcaagcttggggatatcgtcccagctgatgcacgccttctcgagggtgatccccttaagatcgatcagtctgctcttactggtgaatctctaccagtaaccaaaagttctggagatggtgtctattccggttctacatgcaaacaaggagagatcgaagcagttgttatcgcaactggcgtccataccttttttggaaaggctgctcaccttgttgatacgacaaaccaaattggtcatttccaacaggttttaactgcaattgggaacttttgcatctgctctattgctgtggggatgctcattgagattgtcgtgatgtaccctattcaacaccgagcataccgccctgggattgataaccttcttgtgcttctcattggtggaattccaattgccatgcctacagttctgtctgtgaccatggcaattggctcccacagactatctcagcagggagctatcactaagagaatgacggcgattgaggaaatggctggcatggacgttctttgcagtgacaagacgggcactttgacattgaataaacttactgttgacaaaaatctgattgaagttttcatgaaaggagtggatgcagatactgttgtcctgatggcagctcgagcctccagactagagaaccaagatgctatagatgctgctatagtcgggatgctggcagatcctaaagatgcacgagctggtatccaggaggttcactttcttcctttcaatcctactgataagagaacggctctgacatatattgacaatgagggtaacacacatagagtgagcaaaggtgctcctgagcaaatcttaaatcttgcacacaataaatcagagattgagcggagagttcatgctgttattgataagttcgctgaaaggggtctgcgatctcttgctgtggcgtaccaggatgttcctgaagggaggaaggatagtgctggaggtccttggcaatttgtgggtctcatgcctctttttgatccgcctaggcatgacagtgctgagacgataagaagggctttaaatcttggtgtgagtgttaaaatgatcacaggggatcaactggctataggaaaagagactgggcgccgtttggggatgggaaccaacatgtacccctcatccgctttacttggacagaacaaggatgagtcgatagttgctttacctgtcgatgagctcatagagaaagctgatggctttgcgggtgtcttccctgagcataaatatgagatagtgaagcgattacaagccaggaaacatatatgtggaatgacgggtgatggtgtaaatgatgctcctgctcttaaaaaggctgacataggcattgcagttgctgatgccactgatgcagctcgtagcgcatcggatattgttcttactgaacctggtcttagcgttatcatcagtgctgttttgaccagtcgtgctatcttccagagaatgaaaaattatactatctacgcagtctccatcacaatccgtattgttctgggctttatgcttctggctctcatatggcagtttgacttcccacctttcatggtccttatcattgccattcttaatgatggtacgatcatgacaatatcaaaggacagggtgaaaccttcccctcttccagatagctggaagctttctgagatttttgctaccggtgttgtctttggcagttacatggccatgatgaccgttatatttttctgggtttcatacaaaaccgatttcttcccgagaacttttggagttgcgacacttgagaaaactgctcatgatgatttccgaaagcttgcctcagccatatacctgcaagtcagtattatcagtcaggcacttatctttgtgacccgatcgcgaagctggtcttttgtggaacgtcccgggatatttcttatgattgcctttatcctcgctcagttggtggctactctaattgcagtctatgcaaattggagctttgctgcgatagaaggaataggttggggatgggccggggtcatttggctctataacatcatattctacatcccccttgatttcatcaaattcttcatccgctacgctcttagtggcagagcctgggatcttgttatcgaacaaagggttgcgttcacaaggcaaaaagattttgggaaagaacaaagagagctgcaatgggctcacgcacaaagaacgctccatggtctacaagcaccagatactaagatgttcacagatcgaacccatgtcagtgaacttaaccaaatggctgaagaagccaagaggagagctgaaattgctaggttgcgtgaacttcacacgctcaagggccatgttgaatcagtggtgagactcaaaggactcgacatagaaaccattcaacaagcttacactgtctgagaaagtgagtgcaagctgatttcagttgggtcatgaaggttgtgtctgtagttaatacatacatattgcatataaatatcgaatcctcgtagccttcttttagcggtttgttatgttctgttctgttgtggtgatgaaagaagaaacagaaacttcgtacggaggttgaaattagcaacaaaaaacttattttacaatacatgtctacaaagatgaagtgattttcttcttcaattaatctataaaagtacaacaaggttgatttcgggtgaagaaaaactacggagattgaagtagaataccaaaaatatataagtttccagatcagacagagttcttgtcttgtagctgctgttgcttggtttcttcttcattggtctcaatctcagtgatgtcttcatcattacctcctttgtatctataccatctagccatcaacaagaagtaagccatgttaacaaccatgagtcctgtgagcatgaagtagaagtaatccaatttcgctttgttcagatcctcagctaaccaattccctgaaggtgaatgcgcggttgttcgatgaacagttgatatcaagaagctagcgaggtagctcgaaacccctgcaccgacataaaagatagaacccgcgaagctcttcatgttttcaggaaactgcttgtagtaaaactccatttgtccaatggcagcaaaagcttctgctatgcctgcaagtgtaagctgcggaatcagccacaacgctgacattgatgagatttctcctgtccgaggcgccatcccgagtgtcggtttggtcaatgcaaagtttcttctcctttcctctataaacccggaaactaataaactcattatcgcaaatgtaaacccagctccgattctttgtaagagtgatataccggtttctaacccggtcactcttctgagcgacgggacaagtacacggtcgtagaatatgatgaaaactgtcatgccagtcatcaagaacactacataggtggccgcaggaatcctgaagccaccagaacctaatcgtcggtcgctctggagcgct

SEQ ID NO: 107984 - protein, 960 aa, Arabidopsis thaliana
MTTTVEDNREVLEAVLKEAVDLENVPIEEVFENLRCSKEGLTTQAADERLALFGHNKLEEKKESKFLKFLGFMWNPLSWVMEAAAIMAIALANGGGKPPDWQDFVGIITLLVINSTISFIEENNAGNAAAALMARLAPKAKVLRDGRWGEQDAAILVPGDIISIKLGDIVPADARLLEGDPLKIDQSALTGESLPVTKSSGDGVYSGSTCKQGEIEAVVIATGVHTFFGKAAHLVDTTNQIGHFQQVLTAIGNFCICSIAVGMLIEIVVMYPIQHRAYRPGIDNLLVLLIGGIPIAMPTVLSVTMAIGSHRLSQQGAITKRMTAIEEMAGMDVLCSDKTGTLTLNKLTVDKNLIEVFMKGVDADTVVLMAARASRLENQDAIDAAIVGMLADPKDARAGIQEVHFLPFNPTDKRTALTYIDNEGNTHRVSKGAPEQILNLAHNKSEIERRVHAVIDKFAERGLRSLAVAYQDVPEGRKDSAGGPWQFVGLMPLFDPPRHDSAETIRRALNLGVSVKMITGDQLAIGKETGRRLGMGTNMYPSSALLGQNKDESIVALPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLSEIFATGVVFGSYMAMMTVIFFWVSYKTDFFPRTFGVATLEKTAHDDFRKLASAIYLQVSIISQALIFVTRSRSWSFVERPGIFLMIAFILAQLVATLIAVYANWSFAAIEGIGWGWAGVIWLYNIIFYIPLDFIKFFIRYALSGRAWDLVIEQRVAFTRQKDFGKEQRELQWAHAQRTLHGLQAPDTKMFTDRTHVSELNQMAEEAKRRAEIARLRELHTLKGHVESVVRLKGLDIETIQQAYTV

SEQ ID NO: 107985 - DNA, 2694 bp, Oryza sativa
  CDS (1)..(2694)
atggcgtcctccctctccctcgacgacatcaacgacgactccgtcgacctggtacgcacgcacgcacgccatgtgttcgtccatcgtcctcctcctcgtcagcgtctaatgttgtgtaaatgttgtgatgtgcagtcgaaggcgccggtggcggaggtgttccagaagctgaaatgcgaccggaaggggctcaccggagcggagggagagagccggctgcggctgtacgggccgaacaagctggaggagaagaaggagagcaagcttctcaagttcttgggcttcatgtggaacccgctgtcgtgggtcatggagatcgccgccatcatggccatcgtcctcgccaacggcggcggccgcccgcccgactggcaggacttcgtcgggatcgtctccctgctcatcatcaactccaccatctcctacatcgaggaggccaacgccggcgacgccgccgccgcgctcatggccggcctggctcccaagaccaagctgctcagggatggcaggtgggaggagcaggaggcggcgatcttggtccccggcgacatcatcagcatcaagctcggcgacatcatccccgccgacgcgaggctgctcgagggcgacccgctcaagatcgaccagtcggcgctcaccggcgagtcgttgccggtgaacaagcacccggggcaggaggtgttctcgggctccacggtgaagcagggcgagatcgaggccgtcgtcatcgccaccggcgtgcgcaccttcttcggcaaggcggcgcacctcgtcgacagcaccaacaacgtcggccacttccagcaggtgctcaccgccatcggcaacttctgcatcatctccatcggcgccggcatggcggtcgaggtgctcgtcatgtacccgatccagcaccgcgcctaccgcgacggcatcgacaacctcctcgtcctcctcatcggcggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacgctcaacaagctcaccgtcgacaagaccctcatcgaggtgtgctccaagggcgtcgacaaggacatggtcctcctctacgccgccagggcgtcgcgcgtcgagaaccaggacgccattgacacctgcatcgtgaacatgctcgacgaccccaaggaggcacgcgcggggatccaggaggtgcacttcctccccttcaaccccgtcgacaagcgcaccgccatcacctacatcgacggcaatggcgactggcacagggtgagcaagggcgcgccggagcagatcatcgagctctgcaacatggccgccgacgccgagaagaaggtccacgccctgatcgacagctacgccgaccgggggctccggtcgctcggcgtgtcgtaccagcaggtgccggagaagagcaaggacagcggcggcgacccgtggcagttcatcgggctgctgccgctgttcgacccgccgaggcacgacagcgcggagaccatccgccgcgcgctccacctcggcgtcaacgtcaagatgatcaccggcgaccagctcgccatcgccaaggagacggggcggcggctcgggatgggcaccaacatgtacccgtcgaccaccctcctcggcgacaagaacagccaggtgaacggcctccccatcgacgagctgatcgagcgcgccgacgggttcgccggcgtgttcccggagcacaagtacgagatcgtgaagcggctgcaggagatgagccacatctgcggcatgaccggcgacggcgtgaacgacgcgccggcgctgaagaaggcggacatcgggatcgccgtggacgacgccacggacgccgcccggagcgcgtcggacatcgtgctgacggagcccgggctgagcgtgatcgtcagcgcggtgctcacctcccgcgccatcttccagcggatgaagaactacaccatctacgcggtgtccatcaccatccgcatcgtcctcggcttcctcctcatcgccatcatctggaagttcgacttcgccccgttcatggtgctcatcatcgccatcctcaacgacggcaccatcatgaccatctccaaggatcgcgtcaagccgtcgccgacgcccgattgttggaagctcaacgagatcttcctcacgggggtggtgctcggcacctacatggcattggtcaccgtgctcttcttctacctcgcgcacgacacgaacttcttcacggatgtgttcggggtgacgtcgatcagggagagcgagagggagctcatggcggcgctgtacctgcaggtgagcatcatcagccaggcgctcatcttcgtgacgaggtcgaggagctggtcgttcgtcgagaggcccgggttcttgctgctcttcgccttcttcgctgcgcagatggtggcgacggcgatcgccgtgtacgcgcgctgggatttctgccggatccagggcatcgggtggcggtggggcggcgccgtgtggcagttcagcgtcgtcacctacctcccgctcgacgtcctcaagttcatcatccgctacgccctcaccggcggcaaggccggggacagcgcccagaaaaaggcaagctcgccgccgccgacctctcaaccttag

SEQ ID NO: 107986 - protein, 897 aa, Oryza sativa
MASSLSLDDINDDSVDLVRTHARHVFVHRPPPRQRLMLCKCCDVQSKAPVAEVFQKLKCDRKGLTGAEGESRLRLYGPNKLEEKKESKLLKFLGFMWNPLSWVMEIAAIMAIVLANGGGRPPDWQDFVGIVSLLIINSTISYIEEANAGDAAAALMAGLAPKTKLLRDGRWEEQEAAILVPGDIISIKLGDIIPADARLLEGDPLKIDQSALTGESLPVNKHPGQEVFSGSTVKQGEIEAVVIATGVRTFFGKAAHLVDSTNNVGHFQQVLTAIGNFCIISIGAGMAVEVLVMYPIQHRAYRDGIDNLLVLLIGGIPIAMPTVLSVTMAIGSHRLSQQGAITKRMTAIEEMAGMDVLCSDKTGTLTLNKLTVDKTLIEVCSKGVDKDMVLLYAARASRVENQDAIDTCIVNMLDDPKEARAGIQEVHFLPFNPVDKRTAITYIDGNGDWHRVSKGAPEQIIELCNMAADAEKKVHALIDSYADRGLRSLGVSYQQVPEKSKDSGGDPWQFIGLLPLFDPPRHDSAETIRRALHLGVNVKMITGDQLAIAKETGRRLGMGTNMYPSTTLLGDKNSQVNGLPIDELIERADGFAGVFPEHKYEIVKRLQEMSHICGMTGDGVNDAPALKKADIGIAVDDATDAARSASDIVLTEPGLSVIVSAVLTSRAIFQRMKNYTIYAVSITIRIVLGFLLIAIIWKFDFAPFMVLIIAILNDGTIMTISKDRVKPSPTPDCWKLNEIFLTGVVLGTYMALVTVLFFYLAHDTNFFTDVFGVTSIRESERELMAALYLQVSIISQALIFVTRSRSWSFVERPGFLLLFAFFAAQMVATAIAVYARWDFCRIQGIGWRWGGAVWQFSVVTYLPLDVLKFIIRYALTGGKAGDSAQKKASSPPPTSQP

SEQ ID NO: 107987 - DNA, 3284 bp, Oryza sativa
  CDS (1)..(3189)
atgggcaagggcgggcaggaggagggcaagcggcgggacggatccgacgcatccgggtcggagccggccgcagcggccttcccggcgtgggcgcgcacgccgagcgagtgcctcgcggagctgggcgtcgcggcggaccgcgggctgtcctccgaggaggcggcggcgcggctgcggcggtacgggcccaacgagctggagcggcacgcggcgccgtcggtgtggaagctggtgctcgagcagttcgacgacacgctcgtgcgcatcctcctcgccgccgccgtggtgtcgttcgtgctcgcgctctacgacggtgcggagggcggcgaggtcggggcgaccgccttcgtggagcccctcgtcatcttcctcatcctgatagtgaacgccgtcgtcggagtctggcaggagagcaacgccgagaaggcgctcgaggcgctgaaggagatccagtccgagcacgcaaccgtcaagcgcgacggccggtggtcccatgggcttccggcgcgcgacctcgtccccggagacatcgtggagctccgtgttggcgacaaggtcccggcagacatgcgtgtgctccagcttatcagctccaccctccgtgtcgagcagggttccctcactggtgagactgcttcggttaacaagaccagccataaaatcgagctggaggacacagacatccagggaaaggagtgtatggtttttgctggcactacaattgtcaacggcagcgctgtctgtgttgtgacgggcactggaatggacactgaaataggcaagatccatgcccagatccaggaagcctcacaagaggaagatgacacgccactgaaaaagaagctcaatgagtttggggaggcactgacagccataattggggtgatctgtgccttggtttggcttatcaacgttaagtatttcctcacctgggagtatgtggatgggtggcccaggaattttaagttctcatttgagaagtgcacgtattactttgagattgcagtggcactggctgttgcagcaattccagagggcctgcctgctgttatcaccacatgcttggcgctcggcaccaggaagatggcacaaaagaatgcacttgtgaggaagttgccaagtgttgagacactgggttgcactacagtgatttgctccgataagacaggaacattgaccaccaaccagatgtcagcggtgaagcttgtggcaattgggaggtggcctgatacacttaggagctttaaggttgatggaaccacttatgatccaagtgacgggaagataaacgagtggccaagtttgagcatggatgaaaatctccagatgattgctaagattgctgcagtttgcaatgatgcaagtattgctcactctgagcatcagtatgttgccactgggatgcccacagaggctgctttgaaggttttggttgagaaaatgggccttcctggtggatatactccatccctggattcatctgatttgctaaggtgctgtcaatggtggaacaatgctgctaagagagtagctactctggagttcgatcggactagaaaatcaatgggagttattgtaaaaaaagcagactctggaaagaatttgctgcttgtcaagggagctgtagaaaatttgctagaaaggagtggctatattcagttgcttgatggatctgttgtgctcctggatgaaggtgccaaggcgctcatattatcaacacttcgtgaaatgtctgctagtgcattgcgatgtttgggttttgcgtacaaggaggatttggcggaatttgcaacatatgatggtgaagagcatgcagctcacaaatatctacttgatccttcatactactcttccatagagagtaatttgatattctgtggttttgttggtctaagggatcctccccgagaagaagtccacaaagcaattgaagactgtagagctgctggaatacgtgttatggtgattactggtgataacaaagaaacagcagaggcgatatgccgtgagattggagtttttggttccacggaagatattagttcaaagagcttcacagggaaggaattcatgtctctttcagataagaagaaactcttaaggcaaacaggtggccttctcttctctagggctgagccgaaacataagcaggagatagttagattgctcaaagaagatggtgaagtggttgctatgactggtgatggagtgaatgatgcaccagctctgaagttggctgacattggagttgctatgggcattacagggactgaggttgcaaaagaagcttcagatatggttcttgcagatgataacttcagtacaatagtcgcagctgttggtgaagggaggtcaatctacgacaatatgaaggcatttataagatatatgatctcttcaaacatcggggaagttgcttccatatttctaacgtcagctttaggtattcctgaaggtctcatccctgtgcaacttctgtgggtcaatcttgttacagatggtcctcctgcaacggctttggggttcaacccacctgataaagatatcatgaagaaacctccacgaaggagtgatgactcgttgatcactccatggatcctattccgttatatggtcattgggatgtacgttgggattgccacagtgggagtgtttatcatttggtacacacatggctctttcctgggaattgacctggctggtgatggtcactctcttgtctcgtactcccagctctcaaactggggccagtgctcctcatgggagggtttcaaggtgtcaccattcacagcaggtgcccgtacattcaacttcgatgtgaacccatgtgattacttccagggcggcaaaattaaagcgacaaccctctccctgtctgtcttggtggccattgagatgttcaactcgctgaatgcgctgtcggaggatggtagccttctgagcatgcctccgtgggttaacccttggcttcttctggcaatgtcggtttcattcgggctgcatttcttgatcctctacgtgccattccttgcccaagtctttggtattgtgcccctaagcttcaatgaatggcttttggtgatagcagttgctttcccagtggttctcatcgacgaggtccttaaatttgtggggcggtgcttgacagcccgtgccagaaaacaatcaggaaagcagaaggaagattagatgctagtcatcagtgttttagatttctagttatgtcacgaggaaccaacacctgatgtagcacaaacattattttttctcgagttccaaaggct

SEQ ID NO: 107988 - protein, 1062 aa, Oryza sativa
MGKGGQEEGKRRDGSDASGSEPAAAAFPAWARTPSECLAELGVAADRGLSSEEAAARLRRYGPNELERHAAPSVWKLVLEQFDDTLVRILLAAAVVSFVLALYDGAEGGEVGATAFVEPLVIFLILIVNAVVGVWQESNAEKALEALKEIQSEHATVKRDGRWSHGLPARDLVPGDIVELRVGDKVPADMRVLQLISSTLRVEQGSLTGETASVNKTSHKIELEDTDIQGKECMVFAGTTIVNGSAVCVVTGTGMDTEIGKIHAQIQEASQEEDDTPLKKKLNEFGEALTAIIGVICALVWLINVKYFLTWEYVDGWPRNFKFSFEKCTYYFEIAVALAVAAIPEGLPAVITTCLALGTRKMAQKNALVRKLPSVETLGCTTVICSDKTGTLTTNQMSAVKLVAIGRWPDTLRSFKVDGTTYDPSDGKINEWPSLSMDENLQMIAKIAAVCNDASIAHSEHQYVATGMPTEAALKVLVEKMGLPGGYTPSLDSSDLLRCCQWWNNAAKRVATLEFDRTRKSMGVIVKKADSGKNLLLVKGAVENLLERSGYIQLLDGSVVLLDEGAKALILSTLREMSASALRCLGFAYKEDLAEFATYDGEEHAAHKYLLDPSYYSSIESNLIFCGFVGLRDPPREEVHKAIEDCRAAGIRVMVITGDNKETAEAICREIGVFGSTEDISSKSFTGKEFMSLSDKKKLLRQTGGLLFSRAEPKHKQEIVRLLKEDGEVVAMTGDGVNDAPALKLADIGVAMGITGTEVAKEASDMVLADDNFSTIVAAVGEGRSIYDNMKAFIRYMISSNIGEVASIFLTSALGIPEGLIPVQLLWVNLVTDGPPATALGFNPPDKDIMKKPPRRSDDSLITPWILFRYMVIGMYVGIATVGVFIIWYTHGSFLGIDLAGDGHSLVSYSQLSNWGQCSSWEGFKVSPFTAGARTFNFDVNPCDYFQGGKIKATTLSLSVLVAIEMFNSLNALSEDGSLLSMPPWVNPWLLLAMSVSFGLHFLILYVPFLAQVFGIVPLSFNEWLLVIAVAFPVVLIDEVLKFVGRCLTARARKQSGKQKED

SEQ ID NO: 107989 - DNA, 2682 bp, Streptococcus pyogenes
  CDS (1)..(2682)
atgtctaaagaacaaagacatgaagcattttacacgcaaagtgaagagaccgtactggctcaattagagaccagtcgcgaaggtcttacgtctgcccaagcaaaagagcgcttagcagagtatggtcgtaatgagcttgatgaaggcgaaaaacgaagtttatttatgaaattccttgatcaatttaaggatttgatgattattattttgattgtggcagcccttctttcagttcttacagaggggatggaaggtttgacagacgccattattatcttggctgttgttatcctaaatgctgcttttggtgtttaccaagaaggacaagctgaagctgctattgaagccttgaaatcaatgtcaagtccactggctcgtattcgccgtgatgggcatgtgactgagatagactctaaagaattggtccctggagatattgtcttgctagaagcgggagatgttgtccctgctgatctgcgtcttttggaagctaactccttaaaaatcgaagaagcagcgcttactggagaatctgtaccggttgaaaaagacttgtcaacggctgtttcaaaagatgccggtattggtgatcgcgtcaatatgggatatcaaaactcaaatgtgacatatggtcgtgggattggggttatcactaacactggtatgtacaccgaggttgggcatattgctggtatgcttgctaatgctgatgagacagatacaccattgaagcaaaaccttgacaacctttctaagattttgacttatgcgatccttgtgattgcagcggtgacttttgctgttggagtcttcttgcgtggtcaacacccgcttgaaggcttgatgacttcagtagcgcttgccgttgcagctattccagagggacttcctgcgattgttactgttgtgctttctcttggaactcaagtacttgctaaacgtaacgccattatccgtaaattaccagctgttgaaacgctaggatcaactgaaatcattgcttctgataaaacgggtaccttgacaatgaaccaaatgaccgtagaaaaagtttataccaacggggcacttcaaagttcatcagctgatattgcctttgacaatacgacacttcgtgtaatgaactttgctaatgatactaaagttgatccttcagggaagttaattggtgacccaacagaaacagctttggtacagtttgggttagaccacaattttgacgtacgtgaggctatggtggcagaacctcgtgtggcagaattaccatttgattctgatcgtaagttgatgtcaaccattcataaacaagctgatggcaaatatttcatcgctgttaaaggtgcaccagatcagttattgaaacgtgtcacacagattgaagaaaatggacaaattcgtcctattacggatgctgataaaaaaaccattcttgataccaataagagtcttgccaaacaagctcttcgtgtcttgatgatggcttacaaatattctgatgctcttccaacactggaaacagaaattgttgaggctaatcttgtcttctctggtttggtaggtatgattgaccctgaacgtcctgaagcagcacaggctgttaaagtagctaaggaagctggcattcgtccaatcatgattactggtgaccaccaagatacagcaaaagctattgccaaacgtcttggtattatcgaagaagatggcgttgatcatgtctttacaggtgctgaactcaacgaattatcagatgaagagttccaaaaagtctttaaacaatactctgtgtatgcccgtgtatctcctgagcataaagttcgtatcgttaaggcttggcaaaatgaaggcaaagttgttgccatgactggtgatggggttaacgatgcaccatctcttaaaacggcagatattggtattggtatgggaattacaggtacagaggtttctaagggagcttctgacatggttcttgccgatgataactttgcaaccattatcgttgcggttgaagaaggacgtaaggtcttctcaaatattcaaaaaacaattcaatatttactttctgctaacatggcagaagtctttaccatcttccttgcaaccttgtttggttgggatgtgcttcaaccagttcacttgctttggattaacttggtaactgataccctaccagctattgctcttggtgttgaacctgctgagcctggtgtgatgaagcacaaacctcgtggacgtaagtcaagcttctttgatggtggggtgaaggaagccattctttaccaaggtgccttccaaaccattttggtgcttggggtttatggttttgccttgatgttcccagaacacacaagctaccatgatgtccatgcagatgctttgaccatggcttatgtgaccctcggtttgattcagttggtacatgcctacaacgtgaaatctgtttaccaatccatctttactgttgggttgttcaaaaacaaattgttcaactattctattccagtagcctttgtagcattgatggcaacagttgttgttcctggatttaatcaattcttccatgtgacacacttgacgatcacacaatggttagtggttattatcggaagtctcttgatggttgttcttgttgaattggtgaaagctgttcaacgatcacttggtcaagatgaaaaagcaatttaa

SEQ ID NO: 107990 - protein, 893 aa, Streptococcus pyogenes
MSKEQRHEAFYTQSEETVLAQLETSREGLTSAQAKERLAEYGRNELDEGEKRSLFMKFLDQFKDLMIIILIVAALLSVLTEGMEGLTDAIIILAVVILNAAFGVYQEGQAEAAIEALKSMSSPLARIRRDGHVTEIDSKELVPGDIVLLEAGDVVPADLRLLEANSLKIEEAALTGESVPVEKDLSTAVSKDAGIGDRVNMGYQNSNVTYGRGIGVITNTGMYTEVGHIAGMLANADETDTPLKQNLDNLSKILTYAILVIAAVTFAVGVFLRGQHPLEGLMTSVALAVAAIPEGLPAIVTVVLSLGTQVLAKRNAIIRKLPAVETLGSTEIIASDKTGTLTMNQMTVEKVYTNGALQSSSADIAFDNTTLRVMNFANDTKVDPSGKLIGDPTETALVQFGLDHNFDVREAMVAEPRVAELPFDSDRKLMSTIHKQADGKYFIAVKGAPDQLLKRVTQIEENGQIRPITDADKKTILDTNKSLAKQALRVLMMAYKYSDALPTLETEIVEANLVFSGLVGMIDPERPEAAQAVKVAKEAGIRPIMITGDHQDTAKAIAKRLGIIEEDGVDHVFTGAELNELSDEEFQKVFKQYSVYARVSPEHKVRIVKAWQNEGKVVAMTGDGVNDAPSLKTADIGIGMGITGTEVSKGASDMVLADDNFATIIVAVEEGRKVFSNIQKTIQYLLSANMAEVFTIFLATLFGWDVLQPVHLLWINLVTDTLPAIALGVEPAEPGVMKHKPRGRKSSFFDGGVKEAILYQGAFQTILVLGVYGFALMFPEHTSYHDVHADALTMAYVTLGLIQLVHAYNVKSVYQSIFTVGLFKNKLFNYSIPVAFVALMATVVVPGFNQFFHVTHLTITQWLVVIIGSLLMVVLVELVKAVQRSLGQDEKAI

SEQ ID NO: 107991 - DNA, 2610 bp, Chlorobium tepidum
  CDS (1)..(2610)
atggacggacaaggcagaaaaagcaaggagtatgaacaaaaaccggttgaggagacgctcagcgagctgaaggttgaccggactctcggtcttgatgacaaggcggtttccgaacgccggagccggttcggcttcaacgagatcgaggagaaggaggaggcactgtggcaccgcgttttccgtcgattctgggggccgattccgtggatgatcgaggtcgcggcaatcctctccgcagcggtgcagaagtgggaggattttagcatcattttcgtgatgctgctggtcaacgcgggtctcgatttcatgcaggaacaccgggcgcttaatgcgctgaagacgctgaagcagcgcctttccaaggaggtgacggtgcggcgcaacggccagttcgtgcgcgttccggtgcgcgagctggtgccgggcgacattgtgaaaatccgcatcggcgacatcgtgcccgccgacgtgcagttgctcgatggcgactacttgcagatcgaccagtccgcgctgaccggtgaatcgctgccggtgacgcgcaaaaccggcgcggtggcgttcgccaacaccatcgtcaaacagggtgagatgctcgccgtggtgctcaacaccggcatgaacacgagcttctcgtcggtggtcgccctcgtcgccgaagcgcagcgccaggagcgcagccacttccagaagatggtgatccagatcggcaacttcctcatcatggtgacgctcgtgctggtgctgctgatcgtgatggtctcgctcttccgccacgaaccgctgctcgacatcatccgcttcgcgctcgtcctgagcgtggcggccattccggtcgccttgcccgccgtgctttcggtgacaatggccgtcggcgcgatgaacctcgccaagcgccaggcgatcgtctcgcgtctggcggccatcgaggagctggcgggggtcgatattttctgcacggacaagaccggtacgctcaccaaaaaccagatggaggtggccaatcctgaggtgctcgaaggcttcaccgaacaggagctgttcctctacgccgcgctcgcctcgcgccccgaaaacaacgatccggtcgagctgccaatcttcagttatctcgatacgaagctaaagtcagttgactggaagtcgtggaagcagacgagtttcacgccgttcgacccagtcagcaagcgcaccgaggccgacgccgaaaaggatggacacacggtgcacgtggtcaagggcgcgccgcaggtggtgatcgaaatggccggactggacgaggcacgtacccggaagctcaacgattcggtgaacgaactggcttcgaaagggtaccgaacgctcggcgttggcgtgaaggagggcgagggcatgttccgcatgattggtctgattccgctctacgatccgccgcgtgaagactcgaagcaggtgatcgacgagatgcacaagtttggcgttaaggtgaagatggtgacgggcgataacctggccatcgcccgcgagatcggtggcattcttggtctcgagcagaaaacgatccgctcgtcgcagctttccggcgcgtcggccaacgaattgctcaatcttgccgaagtgcttgcgacggcgatctaccggaagctcaaaggcgatgtggaactgcgggaggccaaagcgttcgcttccgatgtgatggagcaggtcggcaagctctacgacacccggttgctggagcgcgagttcattcacacgcacgaatcggccattgtggaaatgattgaggatgtcgatattttcgccgaggtggtgcctgaggacaagtaccgcatcgtcgatacgctgcaaaaaggcgggcatatcgtctctatgaccggcgacggcgtgaacgacgcgcccgcgctcaagaaggccgactgcggcatcgcggtctctaacgccaccgacgcggcccgtgcggcggcggacatcgtgctcaccgcgcccggtctgtcggtcatcaacgcggcgatgcagcaggcgcggctcaccttcgctcgcatgaagagctacgccacctttcgtattgccgaaacgatccgcatcattcttttcatgacgctctcgatcgtggtgttcaacttctatccgattacgccgctcatgattattttgctggcgctgctcaacgatatcccgatcctcgccattgcttacgacaacagcacgattcacccaacgccggtgcgttggaagatgcaggagctgctcatcatcgccagttcgctcggtctgttcggcgttatcgcatcgttcctgctctttttcctgttgcagcaatacggcttttcggagccgatgatccagacgctgctcttcctcaagctcatcatcgccgggcacagcaccctctatgttacccgctcggaaggctggttctggcagcgcccgtggccctcgccgctgctcttcggcgcaacttttggcactgagattctcggtacgattttcgccgtttacggccttttcgtgacccccatcggctggacctacgcgcttttgatctgggcttatgctttgcttgaattcgtcatcaacgacgcgatcaagctggctgtcaagcgagtctttctgcagcgcaaccacgactga

SEQ ID NO: 107992 - protein, 869 aa, Chlorobium tepidum
MDGQGRKSKEYEQKPVEETLSELKVDRTLGLDDKAVSERRSRFGFNEIEEKEEALWHRVFRRFWGPIPWMIEVAAILSAAVQKWEDFSIIFVMLLVNAGLDFMQEHRALNALKTLKQRLSKEVTVRRNGQFVRVPVRELVPGDIVKIRIGDIVPADVQLLDGDYLQIDQSALTGESLPVTRKTGAVAFANTIVKQGEMLAVVLNTGMNTSFSSVVALVAEAQRQERSHFQKMVIQIGNFLIMVTLVLVLLIVMVSLFRHEPLLDIIRFALVLSVAAIPVALPAVLSVTMAVGAMNLAKRQAIVSRLAAIEELAGVDIFCTDKTGTLTKNQMEVANPEVLEGFTEQELFLYAALASRPENNDPVELPIFSYLDTKLKSVDWKSWKQTSFTPFDPVSKRTEADAEKDGHTVHVVKGAPQVVIEMAGLDEARTRKLNDSVNELASKGYRTLGVGVKEGEGMFRMIGLIPLYDPPREDSKQVIDEMHKFGVKVKMVTGDNLAIAREIGGILGLEQKTIRSSQLSGASANELLNLAEVLATAIYRKLKGDVELREAKAFASDVMEQVGKLYDTRLLEREFIHTHESAIVEMIEDVDIFAEVVPEDKYRIVDTLQKGGHIVSMTGDGVNDAPALKKADCGIAVSNATDAARAAADIVLTAPGLSVINAAMQQARLTFARMKSYATFRIAETIRIILFMTLSIVVFNFYPITPLMIILLALLNDIPILAIAYDNSTIHPTPVRWKMQELLIIASSLGLFGVIASFLLFFLLQQYGFSEPMIQTLLFLKLIIAGHSTLYVTRSEGWFWQRPWPSPLLFGATFGTEILGTIFAVYGLFVTPIGWTYALLIWAYALLEFVINDAIKLAVKRVFLQRNHD

SEQ ID NO: 107993 - DNA, 2871 bp, Oryza sativa
  CDS (1)..(2871)
atggctgagaaggagggcaacctcgacgccgtcctcaaggaggccgtcgacttggagaatattcccctcgaggaagtgtttgagaacctgagatgcagccgcgagggtctcacaactcagcaggcgcagcagcgcctcgaaatctttggccccaacaagcttgaggagaaggaggagagcaagttcctcaagtttttggggttcatgtggaatccactctcatgggtcatggaagctgcagctatcatggccattgcgctggcgaatggaggggggaagccaccggattggcaggactttgttggtatcataactcttcttgttatcaactcgacaatcagtttcattgaggaaaacaatgctggcaatgctgctgctgcactcatggcccgtcttgcaccaaaggccaaggtgcttcgtgatggccgatggactgaggaagaggcggccatccttgtaccaggggatatcgtaagtattaaacttggagacattatacctgcagatgcgcgtctccttgagggagatcctttgaagatcgatcagtctgccctgactggagaatcattgcctgtcaccaaaggtcctggtgatggtgtctattctggttcgactgtcaagcaaggtgagatcgaagccatagtgattgctactggtgttcacactttcttcggaaaagcagcacaccttgttgactcaactaaccaagttggtcatttccagaaggtcctgacggctattgggaatttctgcatttgctcaattgctgtgggaatgtttgttgagatcattgtaatgtaccctatccagcacagggcataccgccccgggattgacaacctccttgtccttctcattggaggcattcccatagccatgccaacagtcttatctgtgactatggcaattgggtcacaccgcttgtctcaacagggagcgatcacaaagagaatgactgcaattgaggagatggcgggcatggatgttctttgcagtgataaaactggaactttgaccttgaataagctcaccgtggacaagaacctcattgatgtctttgaaagaggaatcactcaggaccaagtgattctcatggctgctagagcatcacgaacagaaaaccaggatgctattgatactgcaatagttgggatgctagctgatccaaaagaggcccgtgctggtattcaagaagttcatttcctgccattcaatcctactgacaaaagaacagcattgacatacattgatggtgatggcaaaatgtatcgtgttagtaagggtgcacctgagcagattctccaccttgctcataacaaaccggagatagagcggagggtccatgctgtgattgacaaatttgcagaacgtggacttagatcgcttgctgtagcataccaggaagtaccagaggggacgaaagaaagccctggtggcccatggcattttgttggtctcatgccactttttgatcctccaaggcacgacagtgctgaaacaattcggcgggcacttaatcttggtgtcaatgtcaagatgatcacaggtgatcagctggcaattggaaaagaaacagggcgtcgcctgggaatgggtacaaacatgtacccttcatccgctttgctgggacagaacaaggatgagtccattgccgctttaccagttgatgatctcattgagaaagctgatggctttgctggtgtattcccagagcacaagtatgagattgtgaaacgtctgcaagcaagaaagcacatatgtggaatgactggtgatggtgtcaatgatgctccagccctaaagaaagctgacattggtattgctgttgctgatgcaactgatgcagccaggagtgcttcagatattgtgctcacagaacctggtcttagtgtgatcatcagtgctgtgcttacaagtcgtgcaattttccagcgtatgaagaactacactatctatgctgtctcaatcaccattcgtatagtgcttggatttatgctacttgcgctcatctggaaattcgatttccccccttttatggtcctaatcatagcaattctaaatgatggtaccatcatgactatatcaaaggatcgggtaaaaccatctccactacctgacagctggaagctggctgagatttttacaactggagttgtcctcggtggatacttggcaatgatgacagtaatcttcttctgggctgcatataagacagactttttcccgagaatatttcatgttgaaagccttgagaagacagctcaagatgatttccaaaaacttgcctctgctgtttacctccaagttagcaccatcagccaagctctcatctttgtcacaaggtcccgcagctggtcatttgttgagcgccctggatttctgctggtctttgctttcttggttgcacagctgattgctacactgattgctgtgtatgctgactgggcgttcacctcaatcaaaggcattgggtggggttgggctggtattgtgtggctctacaatctaatcttctacttcccactcgacattatcaagttcctcatcagatatgctttgagtgggaaagcatgggatcttgtcattgagcaaaggatcgctttcacaaggaagaaggactttggtaaggaggagagggagctcaagtgggcacatgctcagaggaccctccatggactgcagccgcctgatgccaagatgttctcggagaaggctggctacaatgagctcaatcagatggctgaagaggcgaagaggagggcggagattgccaggcttagggagctccatacgctcaaggggcatgtagaatcggttgtgaagctcaaaggcctcgacattgagaccatccagcagtcttacaccgtgtga

SEQ ID NO: 107994 - protein, 956 aa, Oryza sativa
MAEKEGNLDAVLKEAVDLENIPLEEVFENLRCSREGLTTQQAQQRLEIFGPNKLEEKEESKFLKFLGFMWNPLSWVMEAAAIMAIALANGGGKPPDWQDFVGIITLLVINSTISFIEENNAGNAAAALMARLAPKAKVLRDGRWTEEEAAILVPGDIVSIKLGDIIPADARLLEGDPLKIDQSALTGESLPVTKGPGDGVYSGSTVKQGEIEAIVIATGVHTFFGKAAHLVDSTNQVGHFQKVLTAIGNFCICSIAVGMFVEIIVMYPIQHRAYRPGIDNLLVLLIGGIPIAMPTVLSVTMAIGSHRLSQQGAITKRMTAIEEMAGMDVLCSDKTGTLTLNKLTVDKNLIDVFERGITQDQVILMAARASRTENQDAIDTAIVGMLADPKEARAGIQEVHFLPFNPTDKRTALTYIDGDGKMYRVSKGAPEQILHLAHNKPEIERRVHAVIDKFAERGLRSLAVAYQEVPEGTKESPGGPWHFVGLMPLFDPPRHDSAETIRRALNLGVNVKMITGDQLAIGKETGRRLGMGTNMYPSSALLGQNKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLAEIFTTGVVLGGYLAMMTVIFFWAAYKTDFFPRIFHVESLEKTAQDDFQKLASAVYLQVSTISQALIFVTRSRSWSFVERPGFLLVFAFLVAQLIATLIAVYADWAFTSIKGIGWGWAGIVWLYNLIFYFPLDIIKFLIRYALSGKAWDLVIEQRIAFTRKKDFGKEERELKWAHAQRTLHGLQPPDAKMFSEKAGYNELNQMAEEAKRRAEIARLRELHTLKGHVESVVKLKGLDIETIQQSYTV

SEQ ID NO: 107995 - DNA, 2874 bp, Oryza sativa
  CDS (1)..(2874)
atggccgagaagggtgacaatctggaggccgtgctcaacgagtccgtcgatctcgagaacataccgttggaggaggtgttcgagcacctgcgatgcaaccgcgagggcctcacctccgccaatgccgagcagcgcctcaacctcttcggccccaacaggctcgaggagaagaaggagagcaagttcttgaagttcttggggttcatgtggaacccactgtcctgggtcatggaggccgccgcaatcatggccatcgctctcgccaatggaggagggaagccgccggactggcaggatttcgtgggcatcattacactgctcatcatcaactccacaatcagtttcattgaggagaacaatgccggcaatgccgccgccgctctcatggctcgcctcgcccccaaggccaaggttcttagaaatggaagatggagtgaagaggaagcagccatccttgtgccgggggacatcatcagcgtcaagcttggagatatcatccctgctgatgcccgtctccttgagggtgatccgttaaagattgatcagtctgcgcttaccggtgagtcccttccggtgaccaagggccctggagatggagtgtactctggctccacatgcaagcagggtgaaatcgaggctgttgtcattgcaaccggtgtgcacacgttcttcggcaaggccgcacatcttgtcgattcgacaaaccaagttggccatttccagaaggttctgactgccatcgggaacttctgcatctgttcaattgctattggaatggttgtagagattattgtcatgtaccccatccaacacagggattaccgaccagggattgacaatcttttggtgcttctgattggaggaattcccattgccatgcccactgttctttctgtgactatggcaatcgggtcacaccgcttggctcagcagggagcaattacaaagaggatgacagctattgaggaaatggctggtatggatgttctttgcagtgacaaaacaggaacactaaccttgaacaagttgactgtggataagagtcttattgaggttttccaaagaggtgttgaccaggatactgtcatactaatggctgccagagcttcacgtaccgaaaatcaggatgccatagatgccacaatagttggtatgcttgctgatccaaaagaggctcgtgctggtattcaagaggttcattttctgccattcaatccaactgacaaaaggactgctttaacctacattgatggtgaggggaaaatgcaccgtgtaagcaagggagcaccagaacagatccttaatcttgcacacaacaaaactgagattgaaagaagagtcagagctgtaattgacaaatttgctgagcgtggcttgcgatcacttggtgtggcataccagcaagtgccagatggtaggaaagaaagtcctggaggaccatggcaatttgttgggctcttgccactttttgaccctcctcgacacgatagtgcagaaacaatcaggagggcactcaaccttggtgtcaatgttaaaatgattacaggtgaccaacttgcaataggcaaggaaacagcacgccgcttgggaatgggtactaatatgtatccctcatctgctttactgggacaagataaggatgaatcaattgtggctttgccagttgatgaattaattgagaaagctgatggctttgctggagtctttcctgagcacaagtatgagattgtgaaacgcttgcaagcaagaaaacatatatgtggtatgactggagatggtgtgaatgatgctcccgctttgaagaaggctgatattggcattgctgtggacgactcgactgatgcagcccgtagtgcctccgatattgtcctaactgagccaggccttagtgtgattattagtgctgtgcttacaagtcgagcaattttccagaggatgaagaattacactatttatgctgtttcaattacaattcgtattgtgcttggttttatgcttcttgctctgatatggaagttcgatttcccaccatttatggtcctgatcattgccatcctcaatgacggtaccataatgaccatttcaaaggacagagtaaaaccatccccacaacctgatagctggaagttatctgagatttttgcaactggggtcgtccttggtagttacttggccatgatgacagtcattttcttctgggtagcatacaagactgatttcttcccgagagtgtttcacgttgaaagccttgaaaagactgctcaggatgactttcagaagcttgcatctgctgtctatcttcaagtcagcacaatcagccaggccctcatcttcgtaactcggtctcgcagctggtcatttgtggagcgcccaggattcttgttggtttttgctttctttgtagctcaactgattgctactctgattgctgtatatgccaactggggattcgcttcaatcaagggcattggatggggctgggctggtgtcatctggctctacaacatcgtcttttacttgccactggacatcatcaagttcctgatccgttatgcgttgagtgggagggcatgggatcttgttcttgagcaaaggattgctttcacaaggaagaaggatttcggcacacaagaaaaccagctcaagtgggcgactgctcagaggaccatccatgggctccagccagccgccaccgcggctgtcttccgcgacatgacaagctacaacgatctcaaccagcttgcagaagaggcccgtaggagagccgaaatcgcaaggttgagagagctgaccaccctgaaggggcggatggagtcggtggtgaagcagaagggcttggatcttgagaccatccagcagtcatacaccgtgtga

SEQ ID NO: 107996 - protein, 957 aa, Oryza sativa
MAEKGDNLEAVLNESVDLENIPLEEVFEHLRCNREGLTSANAEQRLNLFGPNRLEEKKESKFLKFLGFMWNPLSWVMEAAAIMAIALANGGGKPPDWQDFVGIITLLIINSTISFIEENNAGNAAAALMARLAPKAKVLRNGRWSEEEAAILVPGDIISVKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAIGMVVEIIVMYPIQHRDYRPGIDNLLVLLIGGIPIAMPTVLSVTMAIGSHRLAQQGAITKRMTAIEEMAGMDVLCSDKTGTLTLNKLTVDKSLIEVFQRGVDQDTVILMAARASRTENQDAIDATIVGMLADPKEARAGIQEVHFLPFNPTDKRTALTYIDGEGKMHRVSKGAPEQILNLAHNKTEIERRVRAVIDKFAERGLRSLGVAYQQVPDGRKESPGGPWQFVGLLPLFDPPRHDSAETIRRALNLGVNVKMITGDQLAIGKETARRLGMGTNMYPSSALLGQDKDESIVALPVDELIEKADGFAGVFPEHKYEIVKRLQARKHICGMTGDGVNDAPALKKADIGIAVDDSTDAARSASDIVLTEPGLSVIISAVLTSRAIFQRMKNYTIYAVSITIRIVLGFMLLALIWKFDFPPFMVLIIAILNDGTIMTISKDRVKPSPQPDSWKLSEIFATGVVLGSYLAMMTVIFFWVAYKTDFFPRVFHVESLEKTAQDDFQKLASAVYLQVSTISQALIFVTRSRSWSFVERPGFLLVFAFFVAQLIATLIAVYANWGFASIKGIGWGWAGVIWLYNIVFYLPLDIIKFLIRYALSGRAWDLVLEQRIAFTRKKDFGTQENQLKWATAQRTIHGLQPAATAAVFRDMTSYNDLNQLAEEARRRAEIARLRELTTLKGRMESVVKQKGLDLETIQQSYTV

SEQ ID NO: 107997 - DNA, 2871 bp, Oryza sativa
  CDS (1)..(2871)
atggcggaggacaagggaggcctcgatgccgtcctcaaggagtcggtcgacttggagaacatcccgatcgaagaagtattccagaatttgaaatgctgccgacaggggctcacttccgaagaggcgcagctgcgcctgcaactttttggtccgaacaagctcgaggagaaggaggagagcaaattcctcaagttcttggggttcatgtggaatccgctgtcatgggtcatggaggctgcagctatcatggccattgcattagccaatggtggggggaagccaccagattggcaggactttgttggtatcatcacactgctacttatcaactcaactatcagtttcattgaggaaaacaatgctggcaatgctgctgctgcgctcatggcgcgtcttgcgccaaaagccaaggtgctccgaaatggtagttggactgaggaagaggcagccatccttgtgcctggggacatcatcagtattaagctgggagatatcattcccgcagatgctcgcctcctggaaggagatcctttgaagattgatcagtctgcgctgactggagagtcattgccagccaccaaaggtcctggtgacggtgtttactctggttcaacggttaagcagggtgagattgaggctgttgtgattgcaactggtgtgcacactttctttggaaaggctgcacatcttgttgattccaccaatcaagttggccatttccaaaaggttttaacagctatcgggaatttttgcatttgctcaattgctgtggggatgtttgttgagatcattgtcatgtaccctatccagcacaggccataccgccctgggattgacaacctattggtgcttctcattggaggcattcctatagcaatgcccacagtcttatctgtaaccatggcaatagggtctcatcgcttgtctcagcagggagctataacaaagagaatgactgcaattgaagagatggctggcatggatgttctttgcagtgataaaacaggaactctgactttaaataagctcacagtggacaagaatctcattgagatttttgaaagaggagtcactcaggaccaagtaattctgatggctgctagagcatcccgaacagaaaatcaagatgctattgatactgcaatagtcgggatgctcgctgatccaaaagaggcacgtgctggtattcaagaggttcacttcctgccattcaatccgactgacaagagaactgcattgacatacattgatagtgatggaaagatgtaccgtgttagtaaaggcgcaccagagcagattctcaacctggcacacaacaagacacagatagaacgacgagtccatgctgtaattgataagtttgcagaacgtggacttcgatcacttgctgtagcatatcaggaagttccagatggaaggaaagagagtcctggtgggccatggcgctttgttgctctccttccactctttgatcctccaaggcatgatagtgcagaaacaattcgaagggcacttaaccttggtgtaaatgttaagatgatcacaggtgaccaactagcgattgggaaagaaacagggcgtcgtctaggaatgggtacaaacatgtacccttcatctgctttgttgggacagaacaaggatgagtctgttgctgctttaccagttgacgatctaatcgagaaagctgatggttttgctggtgtattcccagagcacaagtatgagattgtaaaacgtctgcaagcacggaagcacatctgtggaatgactggtgatggtgtaaacgatgctccagccctaaagaaagctgatattggtatagcagttgctgatgcgactgatgcagcaaggagtgcatctgatattgtactcacagaacctggcttgagtgtgatcattagtgctgttcttaccagtcgggcgattttccagcgaatgaagaactacactatatatgctgtctcgattacaatacgtattgtgtttgggtttatgctgcttgcccttatatgggagtttgatttcccgccatttatggttctgatcattgcaattctgaatgatggtaccataatgactatatctaaggatctagtaaagccttctccactacctgacagctggaagttggctgaaattttcacaactggagttgtgctgggtggatacttggcaatgatgactgttatattcttctgggctgcatacaagaccaactttttccctaggatctttcacgtcgaaagccttgagaagacagctcaagatgactaccaaaagcttgcatctgctgtatatcttcaagttagcaccatcagccaagctcttatctttgtcacaaggtctcgcagctggtcatttatcgaacgccctggctttctacttgtctttgctttcttcgttgcacagctgatagctacattgatagctgtttatgctaactgggcattcacttcaatcaaaggcattggatggggctgggccggtatcgtgtggctctacaatctcgttttctacttcccgctcgatatcatcaagttcctcatccgatatgctctgagtgggaaagcatgggatcttgtcattgagcagagaattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcggaagaggcgaaacggagggccgagattgcaaggctcagggagcttcatacgctgaaggggcatgtggagtcagttgtgaagctgaagggcctggacattgataccattcaccagtcctacacagtgtga

SEQ ID NO: 107998 - protein, 956 aa, Oryza sativa
MAEDKGGLDAVLKESVDLENIPIEEVFQNLKCCRQGLTSEEAQLRLQLFGPNKLEEKEESKFLKFLGFMWNPLSWVMEAAAIMAIALANGGGKPPDWQDFVGIITLLLINSTISFIEENNAGNAAAALMARLAPKAKVLRNGSWTEEEAAILVPGDIISIKLGDIIPADARLLEGDPLKIDQSALTGESLPATKGPGDGVYSGSTVKQGEIEAVVIATGVHTFFGKAAHLVDSTNQVGHFQKVLTAIGNFCICSIAVGMFVEIIVMYPIQHRPYRPGIDNLLVLLIGGIPIAMPTVLSVTMAIGSHRLSQQGAITKRMTAIEEMAGMDVLCSDKTGTLTLNKLTVDKNLIEIFERGVTQDQVILMAARASRTENQDAIDTAIVGMLADPKEARAGIQEVHFLPFNPTDKRTALTYIDSDGKMYRVSKGAPEQILNLAHNKTQIERRVHAVIDKFAERGLRSLAVAYQEVPDGRKESPGGPWRFVALLPLFDPPRHDSAETIRRALNLGVNVKMITGDQLAIGKETGRRLGMGTNMYPSSALLGQNKDESVAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVFGFMLLALIWEFDFPPFMVLIIAILNDGTIMTISKDLVKPSPLPDSWKLAEIFTTGVVLGGYLAMMTVIFFWAAYKTNFFPRIFHVESLEKTAQDDYQKLASAVYLQVSTISQALIFVTRSRSWSFIERPGFLLVFAFFVAQLIATLIAVYANWAFTSIKGIGWGWAGIVWLYNLVFYFPLDIIKFLIRYALSGKAWDLVIEQRIAFTRKKDFGKEERELKWAHAHRTLHGLQPPDAKPFPEKTGYSELNQMAEEAKRRAEIARLRELHTLKGHVESVVKLKGLDIDTIHQSYTV

SEQ ID NO: 107999 - DNA, 2679 bp, Corynebacterium glutamicum
  CDS (1)..(2679)
atgtcgtcccctctccccgctgccgtcacatcaaaacccgcccacgcgctttcctctgatgaggtgttagaaaatctcggggtccaggacaccggattgacctccgcggaggcaacacagcgtttggaagcaaacgggccaaacgagcttcctcaaactccacctgaaacagtctggcaacggctattccgccaggtcaacgatccaatgatctacgttctcattgccgccgcggtactcacggcgtttcttgggcattggacagacaccatcgtgatcggcgccgttgtcatcatcaacatgatggttgggttcatccaagagggcaaagctgcggatgcgttggcatcgatccgcaacatgctctccccggaatccgcggcgttgcgcgatggggtcttccacaaaattgatgcggcagagctggtggtcggtgacgttgtgaaactatccgccggcgataaagtgcccgctgacctgcgcatgctcgccgccaccaatctgcacattgaggaatccgcgctcaccggcgaggcggaagcagtggtcaaaggtactgatccagttgaggccgacgccggaatcggcgaccgcacatccatggcgttttcaggaacgctggtgctcacaggcagcggcaccggcgtggtcaccgccaccggtgcaggcacagaaatcgggcacatcaccaccatgcttgccgacgtcgactccgtggataccccattgactcggtcgatgaaaaagttctcatcggcgttagcaatcgtgtgtgtattcctagcgatcctcatgctggtggttgccggtctagtccaccacacacctttggaagagctcattctttccgccatcggctttgcggtggctgccattccggagggtctacctgcggttatcgccatcacgctggcattgggtgtgcaaaagatggcagctcgaaatgcgattacgcgccggttgaattccgtggaaacacttggctctgtcaccaccatctgcacggataaaaccggcacactcacccgcaatgagatgacagtccgcgcaatcgccaccggtacgagtctttatgacgtcagtggagcaggctacgaacctctcggggaaatccgcttaaaagacggcgagcaagtatccaagcaggatttcccagatctctacgccatggcgttggtcgcagcgaacgtcaacgacgccgaaatttaccaagaagacggcatgtggaggctttccggcgaacccaccgacggcggtattcgtgcctttgcaatgaaaaccaacgctgaaatcttgacccgaacagccgaagtccccttcgattccgcatacaaatacatggcgacgcttcacaccatcgatggagcaaacaccatgctggtcaagggcgctcccgatcgtttattggatagaagtgcacagcagcgcaacggtgaaccacttgaccggccgtattgggaacagctcatcgaggacctcgcgtcccaaggcctccgcgtgctggctgcggcatataaagagcttccccacagcacgtcaacaattactccagaagatgttgaccagggcgaactcaccttcctcgggctctacggcatcatggatccgccacgcgaagaagtcatcgaagccatgaaagtggtgcaatcggcaggcgttcgcgtccgcatgatcaccggcgatcactcctccacggcccgcgcaatcgcccgcgaagtgggaatccgcggccagaacgtgctcaccggtgcggaaattactgcggctacggatgaggagctgcagggactcgtcgataatgctgatctttttgtgcgcaccagccccgagcacaagctgcgcgtcgtgcgcgcactgcaagctaacggcgaagtcgcgtccatgaccggcgacggcgtcaacgatgcgccagcgctaaaacaagccgacgtcggcgtcgccatgggcattaagggcaccgaagccaccaaagacgcggccgacatcgtgcttgccgacgacaatttcgccacaatcgccggcgccgtagaaatgggtcgcaccatctacgacaacctgcgcaaagccgtcgtcttcatgctccccaccaacggcgcccaaggcctcgtcattttcatcgcgatgctgctcggctgggaactgcccatcaccgcacttcaagtgctgtggatcaacctcatcaccgccatcacactgtccctggcgctgtccttcgagccggccgagcccggcatcatgaacagaaaacccagaaaccccaagagcgggcttatcgacgccccctccgtgcttcgcatcgtctatgtctccctgctgctcggcggagcaacgttctgggctttccttggcgcccgcgacgcaggaatcgacatcgacaccgcccgcaccatcgcggtcaccacccttgcagtcagccaagtgttctaccttttaagctcccgatacttcgaagtatccgcgctgcgaaaagaactcttcaccaccaacccgatttcctggctgtgcatcgcactcatgctgatcctgcaactggcctttgtctacctgccgttcatgcaaagcaccttcgacaccgccgcactgacgcttagagattgggtcatgccactggtgtttggtgttgttgtctttgcggtcgttgaaaccgagaaattcatcaggcgccttaaagcgtcttaa

SEQ ID NO: 108000 - protein, 892 aa, Corynebacterium glutamicum
MSSPLPAAVTSKPAHALSSDEVLENLGVQDTGLTSAEATQRLEANGPNELPQTPPETVWQRLFRQVNDPMIYVLIAAAVLTAFLGHWTDTIVIGAVVIINMMVGFIQEGKAADALASIRNMLSPESAALRDGVFHKIDAAELVVGDVVKLSAGDKVPADLRMLAATNLHIEESALTGEAEAVVKGTDPVEADAGIGDRTSMAFSGTLVLTGSGTGVVTATGAGTEIGHITTMLADVDSVDTPLTRSMKKFSSALAIVCVFLAILMLVVAGLVHHTPLEELILSAIGFAVAAIPEGLPAVIAITLALGVQKMAARNAITRRLNSVETLGSVTTICTDKTGTLTRNEMTVRAIATGTSLYDVSGAGYEPLGEIRLKDGEQVSKQDFPDLYAMALVAANVNDAEIYQEDGMWRLSGEPTDGGIRAFAMKTNAEILTRTAEVPFDSAYKYMATLHTIDGANTMLVKGAPDRLLDRSAQQRNGEPLDRPYWEQLIEDLASQGLRVLAAAYKELPHSTSTITPEDVDQGELTFLGLYGIMDPPREEVIEAMKVVQSAGVRVRMITGDHSSTARAIAREVGIRGQNVLTGAEITAATDEELQGLVDNADLFVRTSPEHKLRVVRALQANGEVASMTGDGVNDAPALKQADVGVAMGIKGTEATKDAADIVLADDNFATIAGAVEMGRTIYDNLRKAVVFMLPTNGAQGLVIFIAMLLGWELPITALQVLWINLITAITLSLALSFEPAEPGIMNRKPRNPKSGLIDAPSVLRIVYVSLLLGGATFWAFLGARDAGIDIDTARTIAVTTLAVSQVFYLLSSRYFEVSALRKELFTTNPISWLCIALMLILQLAFVYLPFMQSTFDTAALTLRDWVMPLVFGVVVFAVVETEKFIRRLKAS

SEQ ID NO: 108001 - DNA, 2820 bp, Methanosarcina mazei
  CDS (1)..(2820)
atgacggttcagctggatcatattatcccgtatcggcagacggctaaggaagtaatatcctcacttgatacagatgcgcggaacggtctgagcgtaggagaggctggggaacgccttaaaaaatacggcaagaacgaactgatggcagagaagcctgtgcctgcgtggaggaaattcctggctcagttccatgacgtacttgtcatcctgctgcttgttgcaacccttatatcggcaggcatgtggctttatgagcgtgattctgcacttccttacgaggcgattgcgatctttgctgtcgtactcctcaatgctattatgggctatgttcagcaggcacgagctgaggaagcaatggcagctctgcgtcagatgacggcagcacaggcaagtgtcgttcgggacggtaagcggcagaacattccggctactgagatcgtgcctggtgatattattgtcattgaagaaggcaacactatccctgcagatgcccgtgtgcttcaatcaactgcgctccaaacagccgaagcggcactgacaggtgaaagcctgccagttttgaaggacgatctcccgattacggaagaagtcggactgggcgaccgcgataatatgatctttagcggcactatagctgtttatgggcatgggcgtgcagtggtcacagcaaccggaatgcagaccgagatgggacgcattgccggcatgcttaaagaaacacctgtagagaccacgccgctccagaaggaacttcagcgcgttggcaaaatgctcgggatcattgttgtcgccattgcagtcgtgataattgcaacaatacttttagtcgaggacgtgcacggcttttcagccctttttgacgtgctcattttaggtgtggcactcgcggtcgcggctgttcctgagagcttgcctgcggttgtgacagttgtcctctctctaggtgttcagcgcatggcaaggaaaaatgctatcgtgcgccatttagcggctgtagaaactcttggctcggcgaatgttgttgcttccgataagacgggcacgctaaccaggaacgagatgaccgtacttgcggtcatcacagccagtgggcgtgtcaatctggaaggtacgggttacgctcccgaaggcggggtccataaggaaggcggagaaaaaattgatggagatctccagtttgagtttgtacgcgcacttgcagcagctgaccgggcaagcaacgctgtgttgcaagaacgcggcgggcgctgggtggtacacggagacccgactgaaggggcgttgattgttgcggcgcgaaaagccgggctggaagctgaggtactcaatgcacggctggaacgcatagcagagattcctttctcttcggaacgcaaactgatgagtacggttcataatgataccgaacaaaaggaacgtattcttgcctttaccaaaggcgcacctgatgtattacttgcccgctgtacacatgagcttgtaggggacgagatcaggtctctcactgaggagcgtcgtgcagaaattttgagaaggaatgaagaactcgcaggcgaagccctgaggactcttggggtttctttccgcgtatttccgaagaaggcgatgaagcaggaagattttgacgaggatgtggagaaggatctcgtttttctgggattgatcggcatgattgaccctccgcgcatggaggcaaaagaagcagttgcacgggcaatggctgcaggcgttcgccctattatgattacaggtgatcaccctaaaaccgccactgtaattgccgcagaacttgggattcccatccatggagaagctgtcacgggcgcggagcttgagaaaatgcctgaggataagcttgaccggacggttcaggaagtttcggtgtatgcgcgcgtcaatcccgaacacaaacttcggattgtgaaatcactgcagcgtggcggggcaattgttgcaatgaccggtgacggagtcaatgatgctcccgctttgaaaactgccgacataggcgtggcaatgggtattaccgggacagatgtctccaaagaagcctccgatatcgtcctcgcagacgataatttcgctaccattgtcgcggctgttgaagaagggcgtgcgatcttttccaatattcgcaagttcctgcgctacctgctatcctcaaacctcggggaagtaatgataatgttcttcggtctgctgctggcagatgtgatcgggcttactgaagcaggtgataatgggttagtgctgccgcttctggcaacccagatcctgtggataaatctcatctcagacggtccacctgcgctcgctctcggcgttgatcctgcggacccgggaataatgaaagaaccgccgcgcccgcgggaagaaggggtaatcactcgaagcatgtgggctggcaacctctttaccggtgcaatcatggctgtcgggaccctgctcgtactggatgccagtttacccgggggtttgattgaaggctcaggcagcctgcgttatgctcagacaatggcttttaccactgtggtcttcttttcactgtttgttgttttcaatgcacgttcggacaaacagagcgctttcatcgggatgttctcaaacaaatggctttggggagctgtttttctgtccattttactgcaggtaatggtcgtctatatcccgttcctgcaacaggcattttcaacagtgagcttgagccccgtagactggctgctctgcgcagcagtggcaagttccgtgctgtggctgcgtgaattaagcaaaatatttgtacgtgcgatggaggataaaacaaaaagagatctcacgtga

SEQ ID NO: 108002 - protein, 939 aa, Methanosarcina mazei
MTVQLDHIIPYRQTAKEVISSLDTDARNGLSVGEAGERLKKYGKNELMAEKPVPAWRKFLAQFHDVLVILLLVATLISAGMWLYERDSALPYEAIAIFAVVLLNAIMGYVQQARAEEAMAALRQMTAAQASVVRDGKRQNIPATEIVPGDIIVIEEGNTIPADARVLQSTALQTAEAALTGESLPVLKDDLPITEEVGLGDRDNMIFSGTIAVYGHGRAVVTATGMQTEMGRIAGMLKETPVETTPLQKELQRVGKMLGIIVVAIAVVIIATILLVEDVHGFSALFDVLILGVALAVAAVPESLPAVVTVVLSLGVQRMARKNAIVRHLAAVETLGSANVVASDKTGTLTRNEMTVLAVITASGRVNLEGTGYAPEGGVHKEGGEKIDGDLQFEFVRALAAADRASNAVLQERGGRWVVHGDPTEGALIVAARKAGLEAEVLNARLERIAEIPFSSERKLMSTVHNDTEQKERILAFTKGAPDVLLARCTHELVGDEIRSLTEERRAEILRRNEELAGEALRTLGVSFRVFPKKAMKQEDFDEDVEKDLVFLGLIGMIDPPRMEAKEAVARAMAAGVRPIMITGDHPKTATVIAAELGIPIHGEAVTGAELEKMPEDKLDRTVQEVSVYARVNPEHKLRIVKSLQRGGAIVAMTGDGVNDAPALKTADIGVAMGITGTDVSKEASDIVLADDNFATIVAAVEEGRAIFSNIRKFLRYLLSSNLGEVMIMFFGLLLADVIGLTEAGDNGLVLPLLATQILWINLISDGPPALALGVDPADPGIMKEPPRPREEGVITRSMWAGNLFTGAIMAVGTLLVLDASLPGGLIEGSGSLRYAQTMAFTTVVFFSLFVVFNARSDKQSAFIGMFSNKWLWGAVFLSILLQVMVVYIPFLQQAFSTVSLSPVDWLLCAAVASSVLWLRELSKIFVRAMEDKTKRDLT

SEQ ID NO: 108003 - DNA, 2838 bp, Methanosarcina mazei
  CDS (1)..(2838)
atgacaagcgtgtttttatcagatccagatgtatctgaagggaaagagaacaaacagggcccggaggaaaaagggaagaataacccatctcaggaaaagcactctgagacagagattttagaaagccattcaaaaactacttcgtggtattctctggaaaacgaagtgatattcaaaaagcttgcaacgtcttccagggggcttgatcccgaagaagtagcaatcaggcttaaagaatatggaagaaatacacttccttcaaagaaacctccgggaattgccgaaatagttatccatcagtttaaaagccctttaatttacattcttcttatagcaggagtaatatctcttctccttgatgacatcaaagatgctgcatttatttttcttgtggtaataatcaatgcggtaatcggcaccatccaggaatggaaagcagaacagagcgcatcacagctacagaccatcctgaaaataatgtccagggtaaggagagggggaaccgagagccagatttctgctgaagaactggttccgggagatatagtccttcttgaatcaggaaaccgtgttcctgctgatatccgcatttttcgtgctactaatcttactattgatgagtcactccttaccggtgaatcagaggctgtgcagaagactgcggacataatgagggaagatattccagtaagcgaccggcgcaatatggcatatgcaggaagtaccgtaattaccggacgaggctgtggagtggtgaccgcaaccggcagccgaacagaagtaggtatgattgcacgcgcagtcacggaaacggtatctgcaaaacctcctcttcttatacggatggaggagtttgctcagaaaataggaattattgttattgctgcaagtgctgttatgagcgcggttgccctttcacaggggactgcacccatagaagtttttttccttgcagtagcccttgtcgtatcagctatccctgaaggtcttcccgttggagtaacagttgcgctttccattgcttccacccggatggcaaagaggaatgtaattgtccgcaggctctctgcagtagaaagcctgggaagctgtaccacaatagcaaccgataaaaccggaaccctcacagtcaaccagcagactgccaagaaagtcctgctgcccccggaaaactattttgaagtttctggagagggatatgtcccttcaggggagataaaagaggaaaagggaagcactccagagacaaaagacatggaaaggcttcaaaaatttgcgcgggctgctgtgatctgtaatgaaggcacactttatcaggaagaggggaaatgggtccaccacggggatgctatagatgtggctttcctctcccttgcgtccaagataagcataaatccaaaggaagcaaaaaaagaagtgaaaatagttgccgaagtgcctttcgaatcagaaagaatgtacgctgctgtatattacaaggaagacaaaagcgaccacatcagggtagctgttaaaggagcaatggaagctgttcttccttactgcaggaaaatgtacacggcaggaggggaagtccctattgaccctgattccctgaacagggagctgaactcccttatggagaaagggtaccgtgcactggttgtggctgagggtccggtccagggagaaataggtaaagaggctgagctcgaatatgtaaagccagaactcacattcctgggcattgcagcttttatagacccattaaggcccgatgtcaatgaagcggtccggacctgtaaaaaggctggaattgatgtaataatgattacaggggaccacccgaaaaccgcacttgcaatagccggagagcttggaatcaccgattccagggaagaaatgctcacaggcagagagatagaagaccttggtgaccctgaacttcccactttcatgactaccctggaaaaaatccgggtgtttgcgagggtaacaccggttcagaagatgcagattgtggatgcactggtaagaagagggcattttgttgcagttacaggggacggtgtcaatgatgcccctgctctgaggcgggcaaatatcggagtggccatggggtcaggaaccgatgtggcgaaagatacctcatccatgattgtaaccgatgatacgttctcgtctattgttgcaggagtcgaggaaggaagggtcgcttatgataatataaggaaggttacacttcttctcatctcaaccgggctttcggaggttatcctgttcatacttgcccttttagtaggtttaccaatacctctgctcgcagtccagctcctctggttgaatcttgttacgaatgggattcagggggtggctctggcttttgaagcaggtgaacccggtgtgatgtacagaaaaccgagagaacccgaagaagggatctttaataacctgatgataaaagagaccctggtctcaggagcaactatagggttgatagcgtttgcagtctggatgtggttacttggagaaggctacgaagaaaactgggcaagaaacctcctgcttctcctgatggttctcttcgaaaatttccatgtattcaactgccgttctgagtaccgttccgcattccgggtgcctataaggaataattacttcctggtcataggcgtggttatgatgcaggcacttcatattttagccatgcaagtacctttcatgcagggacttctcagtataagcccggtcacatttcagagctggttcagctttttcgtaattgccgccacaattattgttgtgatggaaatattcaaaaagataagagctgctcgtgataaagatattgtgacatga

SEQ ID NO: 108004 - protein, 945 aa, Methanosarcina mazei
MTSVFLSDPDVSEGKENKQGPEEKGKNNPSQEKHSETEILESHSKTTSWYSLENEVIFKKLATSSRGLDPEEVAIRLKEYGRNTLPSKKPPGIAEIVIHQFKSPLIYILLIAGVISLLLDDIKDAAFIFLVVIINAVIGTIQEWKAEQSASQLQTILKIMSRVRRGGTESQISAEELVPGDIVLLESGNRVPADIRIFRATNLTIDESLLTGESEAVQKTADIMREDIPVSDRRNMAYAGSTVITGRGCGVVTATGSRTEVGMIARAVTETVSAKPPLLIRMEEFAQKIGIIVIAASAVMSAVALSQGTAPIEVFFLAVALVVSAIPEGLPVGVTVALSIASTRMAKRNVIVRRLSAVESLGSCTTIATDKTGTLTVNQQTAKKVLLPPENYFEVSGEGYVPSGEIKEEKGSTPETKDMERLQKFARAAVICNEGTLYQEEGKWVHHGDAIDVAFLSLASKISINPKEAKKEVKIVAEVPFESERMYAAVYYKEDKSDHIRVAVKGAMEAVLPYCRKMYTAGGEVPIDPDSLNRELNSLMEKGYRALVVAEGPVQGEIGKEAELEYVKPELTFLGIAAFIDPLRPDVNEAVRTCKKAGIDVIMITGDHPKTALAIAGELGITDSREEMLTGREIEDLGDPELPTFMTTLEKIRVFARVTPVQKMQIVDALVRRGHFVAVTGDGVNDAPALRRANIGVAMGSGTDVAKDTSSMIVTDDTFSSIVAGVEEGRVAYDNIRKVTLLLISTGLSEVILFILALLVGLPIPLLAVQLLWLNLVTNGIQGVALAFEAGEPGVMYRKPREPEEGIFNNLMIKETLVSGATIGLIAFAVWMWLLGEGYEENWARNLLLLLMVLFENFHVFNCRSEYRSAFRVPIRNNYFLVIGVVMMQALHILAMQVPFMQGLLSISPVTFQSWFSFFVIAATIIVVMEIFKKIRAARDKDIVT

SEQ ID NO: 108005 - DNA, 2733 bp, Methanosarcina mazei
  CDS (1)..(2733)
atgtactacgatcaggatatcagctcggtttttggggaactgaggacatcagtaaaggggctgagccccgaagatgccgaaaagagactggaagaatacggaaaaaacgagcttaaagaaaaagaaaaagtctctgttttcaggctctttctctcgcaatttaaaagcattctaattctcatccttgtaattgctgccatcgtttcggctcttcttggcgaagccattgatgctgctgtgattttatttaccgtttttcttgccggaatcctcggttttgttcaagagtacagggctgaaaaagcaatcgagctccttaaatctcttacatccccggaagcaactgtagtacgaaatggcagtgaaaaaaaaatcccctcaacctatctggttcccggagacattattttgctccagaccggggaccgtattcctgcagatgccaggataattgaagagtttaacctcaaagtcgatgaatcctcccttaccggggaatccgtacctgcccagaaggttaccgatgccctgccggcaggcacttccgaggctgacaggaataatatggtctatgcagggactgcggttgcttatgggagagggaaagccgttattacggcaacaggcatgaaaacctcttttggagaacttgccgggcttctggggacaatagaaaggtcaaggactcctctccaggaaagccttgacaaattcggcaggtggatcggcggggcgaccatagtaatcgtagcttttgttgcagttctgggtgtttttttaggctttccacctcttgatatgtttctctggggggttgcgcttgcagttgctgccatacctgaagctctgcctgcggttgtcactgtggggctcgggcttggagtaaggcgcatggtcaaaaggcatgcccttgtaagaaaacttccttccgtagaaacccttggtgctaccaatgtcatatgttcggataaaacaggcacgcttacccagaataaaatgacagttgagaggatttatgttgacaggcagattctcagggtcacgggaggcggatatgacccggatgggaaattcctgaaaggagattcggagaaagaagaccctgaggtctccggggacgatattcaccttagggtcctgctgctctcggctgctttatgtaacgattcaaacctctataaagaagaagacgggtggaaaatcaggggagacccgacagaagcagctcttgtggtcgctgcggcaaaggctggttttgaaaaatccgaacttgacagtaaatatcccaggcttgcggaaattcctttttcttccgaaagcaagagaatgaccacttttaataaactggatgattttcccggggatgtacttgattccgaactggtagctttttcgaaaggggctcctgaggttattctcggttcatgcacgaagattttccttgacggcgaaataaaaactttaacccatgggcagaagcaggagatcttagaggaagtaaaagagcttgctgaccaggctctgagagtcatggctttttctttccgcccgtttgaagagggattctctcccgaaaaaatctcttccgggaaaatccctgtggaacgggccgaagaagatatggttttttcaggtttaactggcatgagagaccctcccagagaagaggtaaaggctgcgatcagaacctgcgaggatgccggaatcaagaccgtgatgataaccggggaccataaggttacagcggctgcaatcgcccgggaactcggtattctgaaagagaacgacctgacacttacaggttcggaacttgacagccttgaagaaaaagaatttgaggacagggttgagagggtctcggtttatgcacgtgtctaccctgcccacaaattgagggttgtggaagcccttaaaaagaaaggctatgttgtggcaatgacaggtgacggggtaaacgatgcccctgcccttaaagctgcggacatgggcatagccatgggtatcacgggcacggacgtcagtaaagaagcttcaagcatgatccttaccgatgataattttgcgtcaatcgtctcggcagttgaagaaggccggaatatctttaaaaatattagaaacttcatcacatacgggcttacctgccacataggggaggtactgatcgttctcatagcaatcctgggctggcagatacttcctcttatggctgtacagatcctgtggattaacctcattacagacgggcttcctcctatggctctttcagttgagcctcctgatagggggcttatgaggcagaagcccaggaacgttgaagaagggcttattacacgccgtgagataactgccgggctcggaatagggatccttgtcactttgcaggcactgatagttttagtctggtctctggagagcggcttttccctttccaaactgcagacaatggtttttacacttgtagtattttcagagatgtttaatgcctttaactggcggtctgacaggtattcggtcttttctctggggctgtttacaaacaaagccctgatttacgcagtccttaccacggtggtcctgcagttgatggttatttatgtcccgttccttcaacttgctttcagtacagttcccctttcccttccggaatgggggatcatactcgctttagcctccaccaccctcatttccatggaaattgtaaagcacataaataacgggaaaagggctgattaa

SEQ ID NO: 108006 - protein, 910 aa, Methanosarcina mazei
MYYDQDISSVFGELRTSVKGLSPEDAEKRLEEYGKNELKEKEKVSVFRLFLSQFKSILILILVIAAIVSALLGEAIDAAVILFTVFLAGILGFVQEYRAEKAIELLKSLTSPEATVVRNGSEKKIPSTYLVPGDIILLQTGDRIPADARIIEEFNLKVDESSLTGESVPAQKVTDALPAGTSEADRNNMVYAGTAVAYGRGKAVITATGMKTSFGELAGLLGTIERSRTPLQESLDKFGRWIGGATIVIVAFVAVLGVFLGFPPLDMFLWGVALAVAAIPEALPAVVTVGLGLGVRRMVKRHALVRKLPSVETLGATNVICSDKTGTLTQNKMTVERIYVDRQILRVTGGGYDPDGKFLKGDSEKEDPEVSGDDIHLRVLLLSAALCNDSNLYKEEDGWKIRGDPTEAALVVAAAKAGFEKSELDSKYPRLAEIPFSSESKRMTTFNKLDDFPGDVLDSELVAFSKGAPEVILGSCTKIFLDGEIKTLTHGQKQEILEEVKELADQALRVMAFSFRPFEEGFSPEKISSGKIPVERAEEDMVFSGLTGMRDPPREEVKAAIRTCEDAGIKTVMITGDHKVTAAAIARELGILKENDLTLTGSELDSLEEKEFEDRVERVSVYARVYPAHKLRVVEALKKKGYVVAMTGDGVNDAPALKAADMGIAMGITGTDVSKEASSMILTDDNFASIVSAVEEGRNIFKNIRNFITYGLTCHIGEVLIVLIAILGWQILPLMAVQILWINLITDGLPPMALSVEPPDRGLMRQKPRNVEEGLITRREITAGLGIGILVTLQALIVLVWSLESGFSLSKLQTMVFTLVVFSEMFNAFNWRSDRYSVFSLGLFTNKALIYAVLTTVVLQLMVIYVPFLQLAFSTVPLSLPEWGIILALASTTLISMEIVKHINNGKRAD

SEQ ID NO: 108007 - DNA, 3116 bp, Rattus norvegicus
  CDS (101)..(2935)
cgcagcaccagccgcggcctcgctagggccccagggaagcgggctgggactacgacctgccccacgcccggctgtggagcagcctggacaccagctcaccatggggagacgcttcaagtttctgcagaaactggccttcttgggccagaaccaccggtacaaggcgctagaaagggacgaggtggacaccctgattgatgaacagtacgagctgaaagctatcgaaagagaaaaggcagtcgctgccctgccacccagggaagcgtgcaaatgcagcaaggaggagttggccagaaccttccacgtggacctggacagcggcctgtcagaatttgcagtagcccagcgtaggctggtccatggctggaacgagtttgtcactgataacactgagcctgtgtggaagaaatacctggatcagttcaggaaccccctgatcctgctgctgctgggctcatccgtggtgagcgtcctcaccaaagagtatgaagacgccatcagcattgccctggccgtcctcatcgtggtgactgttggcttcatccaggagtacaggtcggagaagtctctggaagagctcaccaagctagtacctccagagtgcaactgcctgagagacggcaagctccggcacatgctcgcccgagacctggttccaggagacgttgtgtccttgtccatgggagaccggatccctgccgatatccgactcactgaggtcacagatctcctggtggatgaatccagcttcacaggagaagtggagccatgcagcaaaacagacagcccattggcgggcggcggggatctcagcaccctgagcaacgtggtcttcatggggacgctggtgcagtgcgggaagggtcagggggtcgtgatcggaaccggggagcagtctcagtttggagaagtttttaagatgatgcgggcagaagagacacctaaaactccattacagaagagcatggacaagctaggcaagcaactgaccgtcttttcctttggcatcatcggtctcctgatgctggttggctgggtgcaggggaaaccccttctcagcatgttcactatcggggtcagtctagctgtggcggccattccagaggggctgcccatcgttgtcatggtgacgctggtcctgggggtgctgcggatggctaagaagcgggtcatcgtgaagaagctgcccattgtagagactctcggttgctgtaacgtcatctgctctgacaagactggcactctgacagccaacgaaatgacagcaacccagcttgtcacgtccgatggcttccatgccgaggtcagtggcattggatacagtggcgaagggactgtgtgtcttctgccctccaaggaagtaatcaaagaattcagcaatgtgtcagtggggaagctggtggaggcaggctgcgtcgccaacaacgctgtcgtcaggaagaacgccgtaatggggcagcccacagaaggggccttggtggtgctggccatgaagatgaacttaggcagcatcaaagattcctacatacggaagaaggaaattcccttcagctcggagcagaagtggatggcagtgaggtgcagcctgaagaatgaggatgaggaagatgtttacttcatgaagggagcctttgaggaagtgatccatcactgcagcacgtataacaatgggggcatcccactgcctctgacaccccagcagaagtcctattgccagcaggaagagaagaagatggggtcgctcggccttcgggtgctggccctggcgtctggacctgagctgggaaggctgacattcctcggtctggtgggcatcatcgaccccccaagggctggcgtgaaggaagcggtccaggccctctcggagtctgatgtgtcagttaagatggtgacaggggatgctctggagactgccttggccataggaagaaccatcggcctgtgcgacgagaagctgaaagctatgtccggggaggaggtggagggcatggagcaggacgcactggcagcccgagtgaggcaggtgtctgtattcttcaggaccagcccaaagcacaaggttaaaatcataaaggcattgcaggagtcgggggcaattgtagccatgacgggggatggagtgaatgactcagttgccctgaagtctgcggacatcgggattgccatgggacagacaggaacagacgtcagcaaagaggccgctgacatgattctggtggacgacgacttctcggccattatgagtgcagtggaggaaggtaagggcatcttctacaacatcaagaactttgtccgcttccagctgagcacgagcatcgcagccctgagcctcatcaccctgtccaccgtgtgcaacctgcccaaccccctcaatgccatgcagatcctgtgggtgaacatcatcatggacggaccaccggcccagagcctaggggtggaacctgtggacagagatgccctgaagaggcctcctcggagcgtcaaggacacgatcctgaacagagccctgatcctgaagatcctcatgtcggctgctgttatcttaggggggaccctgttcatcttctggagagagatcccagagaaccgtaccagcaccccacgcaccaccaccatggccttcacctgcttcgtgtttttcgacctcttcaatgctctaagctgccgctctcagaccaagctgatatttgagattggctttttccggaaccgcatgttcctgtactcgatccttgggtccctcctcgggcagctggccgtgatctatgccccgcccttgcagaaggtcttccagaccgaaaacctgagcgcgctcgacctgctgctgctgactggcctggcctcgtccgtcttcatcttgtccgagctgctcaagctatgtgaaaagttctgctccagagccaaggctgatcagatgctcccggaggccgtgtaaaggaaccagggtgtcatggctgactgacttgtgtccttgggtgcctctggcctggccccgtccttctgcactatctgctccaagaggcagattttaggactgtgcagcatcctgcacaggacagggtggagcttatactgaaacatggcgctatttattaaaccaccgtggtttttattta

SEQ ID NO: 108008 - protein, 944 aa, Rattus norvegicus
MGRRFKFLQKLAFLGQNHRYKALERDEVDTLIDEQYELKAIEREKAVAALPPREACKCSKEELARTFHVDLDSGLSEFAVAQRRLVHGWNEFVTDNTEPVWKKYLDQFRNPLILLLLGSSVVSVLTKEYEDAISIALAVLIVVTVGFIQEYRSEKSLEELTKLVPPECNCLRDGKLRHMLARDLVPGDVVSLSMGDRIPADIRLTEVTDLLVDESSFTGEVEPCSKTDSPLAGGGDLSTLSNVVFMGTLVQCGKGQGVVIGTGEQSQFGEVFKMMRAEETPKTPLQKSMDKLGKQLTVFSFGIIGLLMLVGWVQGKPLLSMFTIGVSLAVAAIPEGLPIVVMVTLVLGVLRMAKKRVIVKKLPIVETLGCCNVICSDKTGTLTANEMTATQLVTSDGFHAEVSGIGYSGEGTVCLLPSKEVIKEFSNVSVGKLVEAGCVANNAVVRKNAVMGQPTEGALVVLAMKMNLGSIKDSYIRKKEIPFSSEQKWMAVRCSLKNEDEEDVYFMKGAFEEVIHHCSTYNNGGIPLPLTPQQKSYCQQEEKKMGSLGLRVLALASGPELGRLTFLGLVGIIDPPRAGVKEAVQALSESDVSVKMVTGDALETALAIGRTIGLCDEKLKAMSGEEVEGMEQDALAARVRQVSVFFRTSPKHKVKIIKALQESGAIVAMTGDGVNDSVALKSADIGIAMGQTGTDVSKEAADMILVDDDFSAIMSAVEEGKGIFYNIKNFVRFQLSTSIAALSLITLSTVCNLPNPLNAMQILWVNIIMDGPPAQSLGVEPVDRDALKRPPRSVKDTILNRALILKILMSAAVILGGTLFIFWREIPENRTSTPRTTTMAFTCFVFFDLFNALSCRSQTKLIFEIGFFRNRMFLYSILGSLLGQLAVIYAPPLQKVFQTENLSALDLLLLTGLASSVFILSELLKLCEKFCSRAKADQMLPEAV

SEQ ID NO: 108009 - DNA, 2709 bp, Thermoanaerobacter tengcongensis
  CDS (1)..(2709)
atgataaagattgcaaagaaaaacggtgcaagtgatgcaatttttgctcagctagtaaattttgcaaaaaaagatattgatgaggtgcttgcaagcttagggactgatagagatggattgactgtagaagaagcagaagaaagacttgaaatgtacggtctaaatgaagtagctcatgaaaaaccagctccttggtatgtccagcttgtgaaagcttttataaatccatttataggaatcctcgtatttctggcaattgtatcatatataactgacgtcttgttcgtcttacctcaagacagggactggagcaccatcataataatttctataatggtcctagttagcggacttctgcgctttgtgcaggagtatcgctctaacatagaggctgaaaaactaaaagctatggttcacacaacagcagcagttaaaaggaaagaaacaggtgtaaaggaaataaaaatggaagagatagttccaggagacataatacaccttgcagcaggagatatggtaccggcggatttgagggtcattacttcaaaagaccttttcataaaccaggctactttaactggtgaatctgaacctgtagagaaatatccgaatttgaaggaagagaagagaaaagctgaaagcttatctatatccgatttagaaaatatatgttttatggggacgagcgttgtcagcggttctgcgattggggttgtgatttcgacaggggagcgcacttactttggttcaatggcaaagacactggtcggccaaagagctatgacgagctttgaaaagggtattgacaatgtgagcagactccttatcaaattcatggcagctatgttcccagtagtttttatagtcaatgggctgacaaaaggaaactggcttgacgctttgctgtttgcactggcggtggcagtgggattgacacctgaaatgctcccaatgattgtgactacaaacctcgccaaaggtgctgtagcaatggcaaagcacaagactatagtgaaaaggcttgatgcaatacagaattttggagcgatggatatactctgcacagataaaactggaactttgactttgaataaaatagtcttagaaaagcacctggatatccatgggaatgaagatgacagagtgctaagacatgcctttttaaatagttactaccagacaggcttgagaaaccttcttgacatagcaattttagaatacggcgaagaaaagggaatgaaaggatcagagcttgagaagatttataaaaaggtcgatgaaataccctttgattttgtaagaagaagaatgtctgtcgtgctagagagcgaaaatggggttggtggtaaaaagaggcaattagttactaaaggcgctgtagaggagatgctttccatttgtgattgggttgagtataaaggagaagtagtgccattgacagaagagataaaagaagaggctttagaaatggtgagaaagcttaatgaagatgggatgagagtgctggcagtggcacagaagaacgaagttcctccagaaggcgtgttcagtgtggcagatgagagcaagatggtattgatgggatttttggcatttctcgatccgccaaaagagacagcccctcatgctataaaggctttgaaagaacacggagttgaagtgaagattctgacaggtgacaatgaaatagtgacaaagaaagtttgtaaagaagttggaatacctgtgcagaatgtacttttgggtgaagagatagagaatatgacagatgatgagctggctgaaatagcagaaagaaccacaatttttgcaaaacttactccaatgcaaaaggcaaggataatcaaggcattgaggaccaaaggacatgtagtaggatttttgggggatggaataaatgatgctcctgccatgagagaagcagatgtagcaatttctgttgataacgctgttgatattgccaaagagtctgctgatataattctcttagagaagagcttgatggttttggaagaaggggtagtagaagggcgcaaaatcttcggcaatatcatgaagtacattgcaattacggcaagctccaattttggcaacgtattttcggtgcttgtagccagcgctttcttacccttcttgccaatggcgccgttacaacttttgttcctcaatttaacttatgacctttcaatggcatcaataccttgggacagaatggatagagagtatatagaaaagccgagaaaatgggatgctgcaaacatagggcattttatgatctggtttggacctaccagttccatttttgatataacgacttacgccttgatgttctttgtggttggtccaatggtaataggaggctcttatttcctgttgcctgctgagttaaaagcccaatttgtttctcttttccagactggttggtttgtagagagcttgtggacacagactatggttgtgcatatgctgagaacagagaaagtgccatttatacagagcatgccagcatggcctcttttcctctttacaatgacagctatacttgttggaacagttgttccgtttactacatttggagcacagcttggcatgagacctctacctttaacatattttgggatagtattgataccaacaatactggcatatttgactttggctcagtacgtgaaaaccaggtttataaaaagatttggcactttattataa

SEQ ID NO: 108010 - protein, 902 aa, Thermoanaerobacter tengcongensis
MIKIAKKNGASDAIFAQLVNFAKKDIDEVLASLGTDRDGLTVEEAEERLEMYGLNEVAHEKPAPWYVQLVKAFINPFIGILVFLAIVSYITDVLFVLPQDRDWSTIIIISIMVLVSGLLRFVQEYRSNIEAEKLKAMVHTTAAVKRKETGVKEIKMEEIVPGDIIHLAAGDMVPADLRVITSKDLFINQATLTGESEPVEKYPNLKEEKRKAESLSISDLENICFMGTSVVSGSAIGVVISTGERTYFGSMAKTLVGQRAMTSFEKGIDNVSRLLIKFMAAMFPVVFIVNGLTKGNWLDALLFALAVAVGLTPEMLPMIVTTNLAKGAVAMAKHKTIVKRLDAIQNFGAMDILCTDKTGTLTLNKIVLEKHLDIHGNEDDRVLRHAFLNSYYQTGLRNLLDIAILEYGEEKGMKGSELEKIYKKVDEIPFDFVRRRMSVVLESENGVGGKKRQLVTKGAVEEMLSICDWVEYKGEVVPLTEEIKEEALEMVRKLNEDGMRVLAVAQKNEVPPEGVFSVADESKMVLMGFLAFLDPPKETAPHAIKALKEHGVEVKILTGDNEIVTKKVCKEVGIPVQNVLLGEEIENMTDDELAEIAERTTIFAKLTPMQKARIIKALRTKGHVVGFLGDGINDAPAMREADVAISVDNAVDIAKESADIILLEKSLMVLEEGVVEGRKIFGNIMKYIAITASSNFGNVFSVLVASAFLPFLPMAPLQLLFLNLTYDLSMASIPWDRMDREYIEKPRKWDAANIGHFMIWFGPTSSIFDITTYALMFFVVGPMVIGGSYFLLPAELKAQFVSLFQTGWFVESLWTQTMVVHMLRTEKVPFIQSMPAWPLFLFTMTAILVGTVVPFTTFGAQLGMRPLPLTYFGIVLIPTILAYLTLAQYVKTRFIKRFGTLL

SEQ ID NO: 108011 - DNA, 2616 bp, Thermoanaerobacter tengcongensis
  CDS (1)..(2616)
atggaaagatactgggctatgacagcagaaaaagtggttgaaaagttaaaaacagattgtgagaagggactttcagatgaagaagctataaggagattaactgaatatggcgaaaattcgttagaggaagaaaaaataaaatcacctttaaggatggttattgaacaatttaaagattacctggtgataatactgataatagcttctgtaatctccttttttcttaaagaagcaatagatggaattttaatattagccattgtaattttaaatgctctgataggtacattacaagaatacaaagctgaaaaatctattacagctcttaaaaaactttctcaaccttttaccaaagttataagggaaggaaaattaaaggaggtgaatgtaaccgatattgtggtaggagatgtggtagttataggaagtggagatgtaattcctgcagatggcaggttaatagaagcgaaaaatctacgcattgatgaagcacctttgacgggagaatctgttcctgcagaaaaaacggaaaaagaattggaagataaagaaatacctttaggtgatagaaaaaatatggtttatatgggtacaaatgtagtgtacgggagaggaaaattcattataactgccacggggatgaatacagagataggcaaaattgcttctctgataaggtcggaaaaagaagtcaaaactcctctccagattagactggaagagctaggaaagattttaggtacagccatattactgctgtgtgcagtgatgtttgtaataggaagtttattgcaaaatagaccattgtttgatatgttcttaacatctgtaagtttagcagtagcggcaattccggaagggttacctgccattattactattactttggctttgggtattcaaaaaatggtaaaaagaaatgcgataataagaaggctttcatcggtagagacccttggaagcacaagtgtgatttgttctgacaaaacaggaacgcttacagaaaacaagatggctgttgttaaaatgtatgtggacgaaagagaaatagatataaatgaggagaaggaaattgaaaaatcagaaaaatttcttattgaaagcgcggctctatgtactgatgttgccatagatacaactggtcaaatgataggagatcctacggaaatagctttggtggttgctttaaatagagtaacaggattaaaaaaagaggaattagaaaaaagatttccaagagtagaggaaattccttttgaatcagaaagaaagatgatgtcaactatccattctattgaaggaaagacatttagagtaataaccaaaggagcgcctgactatgtaatcaaaatgtgtggatatgtattgaagaaaaacagaataattcctttagataaaaatgaagtagaaaccattcttcgtgttaatgaaaaaatgggacagcaagggttaagaattcttggtgttgcttataaagagttgacaaaattacctgaaaaacttgtaagtgaagaggtagaaaatgacctgatttttataggccttgtggctttgatggacccaccgcggaaagaagttagggaagctgttgaagtatgcaaaagagcgggaataaagcctgtgatgataaccggcgaccataagattacagcttctgttatagctagagaaattggaattttagaagaaggaaataaaatattaagcggagaggaactagaaaaaatttcagatgaaaagctaactgaaattgttaaagagatttctgtttttgcccgtgtttctcctcagcacaaattaagaattgttaaagcgtggcagaaaaataacgctgtggtagctgttacaggtgatggagtaaacgatgctccagcactcaagcaagctgatattggaattgctatgggtattacaggtacagaagtggctaaagaggcttctgacatgattttaaaaggtgataattttgccacaattgttgctgcagtagaagaaggcagaactatatttgcaaatataaaaaaagcaattcattacttgctgagctgtaattttggtgaaatttttgcactttttgtagctactattttaggaatgtctcttccactaaaacccgtacacatactttgggcaaacctagtaacagatagtttgccggctttggcgtttggattcgaaccttctcaagaagatataatgaaaaaaccacctagaccaaaagatgaaagcattttttctgggggattgatatataggattccttttgagggagctgttatcggaatagtcacacttattgcttttattgtggggctcgagaagggaataaatgtgggcagaacaatggcttttgcagtgatgaatctgtctgaattggtccaggctttaaatgttaagtcagaaaagataggaattagggataagttttccaacaagcatatggttattgcgttcctgataggagtaatatttgtactcgctttagttatgactccactaaatgaaatttttgatttttctcctattagttattatcaatggaatgttgtaatactcttgtcacttattcctctattgacgggtgaaataatgaggcttagaaaaaattttagataa

SEQ ID NO: 108012 - protein, 871 aa, Thermoanaerobacter tengcongensis
MERYWAMTAEKVVEKLKTDCEKGLSDEEAIRRLTEYGENSLEEEKIKSPLRMVIEQFKDYLVIILIIASVISFFLKEAIDGILILAIVILNALIGTLQEYKAEKSITALKKLSQPFTKVIREGKLKEVNVTDIVVGDVVVIGSGDVIPADGRLIEAKNLRIDEAPLTGESVPAEKTEKELEDKEIPLGDRKNMVYMGTNVVYGRGKFIITATGMNTEIGKIASLIRSEKEVKTPLQIRLEELGKILGTAILLLCAVMFVIGSLLQNRPLFDMFLTSVSLAVAAIPEGLPAIITITLALGIQKMVKRNAIIRRLSSVETLGSTSVICSDKTGTLTENKMAVVKMYVDEREIDINEEKEIEKSEKFLIESAALCTDVAIDTTGQMIGDPTEIALVVALNRVTGLKKEELEKRFPRVEEIPFESERKMMSTIHSIEGKTFRVITKGAPDYVIKMCGYVLKKNRIIPLDKNEVETILRVNEKMGQQGLRILGVAYKELTKLPEKLVSEEVENDLIFIGLVALMDPPRKEVREAVEVCKRAGIKPVMITGDHKITASVIAREIGILEEGNKILSGEELEKISDEKLTEIVKEISVFARVSPQHKLRIVKAWQKNNAVVAVTGDGVNDAPALKQADIGIAMGITGTEVAKEASDMILKGDNFATIVAAVEEGRTIFANIKKAIHYLLSCNFGEIFALFVATILGMSLPLKPVHILWANLVTDSLPALAFGFEPSQEDIMKKPPRPKDESIFSGGLIYRIPFEGAVIGIVTLIAFIVGLEKGINVGRTMAFAVMNLSELVQALNVKSEKIGIRDKFSNKHMVIAFLIGVIFVLALVMTPLNEIFDFSPISYYQWNVVILLSLIPLLTGEIMRLRKNFR

SEQ ID NO: 108013 - DNA, 2673 bp, Thermoanaerobacter tengcongensis
  CDS (1)..(2673)
atggcaaaaggtacttcgcaacagacaatctattatttagacaagataaattttaaagggctgacttctcaagaagcgcagaaaaggcttttaaagtacggtccaaatgttttagaggaaggtggcagaataagtcctattcaaatttttttaaaccagtttcaggactttatggtgatggtgcttttggctgccactttgatttcgacccttatgggagagctggcagatgccttgactataactgtaattgtcatcttgaatgcgattttgggttttgttcaggagtataagacagaaaagtcgctagaagccctaaaaaaacttgctgctccttcagcaaaagttttaagagatggggaggagaaagaggtagaagcttcacagattgtcatagacgatgtaatacttctgggagcaggagataaggttccggccgatgctcttttaatagaagctcataatttagaagttgatgaatcaattctgacaggggaatcagtgcctgtccataaagaagcacctttgaatctgaataggacagtagttgaaagccgcaacatggtatatatgggtacagtggtgacaaaaggcaaggggaaagcagttgtcactgcaactggcatgcagacagagatgggtaaaatcgctgggatgatgaaggagattgaaggggaagaaactcctttacaaaaaaggcttaacaagctaggaaaagtgttggtagttttagcgctttttatatgcggcgttgtcacggtgatggggataataagaggggaacctatttactacatgtttttgtcaggagtgagccttgcggtagcggcaataccggaagggcttcctgctgttgttacaatttctctagcgattggcgtgcagaggatgcttaagagaaatgctttgataagaaaactgccagcggtggaaactctgggttgcacaaatgtgatttgcacagataaaaccggcactttgacagagaataaaatgactgttacaaaggtgttttgcgatgaagaagtttttgatgtgagagggaaagaaaatgaggagttaattaaaaagaaaaatatatctagaagtgctttaagaaagatgttagaaataggagctttgtgcaacaatgtaaagatcaaaaaagaaagcataaagataggaagagaagtgttagaagaggataagtacataggagaccctactgaggctgctattttttctttttcgttaaaatcaggcatttcacaggattttttgaataagataaagagaattgaggaaattccttttgattcggagagaaagagaatgactgtaattgtggaaatagatggggagaaatacgcttatacaaaaggggctccagatgtcatattggaactttgtagtttcaaatatgtaaacggaaaggaagttcctttgacgccttttgacaaaaagagggtgctggatgttaatgaatcttttgggaaagaggctttgagagttttagcttttgcctataagaaacttcctcctaaatctccgattattgctgaatttgtagaaaggaatctggtttttgtagggctagaaggtatgatagaccctccaagaaaagaggtatacgatgcggttttaaagtgcaagatggcagggataaaacctgtcatgataacgggagaccataaagttacagcgactgctatagcgaaagaacttaacatactgggagaaggggaaagagttattacaggcaaagatttagatgagatgactgacaaggagttagagaaaacctgcacaaatgtaagtgtttatgctagggtgactcctaagcataagtacagaattgtaagggctcttaaaaatagagggtttactgttgctatgacaggagatggggtcaatgacgctccggctctgaaagaggcggatattggaattgctatgggcaaaggagggacagaggttgcaaaggaagcttcttctatgattttattggatgataattttgccactattgttgcagctgttgaagaaggaagaataatttatgacaatataaagaaatttatacgctttttgctttcatgcaatttcggagaagttttgacaatgttttttgcagcccttatgtctttgaaactgcctcttgtacccatacagatattgatggtaaatcttgttacagatgggctccctgctctggctttaggtcttgacccgcctgaaaaggacataatgaggatgaagccaagagatgcaaatgagagcgttttttcaaggggattgggattgaggatattcatagttggggttttaataggaataagcactgtaggggcatatgtgtttgcactgggatacgctggccttgaaaaagccaggactattgcttttgctacactggttactgttgagatgatacacgcttttgaatgtaggtctgaaagacatttgatttttgaactaggttttttcaccaatccctatctggtgctggcagtgttaagctctttcttgatttttttatccacggtttacataaagcctctgggtgtgattttcaaaacagtgcctcttgatgcttatgattggctggtcgtggtatttttctcatctatagaatttgtcttcaacaatctttacacagcctacataatccctcatttgagaaaagaagagtaa

SEQ ID NO: 108014 - protein, 890 aa, Thermoanaerobacter tengcongensis
MAKGTSQQTIYYLDKINFKGLTSQEAQKRLLKYGPNVLEEGGRISPIQIFLNQFQDFMVMVLLAATLISTLMGELADALTITVIVILNAILGFVQEYKTEKSLEALKKLAAPSAKVLRDGEEKEVEASQIVIDDVILLGAGDKVPADALLIEAHNLEVDESILTGESVPVHKEAPLNLNRTVVESRNMVYMGTVVTKGKGKAVVTATGMQTEMGKIAGMMKEIEGEETPLQKRLNKLGKVLVVLALFICGVVTVMGIIRGEPIYYMFLSGVSLAVAAIPEGLPAVVTISLAIGVQRMLKRNALIRKLPAVETLGCTNVICTDKTGTLTENKMTVTKVFCDEEVFDVRGKENEELIKKKNISRSALRKMLEIGALCNNVKIKKESIKIGREVLEEDKYIGDPTEAAIFSFSLKSGISQDFLNKIKRIEEIPFDSERKRMTVIVEIDGEKYAYTKGAPDVILELCSFKYVNGKEVPLTPFDKKRVLDVNESFGKEALRVLAFAYKKLPPKSPIIAEFVERNLVFVGLEGMIDPPRKEVYDAVLKCKMAGIKPVMITGDHKVTATAIAKELNILGEGERVITGKDLDEMTDKELEKTCTNVSVYARVTPKHKYRIVRALKNRGFTVAMTGDGVNDAPALKEADIGIAMGKGGTEVAKEASSMILLDDNFATIVAAVEEGRIIYDNIKKFIRFLLSCNFGEVLTMFFAALMSLKLPLVPIQILMVNLVTDGLPALALGLDPPEKDIMRMKPRDANESVFSRGLGLRIFIVGVLIGISTVGAYVFALGYAGLEKARTIAFATLVTVEMIHAFECRSERHLIFELGFFTNPYLVLAVLSSFLIFLSTVYIKPLGVIFKTVPLDAYDWLVVVFFSSIEFVFNNLYTAYIIPHLRKEE

SEQ ID NO: 108015 - DNA, 2613 bp, Thermoanaerobacter tengcongensis
  CDS (1)..(2613)
atgaagaagtattggaatatgccaatagaagaaataaaaaaagaattagaaactgatgatgtgtatgggttgacgcaagagcaagtcaatgagagattgttaaaacacggcaagaacattttgagagaaaaggaaagaaaatccatattctctttatttatggaacagtttaaagattatatggtcctgatccttatagttgcttctattatatctttctttctcggagagacaacggatgcgagtataatattagctattgtaattttaaatgcgttgttgggaacggttcaggaaaataaagctgagaaatcgcttgaagctcttaagaaattgtctcagcctcttgcaaaagtaataagagatggaaaagtaatggaagttgaagcatcatctcttgtagtaggagatgtagtgttaatagaggcagggaatatcatacctgcagatgggagattggtagaggctaaaaatcttaaagtagatgaatcagtattgactggtgagtcagtacctgttgaaaaagttgatacagtaatagaaaaagaggatatacctttgggtgatagatttaatttagtttacatgggaactactgttacttacggtagaggaaaatttattgtaactgctacgggcatggataccgaaatgggaaaagtagccagcttaatagaaaatgaaagggacgttaaaacacctcttcaattaaagcttgaagaactgggtaaatatttggggacagctgccatccttataagtggaataatgtttggagtaggagtgcttcaaaaaaggccaatatttgacatgtttatgacggctgttagtcttgctgttgctgcgattcctgaggggcttcctgccattataactattacccttgctcttggtgtgcagaagatgagcaagaaaaatgcgataataagaaaacttccggctgtagaaacgcttggcagtacaagtgttatttgttctgacaaaacaggaacccttacacagaataagatgactgttgtgaagttttatgttaatgatagaaaagtgaatgcccaaaaagatgaagtaaaacaagaagattatttccttttaaagaatgctgcattatgtactgatgcttttatagatgaggaaggaaaagggattggcgatcctacggaagttgcgattgttgctgcgataaatgatttggtaggcttaaaaaaagccgatatagaaaaagaatttccaagagttgcagaaataccttttgattcagatagaaaaatgatgtcaacaatacatatggtggataaagaaggttttagattaattaccaagggagcgcctgataatatcataaaaaggtgtaaatatattttgaaagaaaataagattttaccctttgatgaaatagaaaaaaataagctaagttctatcaacgaagaaatgggaggagaggctttaagagttattgcagttgcgtataaagatataaaagaaatacctgaaaatttgagtagcgatgaaatggaaaaagatttgatatttatagggcttataggtatgatagatccaccgcgaagggaagccaaacattcagttgagatatgcaaaaaagcaggaataaaacctgttatgataacaggtgaccataagataacggcttctgcgatagcaagagagcttggaattcttgaggataatgatgaagcagtaacaggtgaagaccttgacagaatttctgatgacgagttggcagaaaggataaaaagaatatctgtttttgcaagggtatctcctgagcacaaaatgagaattgtaaaagcgtggcaaaaaagaggtgctgttgtggcaatgacaggtgatggtgtgaatgacgcacctgccctcaaacaagcagatattggagtcgcaatgggtataactggtactgatgttgcaaaagaagcagcagatatggttttaacagatgacaattttgcaacaatcgttgcagcagtagaagagggtagaactatatttgcaaatataaagaaagctattcactatttattaagctgtaattttggtgaaatagtcacactgtttattgctacaatattaggaatgccaatgcctttaaagcctgttcatatactgtgggtgaatctcataactgatagtcttccggcacttgctcttggatttgaaccgccggaaagagatataatggagaagaagcccagaccaaaaggagaaagtatttttgcaggagggttagcttatagaatactttttgaaggtatgttaattggattggttacattaattgcttttgtaataggacttaaacaaaatatagaaactgcaaggactatggcttttgcggtgctgactttatcgcagcttgctcaagctttaaatgtaaggtcagacaagtccatttttaagataggattgtttacaaacaaatacatgatttttgctttgatagtggcgattttgttacaggttattctaattgtaactcctttaaacgcagtatttggacttaaaaatattaatgtttatgattgggatataattattgcaatggcaattttacctcttttagtaatggaagtggtcaaatttttcaaaaaagcgaattaa

SEQ ID NO: 108016 - protein, 870 aa, Thermoanaerobacter tengcongensis
MKKYWNMPIEEIKKELETDDVYGLTQEQVNERLLKHGKNILREKERKSIFSLFMEQFKDYMVLILIVASIISFFLGETTDASIILAIVILNALLGTVQENKAEKSLEALKKLSQPLAKVIRDGKVMEVEASSLVVGDVVLIEAGNIIPADGRLVEAKNLKVDESVLTGESVPVEKVDTVIEKEDIPLGDRFNLVYMGTTVTYGRGKFIVTATGMDTEMGKVASLIENERDVKTPLQLKLEELGKYLGTAAILISGIMFGVGVLQKRPIFDMFMTAVSLAVAAIPEGLPAIITITLALGVQKMSKKNAIIRKLPAVETLGSTSVICSDKTGTLTQNKMTVVKFYVNDRKVNAQKDEVKQEDYFLLKNAALCTDAFIDEEGKGIGDPTEVAIVAAINDLVGLKKADIEKEFPRVAEIPFDSDRKMMSTIHMVDKEGFRLITKGAPDNIIKRCKYILKENKILPFDEIEKNKLSSINEEMGGEALRVIAVAYKDIKEIPENLSSDEMEKDLIFIGLIGMIDPPRREAKHSVEICKKAGIKPVMITGDHKITASAIARELGILEDNDEAVTGEDLDRISDDELAERIKRISVFARVSPEHKMRIVKAWQKRGAVVAMTGDGVNDAPALKQADIGVAMGITGTDVAKEAADMVLTDDNFATIVAAVEEGRTIFANIKKAIHYLLSCNFGEIVTLFIATILGMPMPLKPVHILWVNLITDSLPALALGFEPPERDIMEKKPRPKGESIFAGGLAYRILFEGMLIGLVTLIAFVIGLKQNIETARTMAFAVLTLSQLAQALNVRSDKSIFKIGLFTNKYMIFALIVAILLQVILIVTPLNAVFGLKNINVYDWDIIIAMAILPLLVMEVVKFFKKAN

SEQ ID NO: 108017 - DNA, 2589 bp, Fusobacterium nucleatum
  CDS (1)..(2589)
atgaaacactttacaaaatctaagaaacagttatttgaagaatttgaaacagtttctactggtttaactgatgaagaagtagaaaaaagaaggaaaaaatatggagaaaataaatttattgaaaaagaaaaagatggacttataaaaatctttttttaccaatttaaagattctcttgttattattttattagttgctgcaattatttcatttttttctggaaatgaagaaagtagctttgttatagttttagttcttattttaaactcaattcttggtgcttatcaaactattaaagctcaaaaatcattagatagcttaaagaaaatgtcatcaccaaaatgtaaagttattagagaacatgaacaattagaagttgattcatcagagttagttcctggagatattgttattatagaagctggagatattgttccagcagatggaagaataattgaaaacttttcattacttgtaaatgaaaattcacttactggtgaatcaaattcaatagaaaaaactgatgaaatattacaatatgaagatttagctctaggtgaccaagttaatatggttttctcaggaagtcttgtaaactatggtagagctaaaattttaattacagaaactggaatgagtacagagctaggtaaaattgctactcttttagaccaaacagaagaaaatgtaactccattacaaaaatctttagatatatttggaaaaagattaactcttgctatagtaattctttgtatatttatctttggaatctatgtatatcatggaaatacagttcttgattcactattacttgcagtagctttagctgttgcagcaattccagaatcattaaaccctatcatcacaatagtattatcattagaaactgaaaaacttgctaaagaaaatgcaatagtaaaagaattaaaatctattgaagctcttggttcaatttcagttatatgttctgataaaactggtactcttactcaaaataagatgacagttaaaaagatttttataaatggaaaattagatgatgaatattctttaaatataaataaaaaaattgataaattattattagatagttttatactttgtactgatgcaacagataccataggagatccaacagaaacagctcttatccatcttacacaaaaatatgatatgtcttttagagatgaaagaaaagatagtaaaagaatttctgaaatcccctttgattctgttagaaaattaatgactgttctttatgaagataaaaaaggtaaatatattatttttacaaagggagcttttgattctcttataactaaatttaaatacttcattgatgaaaatggagacattcaaaatataaatgaagaatttattaaaaaaattgaaaaagtaaataatgatttagctgaagaaggattaagagttttaacatttgcatataaatatatggatgagcctaaagacctaactactcaagatgaagattcttatattttccatgctcttgtaggtatgatagatcctccaagagaagaatcaaaagttgcagttcaagaatgtataagaggtggaattaaaccagttatgataactggtgaccataaaattacagctagaacaatagcaaaaaatattggaatattcaaagatggagatatggctattgaaggtgttgaacttgaaaaaatgtctgatgaggaattagaaaattctgttgaaaaaatttcagtttatgcaagagtctctcccgaacacaaaataagaattgtcaatgcttggcaaaaacttggaaaaatttgtgctatgactggtgatggtgtaaatgatgctcctgcactaaagaaagctaatataggtattgcaatgggaataactggtacagaagtttctaaaaatgctgcttctatgatacttgctgatgataacttttctacaatagttaaagctataataacaggaagaaatgtttatagaaatatcaaaaatgcaataggtttcttactttcaggaaatactgctgctatacttgccgttctatattcatcactggctaatttaccagtgatattctctcctgtacaattactatttataaacctattaacagatagcttaccatcaattgcagttggagttgagcctaaaaatgaagatatcttagatgaaaaaccaagagaccctaatgaagctatacttacaaaaagattttcttctaaacttttaattgaaggagttttaattgctatatttattataattgctttctatataggtttaaaagattcagcattaaaaggttctacaatggcatttgctacattatgtttagcaagactatttcatggaattgattacagaggacaaagaaatatatttgctattggattctttaaaaataaattttctttgatagcttttggagtaggttttgctctattaaatttagtcttattaataccttctttatataaaatcttcggaataactagaatagaagctgttaattttttacaaatttatatactttcattgatacctactatattaattcaaatttataaagctataaaatatagataa

SEQ ID NO: 108018 - protein, 862 aa, Fusobacterium nucleatum
MKHFTKSKKQLFEEFETVSTGLTDEEVEKRRKKYGENKFIEKEKDGLIKIFFYQFKDSLVIILLVAAIISFFSGNEESSFVIVLVLILNSILGAYQTIKAQKSLDSLKKMSSPKCKVIREHEQLEVDSSELVPGDIVIIEAGDIVPADGRIIENFSLLVNENSLTGESNSIEKTDEILQYEDLALGDQVNMVFSGSLVNYGRAKILITETGMSTELGKIATLLDQTEENVTPLQKSLDIFGKRLTLAIVILCIFIFGIYVYHGNTVLDSLLLAVALAVAAIPESLNPIITIVLSLETEKLAKENAIVKELKSIEALGSISVICSDKTGTLTQNKMTVKKIFINGKLDDEYSLNINKKIDKLLLDSFILCTDATDTIGDPTETALIHLTQKYDMSFRDERKDSKRISEIPFDSVRKLMTVLYEDKKGKYIIFTKGAFDSLITKFKYFIDENGDIQNINEEFIKKIEKVNNDLAEEGLRVLTFAYKYMDEPKDLTTQDEDSYIFHALVGMIDPPREESKVAVQECIRGGIKPVMITGDHKITARTIAKNIGIFKDGDMAIEGVELEKMSDEELENSVEKISVYARVSPEHKIRIVNAWQKLGKICAMTGDGVNDAPALKKANIGIAMGITGTEVSKNAASMILADDNFSTIVKAIITGRNVYRNIKNAIGFLLSGNTAAILAVLYSSLANLPVIFSPVQLLFINLLTDSLPSIAVGVEPKNEDILDEKPRDPNEAILTKRFSSKLLIEGVLIAIFIIIAFYIGLKDSALKGSTMAFATLCLARLFHGIDYRGQRNIFAIGFFKNKFSLIAFGVGFALLNLVLLIPSLYKIFGITRIEAVNFLQIYILSLIPTILIQIYKAIKYR

SEQ ID NO: 108019 - DNA, 2529 bp, Legionella pneumophila
  CDS (1)..(2529)
atgcagcaatttgcgagcgtggttacctgggtacttttaggtgctgtcatcgtttcttttttattagatgaaaaagccgacgctattgccatttttgctattgtaattttaaatgccattattggattcgttttagaatatcgcgccgatcgagcgatgcttgctttgcaacaaatggcggcccctaaagccacagtattgcgagatggccacgcgaggatgattgctgcttctgatatcgtaccaggtgatgttcttctttttgaaagcggtgatttaatcgctgccgatgctcgcctttttgaattatcagcgcttaaggttaatgaagcgccgctcacgggtgagtccatacctgttgctaaaaatctagaggtttgctctaaagaaacgcctctagccgaccgtaaaaacatggtgtttatgggcacctctatagccgatggcacaggtcgcgcgcttgtcgtggcgactggtatgcaaacggaaatggggcacattgccaaaatgctgggtgaagcgtctcgtgatgaaacccctttacagaaaaaactcaatcaagtgggttctcgtctattgtggctttgctttttcattatcattgccatttttggcttaggtctcttacgtaacatccctatcttcagtttgttcatgagttcagtcagtcttgcagtggctgcaattcctgaaggcttgcctgccgtagtaacggtggctttagcactcggcgtgcaacgtatggtacggcgtgccgtactggtaaggcgattatcggcggttgaaacactcggctgtttacaagtcatttgcacggataaaacaggaacgttgacggtaggggaaatgacggcgcgtaagcttgtgacagcaagtgatgtttatagcattcatggggaaggctataacctctcgggagggtttgctcttcaaggtcaagaaattaatgtgtcagaagacccgttgttgcaagctactttgcaagcgatggtggcttgcaataacgcgagttttgagagccaagatggacaggtagctactgtgggagacccaactgaagtggcacttttggttgctgctgccaaaggaggcctttggcaaggggaactacaggcctcttatcctcgtatcaaagagttaccctttagctccgaacgcaaacgcatgtcggtcgtgtgtcgacaagaccatgaacacatcgcttttgtgaagggggcaccagaaattatcttggagcgctgcacccatattttgaccaaaacaggtattaaaaaattaacaccgaatgataaggcgcgcatgaaacaatcctgtgaactcatggccagcgaagcattgcgactgttagcttttgcgaagcgccaattagagcctgcagctttagaaaaagaagagaaagagcttgaaaataacctggttttcttaggtcttattggtcttcaggacccacctcatgcaagtagcaaggaatccatcagtcgctgtaaaaaagccggcatcaaaccggtgatgattacaggagaccatcctgatacggcaagagccattgccaaagagcttggtattttggaggcaggtgaccgattgctcactggcaatgaacttgaaaatatgccagaggaggaatttaaccattgcgttaaggacattgccgtctatgctcgtgtgaccgcggagcataaattaaaaatcgtacgggcctggaaaagacagcaaatggtggtggcgatgacaggcgatggggtgaatgatgcgcctgctttaaaagaagcatctgttgggattgccatgggaaaaactggtactgcggtcaccaaggaagcctctgacatcattgtcatggacaataatttcacctcgattgtggcgggcattgaagaaggccggactatttacgataacattgccaaaacgcttgcctatttattagcaggcaatagtggggagttactggttgtgtttgtagcccttttaattggttggcctctgccgttacttcctatccaattattatggattaacttagtaaccgatggtttgccggccattggcttagctaccgatatgtcagagccagggattttgaatcgtccacccagagccacgcaaaaatccatgatggatatggcgtttttcaaacgagtaacctttgtgggttgtttaaaggctttagtaatccttagtgtgtttgcttatgaatatttaatcgataaggatttaattcaagcccaagatgcggccttttctgttttagtaaccgccgagcttttatgggcctttggagcgcgaagcgacaccaagaacatttggcaagtaggattgttctccaatttaagactcttttttattgtgagcatcagtttttccctgcaggtcttaattcaccatatcccggtattgcgcgaattatttgggatacaaccggtctcattcacccaatgcctggtttggattctattgggcatggtgcctttgctcatcatagaagctcagaaacggctaaggaaggcacccaatgaagcattttag

SEQ ID NO: 108020 - protein, 842 aa, Legionella pneumophila
MQQFASVVTWVLLGAVIVSFLLDEKADAIAIFAIVILNAIIGFVLEYRADRAMLALQQMAAPKATVLRDGHARMIAASDIVPGDVLLFESGDLIAADARLFELSALKVNEAPLTGESIPVAKNLEVCSKETPLADRKNMVFMGTSIADGTGRALVVATGMQTEMGHIAKMLGEASRDETPLQKKLNQVGSRLLWLCFFIIIAIFGLGLLRNIPIFSLFMSSVSLAVAAIPEGLPAVVTVALALGVQRMVRRAVLVRRLSAVETLGCLQVICTDKTGTLTVGEMTARKLVTASDVYSIHGEGYNLSGGFALQGQEINVSEDPLLQATLQAMVACNNASFESQDGQVATVGDPTEVALLVAAAKGGLWQGELQASYPRIKELPFSSERKRMSVVCRQDHEHIAFVKGAPEIILERCTHILTKTGIKKLTPNDKARMKQSCELMASEALRLLAFAKRQLEPAALEKEEKELENNLVFLGLIGLQDPPHASSKESISRCKKAGIKPVMITGDHPDTARAIAKELGILEAGDRLLTGNELENMPEEEFNHCVKDIAVYARVTAEHKLKIVRAWKRQQMVVAMTGDGVNDAPALKEASVGIAMGKTGTAVTKEASDIIVMDNNFTSIVAGIEEGRTIYDNIAKTLAYLLAGNSGELLVVFVALLIGWPLPLLPIQLLWINLVTDGLPAIGLATDMSEPGILNRPPRATQKSMMDMAFFKRVTFVGCLKALVILSVFAYEYLIDKDLIQAQDAAFSVLVTAELLWAFGARSDTKNIWQVGLFSNLRLFFIVSISFSLQVLIHHIPVLRELFGIQPVSFTQCLVWILLGMVPLLIIEAQKRLRKAPNEAF

SEQ ID NO: 108021 - DNA, 2598 bp, Oryza sativa
  CDS (1)..(2598)
atggcgtcctccctctccctcgacgacatcaacgacgactccgtcgacctgtcgaaggcgccggtggcggaggtgttccagaagctgaaatgcgaccggaaggggctcaccggagcggagggagagagccggctgcggctgtacgggccgaacaagctggaggagaagaaggagagcaagcttctcaagttcttgggcttcatgtggaaccccgctgtcatcgccgccatcatggccatcgtcctcgccaacggcggcggccgcccgcccgactggcaggacttcgtcgggatcgtctccctgctcatcatcaactccaccatctcctacatcgaggaggccaacgccggcgacgccgccgccgcgctcatggccggcctggctcccaagaccaagctgctcagggatggcaggtgggaggagcaggaggcggcgatcttggtccccggcgacatcatcagcatcaagctcggcgacatcatccccgccgacgcgaggctgctcgagggcgacccgctcaagatcgaccagtcggcgctcaccggcgagtcgttgccggtgaacaagcacccggggcaggaggtgttctcgggctccacggtgaagcagggcgagatcgaggccgtcgtcatcgccaccggcgtgcgcaccttcttcggcaaggcggcgcacctcgtcgacagcaccaacaacgtcggccacttccagcaggtgctcaccgccatcggcaacttctgcatcatctccatcggcgccggcatggcggtcgaggtgctcgtcatgtacccgatccagcaccgcgcctaccgcgacggcatcgacaacctcctcgtcctcctcatcggcggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacgctcaacaagctcaccgtcgacaagaccctcatcgaggtgtgctccaagggcgtcgacaaggacatggtcctcctctacgccgccagggcgtcgcgcgtcgagaaccaggacgccattgacacctgcatcgtgaacatgctcgacgaccccaaggaggcacgcgcggggatccaggaggtgcacttcctccccttcaaccccgtcgacaagcgcaccgccatcacctacatcgacggcaatggcgactggcacagggtgagcaagggcgcgccggagcagatcatcgagctctgcaacatggccgccgacgccgagaagaaggtccacgccctgatcgacagctacgccgaccgggggctccggtcgctcggcgtgtcgtaccagcaggtgccggagaagagcaaggacagcggcggcgacccgtggcagttcatcgggctgctgccgctgttcgacccgccgaggcacgacagcgcggagaccatccgccgcgcgctccacctcggcgtcaacgtcaagatgatcaccggcgaccagctcgccatcgccaaggagacggggcggcggctcgggatgggcaccaacatgtacccgtcgaccaccctcctcggcgacaagaacagccaggtgaacggcctccccatcgacgagctgatcgagcgcgccgacgggttcgccggcgtgttcccggagcacaagtacgagatcgtgaagcggctgcaggagatgagccacatctgcggcatgaccggcgacggcgtgaacgacgcgccggcgctgaagaaggcggacatcgggatcgccgtggacgacgccacggacgccgcccggagcgcgtcggacatcgtgctgacggagcccgggctgagcgtgatcgtcagcgcggtgctcacctcccgcgccatcttccagcggatgaagaactacaccatctacgcggtgtccatcaccatccgcatcgtcctcggcttcctcctcatcgccatcatctggaagttcgacttcgccccgttcatggtgctcatcatcgccatcctcaacgacggcaccatcatgaccatctccaaggatcgcgtcaagccgtcgccgacgcccgattgttggaagctcaacgagatcttcctcacgggggtggtgctcggcacctacatggcattggtcaccgtgctcttcttctacctcgcgcacgacacgaacttcttcacggatgtgttcggggtgacgtcgatcagggagagcgagagggagctcatggcggcgctgtacctgcaggtgagcatcatcagccaggcgctcatcttcgtgacgaggtcgaggagctggtcgttcgtcgagaggcccgggttcttgctgctcttcgccttcttcgctgcgcagatggtggcgacggcgatcgccgtgtacgcgcgctgggatttctgccggatccagggcatcgggtggcggtggggcggcgccgtgtggcagttcagcgtcgtcacctacctcccgctcgacgtcctcaagttcatcatccgctacgccctcaccggcggcaaggccggggacagcgcccagaaaaaggcaagctcgccgccgccgacctctcaaccttag

SEQ ID NO: 108022 - protein, 865 aa, Oryza sativa
MASSLSLDDINDDSVDLSKAPVAEVFQKLKCDRKGLTGAEGESRLRLYGPNKLEEKKESKLLKFLGFMWNPAVIAAIMAIVLANGGGRPPDWQDFVGIVSLLIINSTISYIEEANAGDAAAALMAGLAPKTKLLRDGRWEEQEAAILVPGDIISIKLGDIIPADARLLEGDPLKIDQSALTGESLPVNKHPGQEVFSGSTVKQGEIEAVVIATGVRTFFGKAAHLVDSTNNVGHFQQVLTAIGNFCIISIGAGMAVEVLVMYPIQHRAYRDGIDNLLVLLIGGIPIAMPTVLSVTMAIGSHRLSQQGAITKRMTAIEEMAGMDVLCSDKTGTLTLNKLTVDKTLIEVCSKGVDKDMVLLYAARASRVENQDAIDTCIVNMLDDPKEARAGIQEVHFLPFNPVDKRTAITYIDGNGDWHRVSKGAPEQIIELCNMAADAEKKVHALIDSYADRGLRSLGVSYQQVPEKSKDSGGDPWQFIGLLPLFDPPRHDSAETIRRALHLGVNVKMITGDQLAIAKETGRRLGMGTNMYPSTTLLGDKNSQVNGLPIDELIERADGFAGVFPEHKYEIVKRLQEMSHICGMTGDGVNDAPALKKADIGIAVDDATDAARSASDIVLTEPGLSVIVSAVLTSRAIFQRMKNYTIYAVSITIRIVLGFLLIAIIWKFDFAPFMVLIIAILNDGTIMTISKDRVKPSPTPDCWKLNEIFLTGVVLGTYMALVTVLFFYLAHDTNFFTDVFGVTSIRESERELMAALYLQVSIISQALIFVTRSRSWSFVERPGFLLLFAFFAAQMVATAIAVYARWDFCRIQGIGWRWGGAVWQFSVVTYLPLDVLKFIIRYALTGGKAGDSAQKKASSPPPTSQP

SEQ ID NO: 108023 - DNA, 2865 bp, Oryza sativa
  CDS (1)..(2865)
atggaggttgccaatgccatggatgccatcaccaaggagaccgtcgacctggagcacatccctgtggaggaggtgttggatcacctaaaatgcacgcgcgagggtctcacctccgaggttgcccagcagaggatccactccttcggctacaacaagctcgaggagaagcaggaaagcaaactgctcaagttcctcggctttatgtggaacccgctttcctgggtcatggaggcggcagccatcatggctatcgccctcgcacacggaggaagagatgccaggggaaagagaatgcgcatagactaccacgacttcgttggaattgtactgctactctttatcaactctaccattagcttcatggaggaaaataacgctggcaatgctgccgctgcactgatggctcgcctggcaccaaaagctaaggttttacgtgatggaacctgggatgaattagatgcatccttgttggttccgggcgatataatcagcgtaaaactcggggacatcattcctgcagatgcacgccttctcgagggagatccgctcaagattgatcagtctgcacttacgggtgaatcgctacctgtaactaagcatcctggagatggaatttactctggttcaacctgtaagcaaggtgaaatagaagcagttgttattgccactggaattcatactttctttggaaaagcagcccatctcgttgaatcaactactcacgttggtcactttcaaaaggttctgacttcgattgggaacttctgtatttgttcaattgctgctggaatggttattgagttacttgtaatgtacgctgttcatgaaaggaaataccgccagattgttgataatcttcttgtgcttcttattggtgggattccaatcgccatgcctacagttctttctgttactatggccattggatcacacaaactggcacagcagggtgctattaccaagagaatgacagcaatagaggaaatggctggaatggatgtcctttgtagtgacaagactggaacattgacactcaacaaactgagtgttgacaaaaatttaattgaggtttttgaaaaaggcattgagaaggacgatgttgtattgatggctgcaagggcttcaagattggaaaatcaagatgctattgattttgctattgtttccatgttaccagatccaaaagaggcgcgagctggcattcaagaagttcatttccttccatttaacccaacagataaaaggacagctctcacatacttagatgctgagggtaaaatgcacagggttagcaaaggtgctcctgaacagatcttgaacttggcatcaaataaatgtgagattgaaagaaaggtccatcatgtaattggaaattttgctgagagagggcttcggtcgctcgctgttgcctatcaggaagtacctgaagggacaaaggaaagtccaggtggaccttggcaattcgttggtcttctcccactctttgatcctcctcgtcatgatagtgctgaaaccatacgcagagctcttgaccttggagttagtgtaaaaatgatcacaggtgatcagttggctattggtaaggagacaggccggaggttaggaatgggcacaaacatgtacccttcttcatctttgctgggtgacagaaaagatggtgatatcgctgtcctaccagtggacgagctgattgagcaagcagacggatttgctggagtattcccagagcacaaatatgaaattgtgcagaggctgcaagctagaaagcacatatgtgggatgactggagatggagttaatgatgcacctgcactgaagaaagcagacattgggattgctgtggctgatgcaacggatgctgctagaagtgcctctgacatagttctgacggaacctggattgagtgtcattatcagtgctgtgttgaccagccgggcaattttccaaagaatgaaaaattatacgatatacgctgtatctataactgtacgtattgtgcttggttttttgctcttggcatgcttttggaaatttgattttcctccatttttggttcttgtgatagctattcttaatgatggaaccataatgactatatccaaagataaggttaaaccatctccctatccagacagttggaagctaacagagatatttgcaactggagtgattattggggcttatctggctgtaaccactgtgttgttcttttgggcagcctacaagacacagttttttgtgcaccttttcaatgtagacactctgaacataaacaagaaattggcttctgcagtttaccttcaagtgagcaccattagtcaggctttgatatttgttacacgttccagaggttggtccttcttagagagacctggcctcctgcttatggctgcatttgtcatagctcagctgattgccactgtgttagctgccattgccacctgggaggttgctagcatcagaggtatcggttggcgctgggcaggggctatttgggtgtacaacattgttgtctaccttttgctagacccaatgaaattcgccgtgcgatatggccttagtgggaaagcctggaaccttgtcattgataacaaggtagcttttacaaaccggaaagatttcggaagggaagctcgcgtggttgcttgggcacacgagcagcgcacactacacgggctgcagtctgctgcaagccgggagaaagctgcatcaacggagctcaaccaaatggctgaagaggccagacggcgtgctgagattacaaggttgagggaattgcacactctgaaaggaaaggtggaatctgtggctaaactgaaaggaatcgacttggaggatgtcaacaatcaacactacactgtttaa

SEQ ID NO: 108024 - protein, 954 aa, Oryza sativa
MEVANAMDAITKETVDLEHIPVEEVLDHLKCTREGLTSEVAQQRIHSFGYNKLEEKQESKLLKFLGFMWNPLSWVMEAAAIMAIALAHGGRDARGKRMRIDYHDFVGIVLLLFINSTISFMEENNAGNAAAALMARLAPKAKVLRDGTWDELDASLLVPGDIISVKLGDIIPADARLLEGDPLKIDQSALTGESLPVTKHPGDGIYSGSTCKQGEIEAVVIATGIHTFFGKAAHLVESTTHVGHFQKVLTSIGNFCICSIAAGMVIELLVMYAVHERKYRQIVDNLLVLLIGGIPIAMPTVLSVTMAIGSHKLAQQGAITKRMTAIEEMAGMDVLCSDKTGTLTLNKLSVDKNLIEVFEKGIEKDDVVLMAARASRLENQDAIDFAIVSMLPDPKEARAGIQEVHFLPFNPTDKRTALTYLDAEGKMHRVSKGAPEQILNLASNKCEIERKVHHVIGNFAERGLRSLAVAYQEVPEGTKESPGGPWQFVGLLPLFDPPRHDSAETIRRALDLGVSVKMITGDQLAIGKETGRRLGMGTNMYPSSSLLGDRKDGDIAVLPVDELIEQADGFAGVFPEHKYEIVQRLQARKHICGMTGDGVNDAPALKKADIGIAVADATDAARSASDIVLTEPGLSVIISAVLTSRAIFQRMKNYTIYAVSITVRIVLGFLLLACFWKFDFPPFLVLVIAILNDGTIMTISKDKVKPSPYPDSWKLTEIFATGVIIGAYLAVTTVLFFWAAYKTQFFVHLFNVDTLNINKKLASAVYLQVSTISQALIFVTRSRGWSFLERPGLLLMAAFVIAQLIATVLAAIATWEVASIRGIGWRWAGAIWVYNIVVYLLLDPMKFAVRYGLSGKAWNLVIDNKVAFTNRKDFGREARVVAWAHEQRTLHGLQSAASREKAASTELNQMAEEARRRAEITRLRELHTLKGKVESVAKLKGIDLEDVNNQHYTV

SEQ ID NO: 108025 - DNA, 2847 bp, Oryza sativa
  CDS (1)..(2847)
atgacaggtcgggcccatccaccaatagtaatagagaacataccgatcgaggaggtgttcgagcagctgaaatgtacgcgcgaggggctctcctccgaggaggggaaccggcgtatcgagatgttcggccccaacaagctcgaggagaagaaggagagcaagatactcaagttcttggggttcatgtggaacccgctgtcgtgggtcatggagatggccgccatcatggccatcgcgctggccaacggcggcggcaagccaccggactgggaggacttcgtcggtatcattgtcctgctggttatcaactccaccatctccttcatcgaagagaacaacgccggcaacgccgctgctgctctcatggccaaccttgcacccaagaccaaggtgctgagggatggccgatggggcgagcaggaggcagcaatcttggttcccggtgacattatcagcatcaagctcggtgacatcgtccctgctgatgctcgtctccttgagggtgatccccttaagattgaccagtctgcacttactggggagtcccttccagtgaccaagaaccctggtgatgaggtcttctctggctcgacctgcaagcagggtgagattgaggccgtggtcattgccactggagtgcacaccttcttcggcaaggcggcgcatcttgttgacagcaccaaccaagttggtcacttccagacggtgctcactgcgatcgggaacttctgtatctgctcgattgcggttggtatcgtgatcgagatcatcgttatgttcccgatccagcaccgtgcctaccgcagtggcattgagaacctgttggtcctcttgatcggtggtatcccaattgccatgcctaccgtgctctcggtcaccatggccattggttcccacaagttgtcccagcagggtgctatcaccaagaggatgactgccatcgaggagatggctggcatggatgttctgtgcagtgacaagaccggaacccttacccttaacaagttgagcgttgacaagaacctcgttgaagtgttcactaaaggtgttgacaaggaccatgttttgttgctggctgcaagggcatttaggacagaaacccaagatgccatcgatgctgccatggttggtatgcttgctgatcccaaggaggcaagagccggtatcagggaagtgcacttcttgcccttcaacccagttgacaaggggactgctttaacatacatcgatgccgatggtaactggcaccgtgccagcaagggtgctcctgagcagatcctgaccctgtgcaactgcaaggaggatgtaaagaggaaggtgcatgctgtgattgacaagtatgctgagcgtgggcttcgttctcttgctgttgcaagacaggaagtacctgagaagtcgaaggagtctgctggtggaccatggcaattcgttggtctgctgcccctgtttgatcccccgaggcacgacagtgctgaaactatccggaaggctctccatcttggtgttaatgttaagatgatcactggtgaccagcttgctattggtaaggagactggtaggaggcttggaatgggtacaaacatgtatccttcatccgcattgctcggacaaaacaaggacgcttcacttgaggcacttcccgtggatgagctcattgagaaggctgatggttttgccggagtcttccctgagcacaaatatgagatcgtgaagaggttgcaagagaagaagcacatcgtcggtatgaccggagatggtgtcaatgatgcccctgctcttaagaaggccgacattggtattgctgttgctgatgctacagatgctgcaagaagtgcttccgacattgtgctcactgagccaggtcttagtgtcattatcagcgctgtcctcactagcagatgcatcttccagaggatgaagaactataccatttatgcagtttccatcaccatccgtatagtgcttggatttttgcttattgctctgatctggaaatacgacttctcacccttcatggtccttatcattgccatcctgaatgacggtactatcatgacgatctcgaaggacagagttaagccttctcccttgccagacagctggaagctgaaggaaatcttcgctaccggtattgtgcttggaagctaccttgctctgatgaccgttattttcttctgggccatgcacaagacagactttttcacggacaaattcggtgtcagatcaatcaggaacagtgaacatgagatgatgtctgcactgtacctccaagtcagtattgtgagtcaggccctcatcttcgtcacccgttctcgcagctggtccttcatcgaacgccctggtcttctcttggtcactgcattcatgcttgcacaactggttgcgacattcctcgctgtctatgccaactggggctttgccaggatcaagggcattggctggggctgggctggcgttatctggctttacagcattgtgttctacttccctcttgacatcttcaagttcttcatccgctttgtgctgagtggaagggcctgggacaacctccttgagaacaagattgcattcaccaccaagaaggattacggtagggaggagagggaggcacaatgggccaccgcacaaagaacacttcacggccttcagccaccggaggtcgcctccaacacgctcttcaacgacaagagcagctaccgcgagctctctgagatcgctgagcaagccaagagacgagctgagatcgcgaggctgagagagctgaacactctcaagggccacgtcgaatcggtggtgaagctgaaggggctggacatcgacacgatccagcagaactacacagtgtga

SEQ ID NO: 108026 - protein, 948 aa, Oryza sativa
MTGRAHPPIVIENIPIEEVFEQLKCTREGLSSEEGNRRIEMFGPNKLEEKKESKILKFLGFMWNPLSWVMEMAAIMAIALANGGGKPPDWEDFVGIIVLLVINSTISFIEENNAGNAAAALMANLAPKTKVLRDGRWGEQEAAILVPGDIISIKLGDIVPADARLLEGDPLKIDQSALTGESLPVTKNPGDEVFSGSTCKQGEIEAVVIATGVHTFFGKAAHLVDSTNQVGHFQTVLTAIGNFCICSIAVGIVIEIIVMFPIQHRAYRSGIENLLVLLIGGIPIAMPTVLSVTMAIGSHKLSQQGAITKRMTAIEEMAGMDVLCSDKTGTLTLNKLSVDKNLVEVFTKGVDKDHVLLLAARAFRTETQDAIDAAMVGMLADPKEARAGIREVHFLPFNPVDKGTALTYIDADGNWHRASKGAPEQILTLCNCKEDVKRKVHAVIDKYAERGLRSLAVARQEVPEKSKESAGGPWQFVGLLPLFDPPRHDSAETIRKALHLGVNVKMITGDQLAIGKETGRRLGMGTNMYPSSALLGQNKDASLEALPVDELIEKADGFAGVFPEHKYEIVKRLQEKKHIVGMTGDGVNDAPALKKADIGIAVADATDAARSASDIVLTEPGLSVIISAVLTSRCIFQRMKNYTIYAVSITIRIVLGFLLIALIWKYDFSPFMVLIIAILNDGTIMTISKDRVKPSPLPDSWKLKEIFATGIVLGSYLALMTVIFFWAMHKTDFFTDKFGVRSIRNSEHEMMSALYLQVSIVSQALIFVTRSRSWSFIERPGLLLVTAFMLAQLVATFLAVYANWGFARIKGIGWGWAGVIWLYSIVFYFPLDIFKFFIRFVLSGRAWDNLLENKIAFTTKKDYGREEREAQWATAQRTLHGLQPPEVASNTLFNDKSSYRELSEIAEQAKRRAEIARLRELNTLKGHVESVVKLKGLDIDTIQQNYTV

SEQ ID NO: 108027 - DNA, 2868 bp, Oryza sativa
  CDS (1)..(2868)
atggcggcgacggcgtcgtcgacggcggatgcgctcgagcagatcaagaacgaggccgttgatctggagcacatcccgttggaggaggttttccagcatctgaaatgcactcgggaaggactcaccaacgccgagggcgacgcccgcacccaagtcttcggccccaacaaactcgaagagaaaaaggagagcaagatactgaagtttctggggttcatgtggaacccgctgtcgtgggtgatggaggtggcggcgatcatggcgatcgcgctggcgaacggcggcgggcggccgccggactggcaggacttcgtcgggatcatcgcgctgctgttgatcaactccaccatatcctactgggaggagagcaacgccggcagcgccgcggcggcgctcatgaagaacctcgcccccaagaccaaggtgctccgcgacggcaggtggtcggagaccgacgccttcgtcctcgtccccggcgacgtcatcaacgtcaagctcggcgacatcgtccccgctgacgcccgcctcctcgacggcgatcccctcaagatcgaccagtcggcgctcaccggcgagtccctgccggtcaccaagctccccggcgactgcgtctactccgggtcgacgtgcaagcagggggagatcgacgccgtcgtcatcgccaccggcgtccacaccttcttcggcaaggcggcgcacctcgtcgacaccaccaaccaggtcggccacttccagaaggtgctccgcgccatcggcaacttctgcatcggcgccatcgccatcggcatggccgtcgaggtcatcgtcatgtacctgatccagcaccgcctctaccgcgacggcatcgacaacctcctcgtgctgctcatcggcggcatccccatcgccatgcccaccgtgctgtcagtcaccatggccatcggctcgcaccgcctctctgaccagggcgccatcaccaagcggatgacggcgatcgaggagatggccgccatggacgtgctctgcagcgacaagaccgggacgctcacgctgaacaagctcagcgtcgacaggggcctcatcgaggtgttcgtccagggcgtcgccaaggacgaggtgatcctcctcaccgccagggcgtcgcgtgtcgagaaccaggacgccatcgacaccgccatggtcggcatgctcgacgaccccaaggaggcacgcgccggcatccgggaggagcacttcctccccttcaaccccgtcgacaagcgcaccgccctaacctacgtcgacctcgccgacggctcatggcaccgtgtcagcaagggcgcccccgagcagattctggatctgtgcaaatgcagacaggacgtgaggagcaaggtgcacgccataatcgacaggtacgccgaccggggcctccggtcgctcgccgtggcgaggcaggaggtgccggagaggaggaaggacggccccggcgggccgtgggagttcgttggcctgctgccgctgctcgacccgccgcgccacgacagcgccgagaccataaggcgggcgctccacctcggcgtcaacgtcaagatgatcaccggtgatcagctcgccattgccaaggagaccgggaggaggctcgggatgggcgtgaacatgtacccctcgtcggcgctgctcggccagagcaaggacgagtccatcgcctccgtccccgtcgacgagctcatcaagaaggccgacggcttcgccggcgtcttcccagagcacaagtacgagattgtgaagaagctgcaggagatgaagcacatctgcgggatgaccggcgacggcgtgaacgacgcgccggcgctgaagagggcggacatcgggatcgccgtcgccgacgccaccgacgcggcgaggagcgcctcggacatcgtgctcacccagcctggcctcagcgtcatcatcagcgccgtcctcaccagccgcgctatcttccagaggatgaaaaattacacgatttacgcggtgtcgattactatccgtattgtgcttggattcatgctgattgctctcatctggaagttcgatttctcaccgttcatgatcctcgtcatcgcgatcctcaacgacggaacgatcatgacaatatccaaggacagggtgaagccgtcgccgcacccggacagctggaagttgccggagatcttcatcaccggcatcgtctacggcacctacctcgccgtcatgaccgtcctcttcttctgggccatgaggagcaccgatttcttcaccagcacgttccatgtgaagccactgatggagaaggacgagatgatgtcggcactgtacctgcaggtgagcatcatcagccaggcgctcatcttcgtgacgcgctcccgcagctggtgcttcgtcgagcgccccggcatgctgctctgcggcgccttcgtcgccgcgcagatcatcgcgacgctggtgacggtgtacgccaccttggggttcgcccacatcaagggcatcggctgggggtgggccggcgtcatctggctctacagcatcgtcaccttcctccccctcgacatcttcaagttcgccgtccgctacgccctcagcggccgcgcctgggacaccctcatcgagcacaagattgccttcacgagcaagaaggattacgggagaggggagagggaggcgcagtgggcgacggcgcagaggacgctgcacgggctgcagacgccggagatggggaccacctcggcggccagctacagggagctctcggagatcgccgagcaggccaagcgccgcgccgaggtggcccggctgcgcgagctcagcacgctcaagggccagatggagtccaccgtcaggctcaagggcctcgacatggacaacgtccagcaccactacaccgtctga

SEQ ID NO: 108028 - protein, 955 aa, Oryza sativa
MAATASSTADALEQIKNEAVDLEHIPLEEVFQHLKCTREGLTNAEGDARTQVFGPNKLEEKKESKILKFLGFMWNPLSWVMEVAAIMAIALANGGGRPPDWQDFVGIIALLLINSTISYWEESNAGSAAAALMKNLAPKTKVLRDGRWSETDAFVLVPGDVINVKLGDIVPADARLLDGDPLKIDQSALTGESLPVTKLPGDCVYSGSTCKQGEIDAVVIATGVHTFFGKAAHLVDTTNQVGHFQKVLRAIGNFCIGAIAIGMAVEVIVMYLIQHRLYRDGIDNLLVLLIGGIPIAMPTVLSVTMAIGSHRLSDQGAITKRMTAIEEMAAMDVLCSDKTGTLTLNKLSVDRGLIEVFVQGVAKDEVILLTARASRVENQDAIDTAMVGMLDDPKEARAGIREEHFLPFNPVDKRTALTYVDLADGSWHRVSKGAPEQILDLCKCRQDVRSKVHAIIDRYADRGLRSLAVARQEVPERRKDGPGGPWEFVGLLPLLDPPRHDSAETIRRALHLGVNVKMITGDQLAIAKETGRRLGMGVNMYPSSALLGQSKDESIASVPVDELIKKADGFAGVFPEHKYEIVKKLQEMKHICGMTGDGVNDAPALKRADIGIAVADATDAARSASDIVLTQPGLSVIISAVLTSRAIFQRMKNYTIYAVSITIRIVLGFMLIALIWKFDFSPFMILVIAILNDGTIMTISKDRVKPSPHPDSWKLPEIFITGIVYGTYLAVMTVLFFWAMRSTDFFTSTFHVKPLMEKDEMMSALYLQVSIISQALIFVTRSRSWCFVERPGMLLCGAFVAAQIIATLVTVYATLGFAHIKGIGWGWAGVIWLYSIVTFLPLDIFKFAVRYALSGRAWDTLIEHKIAFTSKKDYGRGEREAQWATAQRTLHGLQTPEMGTTSAASYRELSEIAEQAKRRAEVARLRELSTLKGQMESTVRLKGLDMDNVQHHYTV

SEQ ID NO: 108029 - DNA, 2754 bp, Trypanosoma cruzi
  CDS (1)..(2754)
atgaaccagaagaacgataactccgtgctgaacaacagcaataatggtaacttcaacgaacaacatcccccacaaaaatcgcaaaagcgtcagtccgttctctccaaggccattagtgagcacaaggaggacggcgtcgatgaagtgccaatgctaccgccgtccaagggtctgacgacggccgaagctaaagagctccttgccaaatacggacgcaacgagctcccggagaagaaaacgcccagttggctgatatttgcgcgtaacctatggggtcctatgccttttgtcctgtgggtcgccatcatcattgagtttgcgctggagaactggcctgacggtgccattcttcttgctattcagcttgccaatgccacaattgggtggtatgagacaatcaaggcaggcgacgctgtggctgcgctgaagaactcactgaagcccgtggcgaccgtccaccgtgacggaacatggcagcagctggatgccgcgctgctggtacccggtgatcttgtaaagctcgcatccggctccgcggtgcctgccgattgcagcatcaacgagggtgtgattgacgtggacgaggcggcgctgacgggtgagtcgcttcccgtgacgatgggaacggaccacatgcccaaaatgggctcaaacgttgtgcgcggtgaggtggatggaacggtgcagtacactggacaaaacaccttttttggcaaaactgcggtgttgctgcagtcagtggaatccgatcttggaaatattcatgtgattctctcacgagtgatggtggtgctgacaagtttctcatttactttgtgccttatctgctttatctacttgatggtaaagttcaaggaatcatttcgccgttcgttacagttttctgtcgtggtgcttgtggtgtccattccgattgcccttgagattgtcgtgacgacgacgctggctgtgggctcaaagaagctgtcgaggcacaagatcattgtgacgaagctgaccgcaattgagatgatgtcaggtgtgaacatgctgtgctccgacaagacggggacgctgacgctgaacaaaatggagattcaggatcagtgctttacgtttgagaagggctacgacctgcgctccgtgcttgtgctggccgcacttgctgcgaagtggcgtgagccccctcgtgacgccctggacacaatggtgctgggggctgcggacttggacgagtgtgacaactacacacagactgaatttgtgccgtttgatccgacaacgaagcgcacggccgccacccttgtggacaagcgaacgaacgagaagttcagcgtgacgaagggcgcgccacacgtgattatccagctggtgtacaaccaggacgagatcaatgaccaggtggttgaaatcatcgacagtcttgccgcgcgtggtgtccgttgcctctctgtggcgaagacggactcgcagggccgctggcacctgtgcggcattctgacgtttcttgaccccccacgccccgacacgaaggaaacgatccgccggagcaagcagtacggtgtggacgtgaagatggttaccggcgaccatgtgctgattgcgaaggagatgtgccgcatgcttaaccttgacccgaacatcctaacggccgacaagctgcccaaggtggacgtgaatgatctgccggatgacctgggcgaaaagtacggggagatgatgcttggtgtgggtgggtttgcgcaggtgtttcctgagcacaagtttatgattgttgaggctcttcgtcagtatgggtttacatgcgcaatgacgggtgacggcgtgaatgacgcgcccgccctgaagcgtgcggatgtgggtattgccgtgcagggtgcgacggacgctgcgcgagccgcggctgacatggtgctgactggtcctggtctgagcgttgtggttgaggcgatgcttgtgtcccgacaggtgttccagcgcatgctttctttcttgacgtaccgtatatccgccactttgcagctggtgtgctttttctttattgcctgcttctccttgacgccccgtaactatggcagcgtcgatgcggatttccagttcttccaccttcccgtgctgatgttcatgctgatcactcttctcaatgacggttgcctgatgacgatcggctatgaccgcgtggtgccgtcgaagctgccgcagcggtggaaccttcctgttgtgttcacgattgccattattctggccgcggttgcttgttcttcttcgctgatgctgttgtggattgcccttgagggctggggcgaagagacttatccaaattcttggttcaaggctcttggccttgcgcagctgaagcaaggaaaggttgtgacgctgctttatcttaagatttccatctctgatttcttgacgctcttttcttctcgtactggcggacgctggttcttcacgatggcaccgggacttgtgttgcttattggtgcgattatctcgctttttgtgtcgtcgatggttgcctccttttggcatacgtctcgtccggatggtttgctaacggagggtcttgcgtggggagacacgaacagcgagaggctgttgccgctgtgggtgtggatctactgcattgtatggtggcttattcaggacgctgtgaaggtgggggcgcacatgctcatggagtggatggacctgtttggctgcgtctcgaaggcatatggcgggaaagttgttgaacagtatatggagaataagatcactgagcctgccaattaa

SEQ ID NO: 108030 - protein, 917 aa, Trypanosoma cruzi
MNQKNDNSVLNNSNNGNFNEQHPPQKSQKRQSVLSKAISEHKEDGVDEVPMLPPSKGLTTAEAKELLAKYGRNELPEKKTPSWLIFARNLWGPMPFVLWVAIIIEFALENWPDGAILLAIQLANATIGWYETIKAGDAVAALKNSLKPVATVHRDGTWQQLDAALLVPGDLVKLASGSAVPADCSINEGVIDVDEAALTGESLPVTMGTDHMPKMGSNVVRGEVDGTVQYTGQNTFFGKTAVLLQSVESDLGNIHVILSRVMVVLTSFSFTLCLICFIYLMVKFKESFRRSLQFSVVVLVVSIPIALEIVVTTTLAVGSKKLSRHKIIVTKLTAIEMMSGVNMLCSDKTGTLTLNKMEIQDQCFTFEKGYDLRSVLVLAALAAKWREPPRDALDTMVLGAADLDECDNYTQTEFVPFDPTTKRTAATLVDKRTNEKFSVTKGAPHVIIQLVYNQDEINDQVVEIIDSLAARGVRCLSVAKTDSQGRWHLCGILTFLDPPRPDTKETIRRSKQYGVDVKMVTGDHVLIAKEMCRMLNLDPNILTADKLPKVDVNDLPDDLGEKYGEMMLGVGGFAQVFPEHKFMIVEALRQYGFTCAMTGDGVNDAPALKRADVGIAVQGATDAARAAADMVLTGPGLSVVVEAMLVSRQVFQRMLSFLTYRISATLQLVCFFFIACFSLTPRNYGSVDADFQFFHLPVLMFMLITLLNDGCLMTIGYDRVVPSKLPQRWNLPVVFTIAIILAAVACSSSLMLLWIALEGWGEETYPNSWFKALGLAQLKQGKVVTLLYLKISISDFLTLFSSRTGGRWFFTMAPGLVLLIGAIISLFVSSMVASFWHTSRPDGLLTEGLAWGDTNSERLLPLWVWIYCIVWWLIQDAVKVGAHMLMEWMDLFGCVSKAYGGKVVEQYMENKITEPAN

SEQ ID NO: 108031 - DNA, 2628 bp, Trypanosoma cruzi
  CDS (1)..(2628)
atgctaccgccgtccaagggtctgacgacggccgaagcggaagagctccttgccaaatacggacgcaacgagctcccggagaagaaaacgcccagttggctgatatttgtgcgtaacctatggggtcctatgccttttgcgctgtgggtcgccatcatcattgagtttgcgctggagaactggcctgacggtgccattcttcttgctattcagcttgccaatgccacaattgggtggtatgagacaatcaaggcaggcgacgctgtggctgcgctgaagaactcactgaagcccgtggcgaccgtccaccgtgacggagcatggcagcagctggatgccgcgctgctggtgcctggtgatcttgtgaagctcgcatccggctccgcggtgcctgccgattgcagcatcaacgagggtgtgattgacgtggacgaggcggcgctgacgggtgagtcgcttcccgtgacgatgggaacggaccacatgcccaaaatgggctcaaacgttgtgcgcggtgaggtggatggaacggtgcagtacaccggacaaaacaccttttttggcaaaactgcggtgttgctgcagtcagtggaatccgatcttggaaatattcatgtgattctctcacgagtgatggtggtgctgacaagtttctcatttactttgtgccttatctgctttatctacctacttgctgagttttacgaaacatttcgccgttcgttacagttttccgtcgtggtgcttgtggtgtccattccgcttgcccttgagattgtcgtgacgacgacgctggctgtgggctcaaagaagctgtcgaggcacaagatcgttgtgacgaagctgaccgcaattgagatgatgtcaggtgtgaacatgctgtgctccgataagacggggacgctgacgctgaacaaaatggagattcaggatcagtgctttacgtttgagaagggctacgacctgcgctccgtgcttgtgctggccgcacttgctgcgaagtggcgtgagccccctcgtgacgccctggacacaatggtgctgggggctgcggacttggacgagtgtgacaactacacacagactgaatttgtgccgtttgatccgacaacgaagcgcacggccgccacccttgtggacaagcgaacgaacgagaagttcagcgtgacgaagggcgcgccacacgtgattatccagctggtgtacaacccggacgagatcaatgaccaggtggttgaaatcatcgacagtcttgccgcgcgtggtgtccgttgcctctctgtggcgaagacggactcgcagggccgctggcacctgtgcggcattctgacgtttcttgaccccccacgccccgacacgaaggaaacgatccgccggagcaagcagtacggtgtggacgtgaagatgattaccggcgaccatgtgctgattgcgaaggagatgtgccgcatgcttaaccttgacccgaacatcctaacggccgacaagctgcccaaggtggacgtgaatgatatgccggatgacctgggcgaaaagtacggggagatgatgcttggtgtgggtgggtttgcgcaggtgtttcctgagcacaagtttatgattgttgaggctcttcgtcagtatgggtttacatgcgcaatgacgggtgacggcgtgaatgacgcgcccgccctgaagcgtgcggatgtgggtattgccgtgcagggtgcgacggacgctgcgcgagccgcggctgacatggtgctgactggtcctggtctgagcgttgtggttgaggcattgcttgtgtcccgacaggtgttccagtgcatgctttctttcttgacgtaccgtatatccgccactttgcagctggtgtgctttttctttattgcctgcttctccttgacgccccgtaactatggcagcgtcgatgcggatttccagttcttccaccttcccgtgctgatgttcatgctgatcactcttctcaatgacggttgcctgatgacgatcggctatgaccgcgtggtgccgtcgaagctgccgcagcggtggaaccttcctgttgtgttcacgattgccattattctggccgcggttgcctgtggttcttcgctgatgctgttgtggattgcccttgagggctggggcgaagagacgtatccaaactcttggttcaaggctcttggccttgcgcagctgaagcaaggaaaggttgtgacgctgctttatcttaagatttccatctctgatttcttgacgctcttttcttctcgtactggcggacgctggttcttcacgatggcaccgggacttgtgttgcttattggtgcgattatctcgctttttgtgtcgtcgatggttgcctccttttggcatacgtctcgtccggatggtttgctaacggagggtcttgcgtggggagacacgaacagcgagaggctgttgccgctgtgggtgtggatctactgcattgtatggtggcttattcaggacgctgtgaaggtgggggcgcacatgctcatggagtggatggacctgtttggctgcgtctcgaaggcatatggcgggaaagttgttgaacagtatgaggacgaaacatctaattcagggaataaaaatgaatcaaaggaacccacggtgtaa

SEQ ID NO: 108032 - protein, 875 aa, Trypanosoma cruzi
MLPPSKGLTTAEAEELLAKYGRNELPEKKTPSWLIFVRNLWGPMPFALWVAIIIEFALENWPDGAILLAIQLANATIGWYETIKAGDAVAALKNSLKPVATVHRDGAWQQLDAALLVPGDLVKLASGSAVPADCSINEGVIDVDEAALTGESLPVTMGTDHMPKMGSNVVRGEVDGTVQYTGQNTFFGKTAVLLQSVESDLGNIHVILSRVMVVLTSFSFTLCLICFIYLLAEFYETFRRSLQFSVVVLVVSIPLALEIVVTTTLAVGSKKLSRHKIVVTKLTAIEMMSGVNMLCSDKTGTLTLNKMEIQDQCFTFEKGYDLRSVLVLAALAAKWREPPRDALDTMVLGAADLDECDNYTQTEFVPFDPTTKRTAATLVDKRTNEKFSVTKGAPHVIIQLVYNPDEINDQVVEIIDSLAARGVRCLSVAKTDSQGRWHLCGILTFLDPPRPDTKETIRRSKQYGVDVKMITGDHVLIAKEMCRMLNLDPNILTADKLPKVDVNDMPDDLGEKYGEMMLGVGGFAQVFPEHKFMIVEALRQYGFTCAMTGDGVNDAPALKRADVGIAVQGATDAARAAADMVLTGPGLSVVVEALLVSRQVFQCMLSFLTYRISATLQLVCFFFIACFSLTPRNYGSVDADFQFFHLPVLMFMLITLLNDGCLMTIGYDRVVPSKLPQRWNLPVVFTIAIILAAVACGSSLMLLWIALEGWGEETYPNSWFKALGLAQLKQGKVVTLLYLKISISDFLTLFSSRTGGRWFFTMAPGLVLLIGAIISLFVSSMVASFWHTSRPDGLLTEGLAWGDTNSERLLPLWVWIYCIVWWLIQDAVKVGAHMLMEWMDLFGCVSKAYGGKVVEQYEDETSNSGNKNESKEPTV

SEQ ID NO: 108033 - DNA, 2790 bp, Methanosarcina acetivorans
  CDS (1)..(2790)
atgaaaaaggagctggatgaaaataaaaatcagatatgctctcctcagggcgacgaacatttaatttcttactctgaattcctgcagaggttaggtgtaaatgaaaacgggctcagtgaacaggaagctgcccgcagactcaaggagtgcggtccaaatgtccttgaagaaagcggaaaagaaagtatatttaagagatacatccggcagttccgtaactttttctccatcctgctgaccgtaggagctcttctatcttttcttggcgaataccttgacccgggggagggaaatctatatataggaattgctcttatcggggtcgttttccttaacgggactttcacgtttgtgcaggagtaccaggctgcaaagacaatggaaagtttccgacagcttctgcctcctcatgcaaaagtcttcagggacggaaaggtgaaggacatcctggcttcagagcttgttgtaggggacgtcatcttgctcgaagaaggggataaggtccctgcagatgggcgtttgattgagaccaatgccctgaaagtggacaattccgccctgaccggtgagtcagagccgcagttgcgctctattgagtgtactcatgaaaatatgctggaatgccggaatatggtcttttccggaactcttgtacagagcggaaacggtaaagccattgttttcggaaccggccaggatacgcagatcggaagcctggcaacgcttacggagcagaccacctccgtggacacccctattcgaaaagaactcaaccatttcataaagatcatttcagcaattgcgattttcctgggaattacttttttcctgctcgcattttttctccaagatatctttctcgcaagcctcatctttgccataggaatcattgttgccaatgtcccagaggggctcttgcctacagttacgcttgccctcagccttgcttccagaagaatggctacccggaatgcccttataaagcagcttgagtccgtagagaccctgggctcgactactgtgatctgtacggacaagaccggaacccttacccagaacaggatggcagtaaattctcttatcctggggtttgaaagtctggaacgggaaaaaccttccagtcctcaggaaggcggtgaatcgggttcaaaagaacttacagggaatcccggctgggctccggaaaaaatccctcctgttttcataagggttgcagggctctgcaataacgcaaagctttacgaagctcctcccggatatactggcgacccgaccgaaggggcacttctcgtttttgcaaacggtttcgtagatgtaaaagccctccagcgcgagtatccgaggcaggaagagtttcctttcgattctcttacccggagaatggaagttgtctgccgcactcccgaagacaaacttgaggtctaccttaaaggcgctcctgaagttgttgtgcagatgtgcgggtcgattctggagtccggagaaatccgaaaactggatgaagccgggcaaaaagagcttcttggcagacacctgaagctggcagaaaagggagaaaggataattgccctcgccttcaggcaggccgacgcccagaaagagtataccggagacttcattttccttggcttcatcgggattatagatcctccgcgtcctgaagccagagaagctattgcaaaatgccacgcagcagggatcaaagttgttatgataacaggtgaccacccggttactgcagaatcaatagcgagagacgtaggtcttgcagcattcgggacacctgagatcattaccggagacgaattgaaatccctttcccgcacagagcttgcatcgcggctcaaaaatccgagcattgtttttgcccggacctcccctgtacagaaactgaaaattgtacagctctttcaggctgaaggcgagatcgtgaccatgaccggcgatggggtaaacgatgctcctgcgataaaaaatgccgatatgggggtcgcaatgggcagcggcacggatgtggcccgcgaagctgccgacatggtacttcttgacgataattttgctacgatagtaaacgctgtagaagagggcaggaccgtttttgataacataaaaaaattcattgcttacatccttacaagtaatatccccgagatcctgccgttcatagcctttgttctcctttcaattccccttcctatgcctgtccagcttatcctggcaatcgatctcgggactgacatcctacctgccattgcactgggggtggagaaaggggagggagatattatgaagagacctcccaggccacgggatgaaaaattactgacctctcaggtgcttttgacatcctacggggtgaagggacccatagaagctgcagcaggtttcttctgttattttgccgtactttttggaggaggctggacttacggcgagcagcttgcaaacaacaatcctatttacatgcaggcaataaccgctttcttctcagccataattatctgccagattgctaatgtatttgtttcaagaacccggttccagtctgtcttttcaatgggttttttcagcaatcgcatggtcctcctgggaattgcaagtgaactcctgattcttgccctcattatctggaacccggttgctaaccttatcttcaataccgctcccattgacttcaagtacatgctgcttgccgttccttttgcagttttcctactcggggtcgatgaactcaggaagtatctcctgagaaaaaatgtgagctgggtagccagattctttaaatggtga

SEQ ID NO: 108034 - protein, 929 aa, Methanosarcina acetivorans
MKKELDENKNQICSPQGDEHLISYSEFLQRLGVNENGLSEQEAARRLKECGPNVLEESGKESIFKRYIRQFRNFFSILLTVGALLSFLGEYLDPGEGNLYIGIALIGVVFLNGTFTFVQEYQAAKTMESFRQLLPPHAKVFRDGKVKDILASELVVGDVILLEEGDKVPADGRLIETNALKVDNSALTGESEPQLRSIECTHENMLECRNMVFSGTLVQSGNGKAIVFGTGQDTQIGSLATLTEQTTSVDTPIRKELNHFIKIISAIAIFLGITFFLLAFFLQDIFLASLIFAIGIIVANVPEGLLPTVTLALSLASRRMATRNALIKQLESVETLGSTTVICTDKTGTLTQNRMAVNSLILGFESLEREKPSSPQEGGESGSKELTGNPGWAPEKIPPVFIRVAGLCNNAKLYEAPPGYTGDPTEGALLVFANGFVDVKALQREYPRQEEFPFDSLTRRMEVVCRTPEDKLEVYLKGAPEVVVQMCGSILESGEIRKLDEAGQKELLGRHLKLAEKGERIIALAFRQADAQKEYTGDFIFLGFIGIIDPPRPEAREAIAKCHAAGIKVVMITGDHPVTAESIARDVGLAAFGTPEIITGDELKSLSRTELASRLKNPSIVFARTSPVQKLKIVQLFQAEGEIVTMTGDGVNDAPAIKNADMGVAMGSGTDVAREAADMVLLDDNFATIVNAVEEGRTVFDNIKKFIAYILTSNIPEILPFIAFVLLSIPLPMPVQLILAIDLGTDILPAIALGVEKGEGDIMKRPPRPRDEKLLTSQVLLTSYGVKGPIEAAAGFFCYFAVLFGGGWTYGEQLANNNPIYMQAITAFFSAIIICQIANVFVSRTRFQSVFSMGFFSNRMVLLGIASELLILALIIWNPVANLIFNTAPIDFKYMLLAVPFAVFLLGVDELRKYLLRKNVSWVARFFKW

SEQ ID NO: 108035 - DNA, 2730 bp, Methanosarcina acetivorans
  CDS (1)..(2730)
atgtactacgatcgggaaattagctcggttcttgaggagctgaagacttcagaggaaggattgagctccgaagaagctgaaaaaaggctggaagagtatgggaaaaacgaacttaaagaaaaagaaaaagtctcggtcttgcgactctttctctcacaattcaaaagtatcttaattttcatcctgatagttgcttccattgtttcggctttactcggggaaaccattgactcggtggtgattttatttactgtttttcttgccggagttcttggttttgtacaggagtatagagctgaaaaagcaattgaactccttaagtccctgacgtctcccgaggcaaccgtaataagaaacggggctgaaaaaaagatcccttcaaccgaactaatcccgggagacataattctgcttcagaccggagaccgcatccccgctgatgccaggataattaaagagttcaaccttaaagttgacgagtcctcgctcaccggtgagtccgtgcctgtccagaaaattaccgatgctctgcccgcaagcacttccaaagctgacaggaagaacatggtctatgcagggacttcagttgcttacggaagaggaaagggggtcgtcacggcaacaggcatgaaaacatcttttggggaacttgccggacttctcgggacaatagaaaggtccagaacccctctgcaagaaagcctcgataaattcgggagatggattggcggggcaactctcgtaattgtagcttttgttgcagtgctaggggttttttccggcttccctccgctggacatgtttctctggggtgttgcacttgcagttgccgctatccctgaagcccttcctgcggttgtgacagtagggctggggcttggagtaaggcgtatggtcaaaagacatgctcttgtgagaaaacttccttcggtagaaacgctcggggctactgatgtaatttgttctgacaagacaggcacgcttacacagaacaaaatgacagttgaaaagatatatgttaataaacagaacctcaaagtcacgggaaacgggtataatcctgaaggaaaatttttaaaagaggactcggataaagaagaccctgaggtctctgaggacgatttacatcttcggactcttttgcttggggctgccctttgcaacgattcaaaccttcataaagaagaagacgtgtggaaaattacaggagacccgacagaagcagctcttgtggtcgctgcggcaaaggcagggtttgaaaactccgaactagaacgaaaatacccgcgacttgcagaaatacccttttcttccgaaactaagagaatgaccaccttcaacaaactggaagacggccccggaagcattcttgattccgaacttgtggctttttcgaaaggagctccggaggtaatccttgcctcctgtacgaagattttgcttgacggcgaaacgaaagttttaactcaggagcagatacaggagatctccgagcaggttaaagaacttgctgatcaggccctgagagttatggctctttctttccgcccgcttgaagagggtttctcccccgaaaaagttacttccggggaaatccctgcagaagaaattgaaaaggacatgatcttttcagggctaataggtatgagagatcccccgagggaagaagtaaaagctgctatcaaaacctgtgaagaggcgggcatcaagacagtaatgataaccggggatcataagatcacagcggctgcaattgcaagagaactcgggattttaaaggaaaacgacctcactcttacgggttcggaacttgacaaccttgacgagattgagtttgaggagaaagttgaaaaggtttcggtttacgcgcgggtctaccctactcataaactgagagtggtagaagccctaaagaagaaaggctatgttgtggcaatgaccggggacggagttaacgatgctcctgccctgaaggctgcggatatgggcatagcaatgggcattacgggcactgatgtcagcaaagaagcttccagcatgatcctgacagatgataattttgcgtccattgtctcggcagttgaagaaggaagaaacatatttaaaaacatcaaaaacttcatagcctacggacttacagcccatatcggagaagtcctgatcgtcctcacagcaattctgggctggcagatcctacctttgattgcagtacagatcctctggatcaacctgattacggacgggctccctcccatggctctttctgttgaacctcctgacagggggcttatgaggcagaaaccaagggatgttgaagaaggacttatcacccgccgtgaaattgctgccgggcttgggattggagggcttattgccactcaggccctgatagttttagtctgggctctgaacagcggttttcccattccgaaactacagaccatgatcttcacacttgtagtcttttcagagatgttcaacgctttcaactggcgttctgacaggtattcgattttttctctcgggctctttacaaacaaagctctggtctatgcagtcctgaccacagtaatcctgcagttgctggtggtttacacccctttcctgcaatttgctttcaggacagtccctctttccctttctgagctgggaatcataacggctttagcttccaccaccctcatctcaatggagattgtaaagtacctgaatgcaaggaagtattactga

SEQ ID NO: 108036 - protein, 909 aa, Methanosarcina acetivorans
MYYDREISSVLEELKTSEEGLSSEEAEKRLEEYGKNELKEKEKVSVLRLFLSQFKSILIFILIVASIVSALLGETIDSVVILFTVFLAGVLGFVQEYRAEKAIELLKSLTSPEATVIRNGAEKKIPSTELIPGDIILLQTGDRIPADARIIKEFNLKVDESSLTGESVPVQKITDALPASTSKADRKNMVYAGTSVAYGRGKGVVTATGMKTSFGELAGLLGTIERSRTPLQESLDKFGRWIGGATLVIVAFVAVLGVFSGFPPLDMFLWGVALAVAAIPEALPAVVTVGLGLGVRRMVKRHALVRKLPSVETLGATDVICSDKTGTLTQNKMTVEKIYVNKQNLKVTGNGYNPEGKFLKEDSDKEDPEVSEDDLHLRTLLLGAALCNDSNLHKEEDVWKITGDPTEAALVVAAAKAGFENSELERKYPRLAEIPFSSETKRMTTFNKLEDGPGSILDSELVAFSKGAPEVILASCTKILLDGETKVLTQEQIQEISEQVKELADQALRVMALSFRPLEEGFSPEKVTSGEIPAEEIEKDMIFSGLIGMRDPPREEVKAAIKTCEEAGIKTVMITGDHKITAAAIARELGILKENDLTLTGSELDNLDEIEFEEKVEKVSVYARVYPTHKLRVVEALKKKGYVVAMTGDGVNDAPALKAADMGIAMGITGTDVSKEASSMILTDDNFASIVSAVEEGRNIFKNIKNFIAYGLTAHIGEVLIVLTAILGWQILPLIAVQILWINLITDGLPPMALSVEPPDRGLMRQKPRDVEEGLITRREIAAGLGIGGLIATQALIVLVWALNSGFPIPKLQTMIFTLVVFSEMFNAFNWRSDRYSIFSLGLFTNKALVYAVLTTVILQLLVVYTPFLQFAFRTVPLSLSELGIITALASTTLISMEIVKYLNARKYY

SEQ ID NO: 108037 - DNA, 2460 bp, Methanosarcina acetivorans
  CDS (1)..(2460)
atgaacaatcaaggtttgggggtatttatgaaagaaaatgtgcaactcaaagttgatgaaataaaggattctcctgcaagcgaaatcattaaaaaacttgattcgagtgacaaaggactttcttcttcggaagctgagagccggattgagcagtatggctataatgaaattttcgaaaagaaggtcagcccgcttagaaaatttttcggttatttctggggtcccattccctggatgattgaaattgcagctgtaatttcagcttttatccatcgatgggaagacttcgtgataatttccttgctccttctcttaaacggagtcgtggggttctggcaggaaaataaggctgacaatgccattgaactccttaagcagaaaatggcccttaatgccaaagtgctcagaggaggggaatggagccagatacctgcacgggaactggtccccggagatgtggttcgcgtacgttcaggagatgttgtgcctgcagaccttaagctctttgaaggagactatctgcaggtagatgaatcagctctcaccggggaatccctgcctgtagaaaaaaaatccgatgatattgcctattcggggtccgttatccagaaaggggagatgaacgcccttgttgtggctacgggtatgaatacctattttggagagacaaccaaactggtggccgagattcggaccaggagccacttccaaaaagcggtcctaaaaatcggagactacctgatcgtccttgcagcctgcattgttgcgattgttttagttatagagttttttttcaggcatactccttttctggaaaccctccagtttgctcttgtgttgatcgtagccgcaattccggcagctcttcctgccgtaatgtccgtttcaatggccgttggagccaccgagctcgcaaacaaaggagccattgtcagcaagctggtctccatagaagaaatggccgggatggatatcctgtgttcggacaaaaccggtacgatcacccagaataagctaaaattgtcagaaatatcacctttcggaaactttaaagaaaacgatctcctgctttacggctcgctggcctcaagggaagaggacaacgacccgattgataatgcaatccttctgaaggcaaaagatgaaggatcagttcaagaaaaaatcgattcttatgaagtcaaagagttcacgccgtttgatcccgttataaagcacaccgaggctacgattgaagggcctgaagggaaattaaaaattgccaaaggtgcgccccaggttattctggacatgtcagatgataaagaagaagtaaggcagaaagtggaagaaaaagtagattctctggcttcaaaggggtatcgtgccctgggagtatgtgtgggggaagaagggaaatacaggtttgcagggcttctgggactttatgaccccccgcatgaggactctgctgagaccataaagacagcaaactccctcaacgtgaacgtgaaaatggtaaccggggaccatatcgccattgctaaggagatagcaagccaggtaggcctgggcacgaacataattacggctgatgatttcgtagaaaaatccgattccgaagctcaggaacttgtagaaaaggcagacgggtttgcccaggtctttcccgagcacaaatacaggatcgtcgacctccttcaaaaagaagaacatattgttggcatgacaggagacggcgtcaacgacgtccctgctctgaaaatggctgatgcgggaattgctgttgcaggagccacggatgccgcaaaatccgctgcagacatcgtgtttacaatatcaggcctctcgatcattattaacgcgataaaagaaagccgcaagatattccagaggatgaagagctactccatctacagaattgccgaaaccgtccgggtgcttttttttattgccacttcgataatcgtgtttaatttctatcccataaccgccataatgatcgttttgcttgctattctcaacgatgcccctataatgactattgcatatgacaatgtgaaatattccctgaaaccggaagaatggaacatgcgcgaggtcgtgagagtttccacatttctgggaattctgggagtgattgcttcattcctgatatactatatcggagccagggttctttacctcagtccgggtgtactgcagtcttttatcttcctgaaacttgccgtagccgggcacctgaccatatttgttgcccgcaccaggggacatttctggtctcctcctccgggaaagctccttttttggtctgcagtggtcacaaaactgctggcaacctttatcgcagtgtacgggatctatatatctcctatcggatggaaactggcaggctttatctggatctacgcacttacagcttttgttataaccgattatttgaaggtaggcttttataagctaatggacagcagaggatga

SEQ ID NO: 108038 - protein, 819 aa, Methanosarcina acetivorans
MNNQGLGVFMKENVQLKVDEIKDSPASEIIKKLDSSDKGLSSSEAESRIEQYGYNEIFEKKVSPLRKFFGYFWGPIPWMIEIAAVISAFIHRWEDFVIISLLLLLNGVVGFWQENKADNAIELLKQKMALNAKVLRGGEWSQIPARELVPGDVVRVRSGDVVPADLKLFEGDYLQVDESALTGESLPVEKKSDDIAYSGSVIQKGEMNALVVATGMNTYFGETTKLVAEIRTRSHFQKAVLKIGDYLIVLAACIVAIVLVIEFFFRHTPFLETLQFALVLIVAAIPAALPAVMSVSMAVGATELANKGAIVSKLVSIEEMAGMDILCSDKTGTITQNKLKLSEISPFGNFKENDLLLYGSLASREEDNDPIDNAILLKAKDEGSVQEKIDSYEVKEFTPFDPVIKHTEATIEGPEGKLKIAKGAPQVILDMSDDKEEVRQKVEEKVDSLASKGYRALGVCVGEEGKYRFAGLLGLYDPPHEDSAETIKTANSLNVNVKMVTGDHIAIAKEIASQVGLGTNIITADDFVEKSDSEAQELVEKADGFAQVFPEHKYRIVDLLQKEEHIVGMTGDGVNDVPALKMADAGIAVAGATDAAKSAADIVFTISGLSIIINAIKESRKIFQRMKSYSIYRIAETVRVLFFIATSIIVFNFYPITAIMIVLLAILNDAPIMTIAYDNVKYSLKPEEWNMREVVRVSTFLGILGVIASFLIYYIGARVLYLSPGVLQSFIFLKLAVAGHLTIFVARTRGHFWSPPPGKLLFWSAVVTKLLATFIAVYGIYISPIGWKLAGFIWIYALTAFVITDYLKVGFYKLMDSRG

SEQ ID NO: 108039 - DNA, 2520 bp, Methanosarcina acetivorans
  CDS (1)..(2520)
atggggatcattgtgatgaatcaaaatatcactagtacggatgaagcaaaagaagcatctgtagccgaactcctggagaaactatcttcaagtgaaagagggcttaccgattcggaggcaaaagagaggcttcaaaaatacgggcccaatgaaatcacggaaaagaaggccagtgcacttgtcaagtttttgagctatttttggggacctattccctggatgatcgaaattgcagtcgtcctgtcgggaatcctgcatcggtgggatgattttgcaattattcttgcgctgctgctgctgaatgtaactgtgggcttctggcaggaacacaaagccgataatgctattgaattattgaagcagaaactggctttgaaagcaagggtactccgcgacaacaaatggcttgaaatatccgcaggtgaaatggtacccggagatgtaattcgactccggctgggagatatttgccctgcagatgtcaaacttattacaggagattacctgcttgtcgatgaatccgcattaacaggggaatctctccctgtggaaaagcatgtgtccgatattgcatactcgggttcggttatccggcagggggaaatggatgcgctggtagttgcaaccggcatgaacaccttctttgggaaaactgcgaggctggtagaagaggctaaaacccaaagccatttccagaaggctgtcatcaaaatcggagactaccttattgtttttgcccttgtccttgttgcctttactttccttgtggtgctcttccgtcatgaaagcctgcttgaatttttccagtttgcgcttgtcctgctcgtagcagcaattccggccgccctgcctgcagttctatcggtaagcatggcagtaggcgcagttaccctggccagggatggggctatcgtaagtaagcttgcggctgtcgaagaaatggcaggaatggatatcctgtgttcggataagaccgggaccattaccaaaaacgaacttgttctgaccgaaataaacccttttcagaatttttccgaaaacgatgtgcttctctttgccagcctggcttcgagggaagaggacagggacccgattgatgacgcagttctcgccagaacaaaaacccttaaggatttttcagaaatcgccggaagctacagggtactttcgttcaagccgtttgacccggtttcaaaacggacggaagccgaagtagaggactcggctggcaacaggttcctggtaacaaaaggggcgcctcaggcagtttcggctctcatggacagtgaagttgccgtgaccagtaaagttaccacagatagtaaagttaccacagatgacagtgagaatacagcagggtcccagattgaggaatacgttgaagagtttgcatccaggggataccgggctctgggagttggccggaccgatgctcagggaagctggcattttgcagggcttcttgccctctacgatcctccccgtgacgattctgcagagaccatccggactgcacaggatatgggcgtggacgtaaaaatgattacaggcgaccatctcgctattgcaaaggagatttccaggcaggtaaacttaaagcaggacatcatgcttcccacgtcctttctggatgcacctgaccgaaatgcagaagaaatagttgaaacagcggatggttttgcccaggtgttcccggaacataagtaccatatcgtggaattgctacagcacaggggtcatatcataggcatgaccggagatggagttaatgacgctccagccctgaaaaaggccgatgcaggtattgctgttgccggagctacggacgcagccaagtccgctgccgacatcgtgctgacgaagcccgggctttctacaattgtcaatgcgctcaaggagagccgtaagatattccagcggatgaataattatgccctgtaccgtattaccgaaacgattcgagtcctgcttttcataacctcttcaatccttgcgtttaagttctatcccgttacttctctgatgatagttttgctggcgcttctgaatgatgctccaataatgactattgcttatgacaatgtcaaatactccgatctgccggaaaaatgggacatgcgaattttgctgagtatggcaacccttcttggagttataggagttatcagttcattcgggatcctttacataggcctccatattttccagctttcccatgaagtcctccagtctttcatatacctgaaactttccgtagcaggtcatttaacaatatttgtggcaaggacaaaaagctacttctggtcagtaaaaccggccaaaatcttattcgcagcagtaataattacacaaattattgccacactcataaccgtgtacgggttcctgcttcctgcaatgggatggaaacttgcctttttcgtctggggatatgcgttgacagccttcgttataacagattttatcaaagtccaggcttacaggttgctgaaccataccggaataaagtttcatgtatga

SEQ ID NO: 108040 - protein, 839 aa, Methanosarcina acetivorans
MGIIVMNQNITSTDEAKEASVAELLEKLSSSERGLTDSEAKERLQKYGPNEITEKKASALVKFLSYFWGPIPWMIEIAVVLSGILHRWDDFAIILALLLLNVTVGFWQEHKADNAIELLKQKLALKARVLRDNKWLEISAGEMVPGDVIRLRLGDICPADVKLITGDYLLVDESALTGESLPVEKHVSDIAYSGSVIRQGEMDALVVATGMNTFFGKTARLVEEAKTQSHFQKAVIKIGDYLIVFALVLVAFTFLVVLFRHESLLEFFQFALVLLVAAIPAALPAVLSVSMAVGAVTLARDGAIVSKLAAVEEMAGMDILCSDKTGTITKNELVLTEINPFQNFSENDVLLFASLASREEDRDPIDDAVLARTKTLKDFSEIAGSYRVLSFKPFDPVSKRTEAEVEDSAGNRFLVTKGAPQAVSALMDSEVAVTSKVTTDSKVTTDDSENTAGSQIEEYVEEFASRGYRALGVGRTDAQGSWHFAGLLALYDPPRDDSAETIRTAQDMGVDVKMITGDHLAIAKEISRQVNLKQDIMLPTSFLDAPDRNAEEIVETADGFAQVFPEHKYHIVELLQHRGHIIGMTGDGVNDAPALKKADAGIAVAGATDAAKSAADIVLTKPGLSTIVNALKESRKIFQRMNNYALYRITETIRVLLFITSSILAFKFYPVTSLMIVLLALLNDAPIMTIAYDNVKYSDLPEKWDMRILLSMATLLGVIGVISSFGILYIGLHIFQLSHEVLQSFIYLKLSVAGHLTIFVARTKSYFWSVKPAKILFAAVIITQIIATLITVYGFLLPAMGWKLAFFVWGYALTAFVITDFIKVQAYRLLNHTGIKFHV

SEQ ID NO: 108041 - DNA, 2550 bp, Clostridium perfringens
  CDS (1)..(2550)
atgcatgagaaagaactctttagagggttaacaactcaagaagctaaacaacgaatagaaaaatttggattaaatgaaataacagaaaagaaaaaggtatctgctataaaaatattattacaacaatttaatgattttataatatgggttttaattggagctactattatatcaggacttatgggagatgttgcagatgctattaccatatttgttattgttgtaataaacggaattttaggatttgtacaggaatttaagacggaaaaatctttagatgcattaaaatccttagcagcacctacttgcaaggtattaagagatgggaatattaaggtaattaatgctaatgaattaactataggagatgttgtgatattagaggctggagatagagttcctgctgatggagaaatctttgagtgtacaaactttatgattgatgagtcattacttactggagaatcagttggagttaacaaaacaaataattctaaagaagcttctttaatttacatggggactaaagtattaaaaggtaaaggaagatttagagtaacagctataggtatgagtacaaaaatgggatctatagcagatatgttacaggacatagaagaggaaaaatctcctcttaaagagagattagatggattagggaaaattttacttgtattatgtttagctatatgtgctttagtaactatattaggtattataagaggaaatgatttaacagaaatgttcttactaggtgttagtttggcagtagcggctataccagaaggattagcggccatagtaactgtttctttagctttaggagtttctagaatgttaaaaagaaatgccttagtaaagaaattaccagctgttgaaacactaggatgtacctcagttatatgtagtgataagactggtaccttaactcagaataagatgactgttaaagaaatttttgtagatggaaagcattgtagattagatgtagataaaattccaaattcacctattttaatgaaagcctttgtttattgtaatgattgtaattatgacttttcaaaggataagttagatgatgtattaaatggtgatcctacagaaacagccttaataaaggcatattttaataatgtagatctattaaaaaatacagtatctaatgtaaatagagtttttgatataccttttgattcaagtagaaaaatgatgtcagttatagttaaggagaatggaagagaggcttgttatgtaaaaggtgctccagaaagacttataaataaatgtagatatatacatgaagaaggaagagttaaattactaacttctcaaaagaaacaacaaatattaaatgttgtggagaatatgagtaatagggcactaagatgtataggaggcgcatataaagtagaaaatttaactagaagtgaaagtcttgaaaatgaacttatattccttggaattgcagggataatagatccacctagaccagaggttaaggactcagttataaaatgtagattagcaggaataactcctgtaatgataactggtgaccataaaaacactgctttcgctataggaaaagatttaaatattgcaaaatctcaagatcaagtaataactggagaagaattagacaaattagatgataaagaacttaaaaagagagttaataagctgagaatatttgctagggttacgcctaatcataagcttagaatagttaaggcctttaagcaaaatggaaatatagttgccatgactggagatggagtaaatgatgctccagctataaaggaagctgatattggggttgctatgggaatttcaggtactgatgttacaaaggaagcttcttcaatgattttaatggatgataactttgaaaccatagtatcagcagtagaagagggaagaataatatatgataatataagaaaattcataagatatttattgtcatgtaatttaggagaggttttaacaatgtttttagctaccatattctatcttccaactcctatgttacctatacaaattctttttgtaaatttagctacagatggacttcctgcaatagccttaggagtagatcctgctgataaggatataatgaatcaacagcctagaagtaagaaagaaggtatatttgctaggggacttactgagaaaattttagtaagaggatgtttaattggaatatgtaccttactaacctttattgttggtggattatatggaatggatttaaatacatgtagaactatggctttatcaacattagttatgtctcaattattacatgtttttgaatgtagatcagaaagacattcaatttttgaaataaaattatttactaatatgtatttagtaggtgcagtagcaatatcaatacttatgttattaagtattatttacattcctttctttagtggaatattccataccacagtactaggtataaatcattggttaatagttttattcttctcaacaataatattctttataaatagcttatatttatttataaaagtaaagaaataa

SEQ ID NO: 108042 - protein, 849 aa, Clostridium perfringens
MHEKELFRGLTTQEAKQRIEKFGLNEITEKKKVSAIKILLQQFNDFIIWVLIGATIISGLMGDVADAITIFVIVVINGILGFVQEFKTEKSLDALKSLAAPTCKVLRDGNIKVINANELTIGDVVILEAGDRVPADGEIFECTNFMIDESLLTGESVGVNKTNNSKEASLIYMGTKVLKGKGRFRVTAIGMSTKMGSIADMLQDIEEEKSPLKERLDGLGKILLVLCLAICALVTILGIIRGNDLTEMFLLGVSLAVAAIPEGLAAIVTVSLALGVSRMLKRNALVKKLPAVETLGCTSVICSDKTGTLTQNKMTVKEIFVDGKHCRLDVDKIPNSPILMKAFVYCNDCNYDFSKDKLDDVLNGDPTETALIKAYFNNVDLLKNTVSNVNRVFDIPFDSSRKMMSVIVKENGREACYVKGAPERLINKCRYIHEEGRVKLLTSQKKQQILNVVENMSNRALRCIGGAYKVENLTRSESLENELIFLGIAGIIDPPRPEVKDSVIKCRLAGITPVMITGDHKNTAFAIGKDLNIAKSQDQVITGEELDKLDDKELKKRVNKLRIFARVTPNHKLRIVKAFKQNGNIVAMTGDGVNDAPAIKEADIGVAMGISGTDVTKEASSMILMDDNFETIVSAVEEGRIIYDNIRKFIRYLLSCNLGEVLTMFLATIFYLPTPMLPIQILFVNLATDGLPAIALGVDPADKDIMNQQPRSKKEGIFARGLTEKILVRGCLIGICTLLTFIVGGLYGMDLNTCRTMALSTLVMSQLLHVFECRSERHSIFEIKLFTNMYLVGAVAISILMLLSIIYIPFFSGIFHTTVLGINHWLIVLFFSTIIFFINSLYLFIKVKK

SEQ ID NO: 108043 - DNA, 2658 bp, Clostridium perfringens
  CDS (1)..(2658)
atgaagaaagtttattcaaaatcaaaagaagaactttttaaagaactcggtgtaaacaaggacggtttaaatgacactgaagttaaaagcatggaagaaaaatatggtaaaaacgaattagttgaaggtaagaaaaaatctactttccaagtatttcttgatcaatttaaggacatgctaataataattcttatatgtgctgccgctatttcaatgtttttaggagatattgaaagtgccgctgttatcatattcgtattaatagtaaatgctactcttggaactattcagcatcttaaagctgaacaatcattaagtagcttaaaagctctctcctcaccttctactaaggtgcttagaaatggtgaaagaatagaaatagactcaaaggatgtagttgttggagatattatctttcttgaagctggagactatgttcctgctgatggtagaattcttgaaaactatagcttacaagttaatgaaagctcattaacaggagaatctgaaagcatagttaaaatgtctgaaataataaaaggagaagaaatccctattggtgatagaaaaaatatggtcttctctggaagcttagtaacttatggtagagctactattttagcaacagccgttggtatggatactgaaataggtaaaatagctcagttattaaatgataccaaggaaaagaaaactcctcttcaagctaacttagataactttggtaaaaagcttgcaattggaatacttgttatctgtgcaatagtatttgctcttagtctttatagaggtgaagctattatagatgcattcatgtttgcagttgccttagccgtagctgctatcccagaagctttaagttctatagtaacaatagttctttctttaggaactcaaaaaatggctaaagaaaatgccatcataagaaaattacaagcagttgaaggcttaggtagtgtatctattatatgttcagataaaactggtacactaactcaaaataaaatgactgttaaaaagatttttgttgatggaaaagtaatagattcaaatgaattaaacttagaaaagaaaatagataatgatttattaactatgagtttactttgtaatgatgcaattacagattgtgaaaaagaaataggtgatccaactgaggttgcccttgtaaacttaggtgatttatacggagtagatgaacttgttcaaagggataaatttaaaagacttggtgaaattccttttgattcagatagaaaacttatgagtgttgtttataacattcatggtgaaaatattatagctactaagggagctgttgatgttcttcttaaaagatctactaagattgaaacttctgaaggggttagacctataactaaagaagatatagctaaaatagaagaaattaaccaagaattctcaaaaacaggtcttagagttttatcttttgcatatagaaatattgaaagtagaacagatataaaacttgatgatgaaaatgacttaaccttcataggtcttatatcaatgatggacccaccaagagaagaatctgctgaagccgtaagagcttgtatagaagctggaattaaacctgtaatgataactggtgaccataaaataacagcttccgccatagcaaaacaaataggtatattaaaagatgaaagtgaagctattgaaggttctgctttagataaaattagtgacgaagaacttaagaatatggtagaacacatttcagtatatgctagggtttctccagagcataaaataagaatagttagagcatggcaagaaaaaggcaatgtagttgccatgactggtgatggtgtcaatgacgcccctgctttaaaacaagctgatataggtgttgcaatgggtattacaggatctgaagttgctaaagatgccgcttctatggtcttaacagatgataactttgcaaccatagtaaaagctattgaaaatggtagaaatatttactcaaatattaaaaatgctattaaattcttattatctggtaatactgctggtatattatcagtattatatgcttccatattagcattaccagttccatttgctgcggtacacttattatttataaaccttttaactgatagtttacctgcaattgctttaggtcttgaacctcataaaaaagaagttatgaaagaaaaaccaagaaaagctaatgcttctatattaacaaaagactttgttacagatgttttatttgaaggtgtagttattactattgttactatgatagccttccatattggattaaaccaaggtggacctctattagcaagtacaatggcctttgctactttatgtttatcaagacttgttcacggatttaacagtaaatctaaaaaacatgtagtatcaaaagaattattctctaataaatatttatgggctgcatttggtgtaggatttgtactattaaacattgttcttttagtacctgcatttgaaggattattccaagttgctccacttacacttaataacttattaactatatatggattatcattatgtactttcatagttgttcaatttgttaaatttataagagaaaaatttactgaaaataaaacaaacactgttcaagaatcaaataaagaaaatagagcagcttaa

SEQ ID NO: 108044 - protein, 885 aa, Clostridium perfringens
MKKVYSKSKEELFKELGVNKDGLNDTEVKSMEEKYGKNELVEGKKKSTFQVFLDQFKDMLIIILICAAAISMFLGDIESAAVIIFVLIVNATLGTIQHLKAEQSLSSLKALSSPSTKVLRNGERIEIDSKDVVVGDIIFLEAGDYVPADGRILENYSLQVNESSLTGESESIVKMSEIIKGEEIPIGDRKNMVFSGSLVTYGRATILATAVGMDTEIGKIAQLLNDTKEKKTPLQANLDNFGKKLAIGILVICAIVFALSLYRGEAIIDAFMFAVALAVAAIPEALSSIVTIVLSLGTQKMAKENAIIRKLQAVEGLGSVSIICSDKTGTLTQNKMTVKKIFVDGKVIDSNELNLEKKIDNDLLTMSLLCNDAITDCEKEIGDPTEVALVNLGDLYGVDELVQRDKFKRLGEIPFDSDRKLMSVVYNIHGENIIATKGAVDVLLKRSTKIETSEGVRPITKEDIAKIEEINQEFSKTGLRVLSFAYRNIESRTDIKLDDENDLTFIGLISMMDPPREESAEAVRACIEAGIKPVMITGDHKITASAIAKQIGILKDESEAIEGSALDKISDEELKNMVEHISVYARVSPEHKIRIVRAWQEKGNVVAMTGDGVNDAPALKQADIGVAMGITGSEVAKDAASMVLTDDNFATIVKAIENGRNIYSNIKNAIKFLLSGNTAGILSVLYASILALPVPFAAVHLLFINLLTDSLPAIALGLEPHKKEVMKEKPRKANASILTKDFVTDVLFEGVVITIVTMIAFHIGLNQGGPLLASTMAFATLCLSRLVHGFNSKSKKHVVSKELFSNKYLWAAFGVGFVLLNIVLLVPAFEGLFQVAPLTLNNLLTIYGLSLCTFIVVQFVKFIREKFTENKTNTVQESNKENRAA

SEQ ID NO: 108045 - DNA, 2826 bp, Oryza sativa
  CDS (1)..(2826)
atggatgaaccaggtgaacctttgcttgggctagagaatttcttcgacgaagatgttgatttggagaatctgcccctggaagacgtttttgagcagctgaatacgtctcagagtgggctctcatcagcagatgctgcagaacgcttgaagttgtttggtgcaaacagattggaggagaagcgtgagaacaagatcatcaagttcctcagctttatgtggaatcctttgtcctgggtgatggaggcagcagcagtgatggcattggttctagcaaatggtggtagccaaggtactgactgggaagatttcctgggaattgtctgcctcctgattatcaattcaacaatcagcttcattgaggagaacaatgcaggcgatgctgctgctgcactcatggcccggttggcgctaaaaacaaaggttcttagagatgagcaatggcaagagcttgatgcttctacattggtacctggggatattatcagcatcaggcttggtgatattgtccctgcagatgcgcgcctacttgagggagatcctctgaagattgatcagtcagctctcaccggtgaatcccttcctgtcacaaaaagaacaggggacatagtgttcactggctcaacatgcaagcatggtgagattgaagctgttgtcattgcaactgggatacactctttctttggcaaggcagctcatctagtggattccactgaggttgttgggcattttcagaaggttcttacctccataggcaacttctgtatctgttcaatcgccatcggtgcgattgttgaggttataatcatgttcccaatccagcaccggtcataccgggatgggatcaacaatgttcttgttcttctgatcggagggataccgatcgcaatgcctactgttctgtcagtcacacttgcaataggttctcatcacctgtctcaacagggtgctatcactaaaaggatgacagccatagaggaaatggcaggaatggatgttctctgctgtgacaaaaccggaactctcaccctcaaccatctcactgttgacaaaaacctaattgaggttttcagcagagaaatggacagggaaatgattatcctgctggctgcaagagcatcaagagtggagaatcaagatgcaattgatatggccataataaacatgctagctgaccccaaagaggcacgctctagcatcactgaagttcacttccttccattcaatcctgtcgataagaggacggctataacatacgttgattctgatggtaactggttcagagtcagcaaaggtgctcctgagcagatcctcagcctatgctacaacaaggatgatatctctgaaaaggtgcagctaatcatcgacagatttgcagagagaggcctccgttcactcgccgtcgcttaccaggaggtgccagagaaatcgaagcacggccatggcggaccatgggtgttctgcggcctcctgccgctgttcgacccgccgcggcacgacagcgccgacaccatccgccgagcgcttgatcttggcgtctgcgtgaagatgatcaccggcgatcacctggccatcgcgaaggagaccggccgccgtcttgggatgggcaccaacatgtacccgtcggcgtcgctgttcggccgccacggcgacggcggcggcgcggctgttccggtggaggagctcgtggagaaggcggacgggttcgccggcgtgttcccggagcacaagtacgagatcgtgaggatgattcaaggggggggcggccacgtgtgcgggatgaccggcgacggcgtgaacgacgcgccggcgctgaagaaggccgacatcggcatcgccgtctccgacgcgacggacgccgcgaggggcgccgccgacatcgtgctcaccgagcccggcctcagcgtcatcgtcagcgccgtcctcaccagccgcgccatcttccagcggatgaagaactacacgatttatgcagtgtccatcactataaggatagtgattggatttgttcttctggcatcaatttgggagtacgacttccctccgtttatggttctgatcatagccatactaaatgacggaactatcatgacaatatcaaaggatcgcgtgaagccatcaccaagcccagatagctggaaactgaatgagatattcgcagctggagttgtcataggaacctaccttgcattggtaaccgtgctgttctactggacagtcacaagaacaaccttctttgagtctcacttcaaggtgagatctctgaagcaaaattccgacgagatctcgtcagcgatgtacctgcaagtcagcatcatcagccaggccctgatattcgtcacacgcagtcagggcttgtccttcctcgagagacctggagccctgctgatttgtgctttcatcctagcacaattggtggctacactgatcgccgtgtacgcaacgatcagcttcgcgtcgatcagcgcgatcgggtggggatgggcgggcgtgatatggctgtacagcctggtgttctacgcccccctcgatctgatcaagatcgccgtccgctacacgctcagcggcgaagcctggaacctgctgttcgacaggaaggagagactacggcggcaacgagcggcggccggagaccaggtggccgcgctcccatcatcatcatcatcaacaacggagggcgctttccgatcatctcctcagcagcggatggcggcctacgcggatcgcggagcgagccaagcgacgggcagaaatcgccagattgggagatgcacatatgctgagagcgcatgtgcaatctgtgatgagactgaagcgtgtggattctga

SEQ ID NO: 108046 - protein, 941 aa, Oryza sativa
MDEPGEPLLGLENFFDEDVDLENLPLEDVFEQLNTSQSGLSSADAAERLKLFGANRLEEKRENKIIKFLSFMWNPLSWVMEAAAVMALVLANGGSQGTDWEDFLGIVCLLIINSTISFIEENNAGDAAAALMARLALKTKVLRDEQWQELDASTLVPGDIISIRLGDIVPADARLLEGDPLKIDQSALTGESLPVTKRTGDIVFTGSTCKHGEIEAVVIATGIHSFFGKAAHLVDSTEVVGHFQKVLTSIGNFCICSIAIGAIVEVIIMFPIQHRSYRDGINNVLVLLIGGIPIAMPTVLSVTLAIGSHHLSQQGAITKRMTAIEEMAGMDVLCCDKTGTLTLNHLTVDKNLIEVFSREMDREMIILLAARASRVENQDAIDMAIINMLADPKEARSSITEVHFLPFNPVDKRTAITYVDSDGNWFRVSKGAPEQILSLCYNKDDISEKVQLIIDRFAERGLRSLAVAYQEVPEKSKHGHGGPWVFCGLLPLFDPPRHDSADTIRRALDLGVCVKMITGDHLAIAKETGRRLGMGTNMYPSASLFGRHGDGGGAAVPVEELVEKADGFAGVFPEHKYEIVRMIQGGGGHVCGMTGDGVNDAPALKKADIGIAVSDATDAARGAADIVLTEPGLSVIVSAVLTSRAIFQRMKNYTIYAVSITIRIVIGFVLLASIWEYDFPPFMVLIIAILNDGTIMTISKDRVKPSPSPDSWKLNEIFAAGVVIGTYLALVTVLFYWTVTRTTFFESHFKVRSLKQNSDEISSAMYLQVSIISQALIFVTRSQGLSFLERPGALLICAFILAQLVATLIAVYATISFASISAIGWGWAGVIWLYSLVFYAPLDLIKIAVRYTLSGEAWNLLFDRKERLRRQRAAAGDQVAALPSSSSSTTEGAFRSSPQQRMAAYADRGASQATGRNRQIGRCTYAESACAICDETEACGF

SEQ ID NO: 108047 - DNA, 2859 bp, Lycopersicon esculentum
  CDS (1)..(2859)
atggcgaaagctataagcctcgaagagatcaaaaatgagactgttgatctggagaaaatccccattgaagaagtgtttgaacaactgaaatgttcgcgagagggtctgacttcggacgaaggagccaacaggcttcaaatctttggaccgaacaaattggaagagaaaaaagaaagcaaaatactgaagtttcttgggtttatgtggaatcctctgtcatgggttatggagatggcggctatcatggccattgcactggctaatggagatgggaagcccccagattggcaagattttgttggtattgtttgcttgctggtgatcaattcaactatcagttttattgaagaaaacaatgctggcaatgctgccgcagctcttatggctggtcttgctcccaaaaccaaggttcttagagatgggcgctggagtgaacaggaagctgctattctagtgcctggtgatattataagtgtcaagttgggagacattgttcctgctgatgctcgtcttcttgaaggtgatcctttaaagattgatcaatctgcccttacaggagaatctcttcctgtgacaaagaatcctggagatgaagttttctctggatcaacctgcaaacaaggtgagcttgaagctgtagtcattgccactggagttcacactttctttggcaaggcagcacaccttgttgacagtacaaacaatgttggtcatttccagaaagtgttaacagccataggaaacttctgtatctgttccattgctattggtatgctggttgagattattgtcatgtatccaatccagcacaggaagtacagggatggaattgacaatctcttggtgctccttattggtggtattcccattgctatgcctactgtgttgtcagtcactatggctattggatcccataggctctcccagcagggtgccatcaccaagagaatgactgctattgaagaaatggctggaatggatgtgttgtgcagtgacaagacaggtaccttgactcttaacaagttgagtgtcgacagaagcttggttgaagtgtttactaagggagtagataaagaatatgtgctcctccttgccgcaagggcctctagagttgaaaatcaggatgcaattgatgcttgcatggttggcatgcttgccgatccaaaagaggcacgagctggtatcagggaggtgcatttcttgcccttcaatccagtggacaagagaactgctttaacatatattgacagcaatggcaactggcaccgtgccagcaagggagctcctgagcagattttggacctatgtaactgtaaggaagatgtcaggagaaaggttcattcaatgatcgacaaatacgctgagcgtgggttgaggtcactggctgtagctagacaggaagtgccagagaaatcaaaagagagcactggaggtccatggcaatttgttggattgctacccctctttgatcctcccaggcatgatagtgctgagaccatccgtagagctctcaaccttggtgtaaatgttaagatgatcactggggatcaattggctattgccaaggagactggccgtaggcttggaatgggaacaaacatgtacccatcagcatctttacttggtcaagacaaggattcatctattgcttcacttcctgtagaagagttgattgagaaggcagatggatttgctggagtatttcctgagcacaaatatgagattgtgaagaagttgcaggagagaaagcacattgtgggaatgactggtgatggtgtgaacgatgctcctgctttgaagaaggcagatatcggtatcgctgttgcagatgctactgatgcagcacgaggtcgttctgatatcgtgctcactgagccaggtctaagcgttatcatcagtgctgtgttgaccagtagagctattttccagaggatgaagaattacacaatatatgcagtttccatcacaatccgtattgtgtttggtttcatgcttattgctctaatctggaagtacgacttctctgcatttatggttttgatcattgccatcctaaatgacggaaccattatgacaatctcaaaggatagagtgaaaccatctccaatgcctgatagctggaagttgaatgaaatctttgcaactggtgttgttcttggagggtaccaagcattgatgactgttattttcttctgggcgatgcatgacactagtttcttcacggacaaatttggtgtgaaggatattagggaaagtgatgaagaaatgatgtctgctttgtaccttcaagtgagtattatcagccaggctttgattttcgtgacccgttcacgaagctggtccttcgttgaacgtccaggagctctgttaatgattgctttcttgattgcccaattggttgccactttaattgctgtctatgccgactggacttttgcaagagtcaaaggatgtggatggggatgggctggtgtcatctggattttcagcattgttacctacttcccacttgacataatgaaattcgccatccgttacatcttaagtggaaaggcttggaataacttgcttgacaacaagactgctttcaccacaaagaaagactatggaaaagaagaaagggaagctcaatgggcacttgctcagagaactttacatggacttcaaccaccagaagcatcaaacctgttcaacgaaaagaacagctaccgggaactgtctgaaattgctgaacaagcaaagagaagagcagagatggcaaggcttcgtgagttgcacacactcaagggtcatgttgaatcagtggtgaagctgaaaggtctggatatcgaaacgatccagcagcattatacagtttaa

SEQ ID NO: 108048 - protein, 952 aa, Lycopersicon esculentum
MAKAISLEEIKNETVDLEKIPIEEVFEQLKCSREGLTSDEGANRLQIFGPNKLEEKKESKILKFLGFMWNPLSWVMEMAAIMAIALANGDGKPPDWQDFVGIVCLLVINSTISFIEENNAGNAAAALMAGLAPKTKVLRDGRWSEQEAAILVPGDIISVKLGDIVPADARLLEGDPLKIDQSALTGESLPVTKNPGDEVFSGSTCKQGELEAVVIATGVHTFFGKAAHLVDSTNNVGHFQKVLTAIGNFCICSIAIGMLVEIIVMYPIQHRKYRDGIDNLLVLLIGGIPIAMPTVLSVTMAIGSHRLSQQGAITKRMTAIEEMAGMDVLCSDKTGTLTLNKLSVDRSLVEVFTKGVDKEYVLLLAARASRVENQDAIDACMVGMLADPKEARAGIREVHFLPFNPVDKRTALTYIDSNGNWHRASKGAPEQILDLCNCKEDVRRKVHSMIDKYAERGLRSLAVARQEVPEKSKESTGGPWQFVGLLPLFDPPRHDSAETIRRALNLGVNVKMITGDQLAIAKETGRRLGMGTNMYPSASLLGQDKDSSIASLPVEELIEKADGFAGVFPEHKYEIVKKLQERKHIVGMTGDGVNDAPALKKADIGIAVADATDAARGRSDIVLTEPGLSVIISAVLTSRAIFQRMKNYTIYAVSITIRIVFGFMLIALIWKYDFSAFMVLIIAILNDGTIMTISKDRVKPSPMPDSWKLNEIFATGVVLGGYQALMTVIFFWAMHDTSFFTDKFGVKDIRESDEEMMSALYLQVSIISQALIFVTRSRSWSFVERPGALLMIAFLIAQLVATLIAVYADWTFARVKGCGWGWAGVIWIFSIVTYFPLDIMKFAIRYILSGKAWNNLLDNKTAFTTKKDYGKEEREAQWALAQRTLHGLQPPEASNLFNEKNSYRELSEIAEQAKRRAEMARLRELHTLKGHVESVVKLKGLDIETIQQHYTV

SEQ ID NO: 108049 - DNA, 3731 bp, Electrophorus electricus
  CDS (102)..(3131)
atatctcccagtgtcatacacacacgtgttagagacagacagacagacagagagagagagaaagagcgtatctgtccttcacgtttctgccatctgagaacatggggaaagggtttggacgtggaagcagctctgatgaaaagaagaaagatttagatgagctgaagaaagaagtggctttggatgatcataaactttctctgacagacttagcaagtcgttatggggtggacctgaataaaggtctgaccactaagagagcagcagagatcctggaaagggatgggccaaacgccctgactccgcctcccaccaccccagagtgggtgaagttctgtaagcagctgtttggggggttctccatcctcctctggattggcgccatcctctgtttcttcgcctacagcatccaggtcgcaagtgaggatgaaccagtcaatgacaatttgtatctgggagtagtcctggctgctgtggttatcatcaccggctgtttttcctactaccaggagtccaaaagttcacgtatcatggactctttcaagaacatggtgcctcagcaagccatggtgatccgtgatggtgagaagaggcagatcaatgctgaggatgtggttgcaggagacctggtggagattaaaggtggagaccgaattctagcagacgtacggttcatctcctgcagtgggtgcaaggtggacaactcttccctgacgggggagtcagagcctcagtcgcgctcaccggacttcactcatgaaaaccctttggagactaaaaacatctgcttcttctccactaactgtgtggaaggaacaggccgaggtattgtcattgcgacgggcgatcgcaccgtcatgggccgcattgccacgctggcgtctgggctggaggtgggtcagacgcccatcaacatcgagatcgaacacttcatccacatcatcacggctgtggccgtcgtccttggggtcgccttcttcttcctctccctcgttctcggatacacctggctggaggccgttatcttcctcattggaatcatcgtcgccaacgtacctgaaggactgctggctacggtcacagtgtgtctcacactgacagccaaacgcatggcgcgtaagaactgtctggtgaagaacctggaggcggtggagactctggggtccacgtccaccatctgctctgacaagacgggcacgctgacccagaaccgcatgaccgtcgcacatatgtggttcgacaaccagatccaggtggcggacaccaccgaggaccaatcaggctgtggggcttttgataagacctctccctcctggaaagctctgtcacgggtggctggactctgcaatcgtgctgacttcctgcctggacaagaaagtgttcctattctcaagagagacactgcaggagatgcgtctgaatctgctctactgaagtgtattgaactatcttgtgggtccgtgcgctcactcagagagaaaaacaacaaagtagcagagatccccttcaactccaccaacaagttccagctgtccatccatgaaattgaggaatcacccacaggtcatatactagtgatgaaaggagctcctgaaaggatactggacaggtgcagttccatcatgatcagtgggcaggacattcctctgaatgatgagtggacaaacgcgtttcaaagagcctacatggagctggggggtctgggggagagagtgctgggtttttgccacctcaacctacctccctctcagttcccacgcggctttgcctttgacagtgaggacgtcaacttccccactgagcagatgtgcttcctggggctcatgtccatgatcgacccgccccgagccgccgtgcctgacgccgtgggaaagtgtcgctccgctgggataaaggtcatcatggtaacaggagatcatccaatcacagctaaggctattgctaagggcgtgggcatcatctctgagggcaacgagacagtggaagacattgcagaaagattacaggttcccctcagccaagtgaacccacgagatgccaaggcgtgtgtagtccatggttctgacctgaaggacatgacctctgagttcctggatgatctcctgagaaaccacacagagatcgtgttcgcccgcacgtccccacaacagaaactcatcatcgtagagggctgtcagagacagggtgctattgtggcggtgacaggcgatggggtgaacgactcccctgctctaaagagagcagacatcggcatcgccatggggatagcgggatcagacgtctccaaacaggcagcagacatgatcctgctggacgataacttcgcttccatagtaacaggagtagaggagggccgtttgatctttgataacctgaagaagtcgattgcctacacgctcaccagcaacatccccgagatctcgccctttctcttcttcatcatcgccagtgtgcctctgcctctgggcactgttaccatcctctgcatcgacctgggaaccgacatggttcctgcgatttctctggcttatgaatctgctgaaagtgacattatgaagcgtcagccccgaaaccccaaaactgacaaactggtcaatgagagactcattagtatcgcatacggacagatcggtatgatccaggccttggctggcttcttcacatactttgttgtcctggcggagaatggcttcctgccccgcgggcttctgggattgcgtgtggactgggacagccgtgacgtcaacgatattgaggacagctatggacagcaatggacctatgagcagaggaagatcgtggagttcacatgtcacacatccttcttcgtgagcattgtggtggtgcagtgggccgacctcatcatctgtaaaacacgcaggaactctgtcttccagcaggggatgaggaacaagattttaatcttcggcctgttcgctgagactgccctggctgccttcctgtcctactgccctggaatggatgtagctctgcgcatgtacccactcaagctgttctggtggttttgtgctttgccgtacagtttgctcatcttcgtctatgatgaggttcggaagcttattctgcgcaggtatcctggaggttgggtggaaaaagagacctactattaatcaacaaatatttaccaacaaatgtgtgtgtgtgtgtggatgtttgtggggatgagtgagacatataaacacatgtttaagggaaatctgatcagtatggaaccctagatctcaccaccatgtgtaaatgctgtatgtttacacagcatgtgtgcatttctatgtgtgtgtgtgtgtgtgtgtttattactgtatgcaccagcgttaggggttcatgggggaggtcccaggactgaggtaaacgtgactctgtttctcagttctgacacgcctgcttcctctcatgtcagcagtgtcaggagatatctcagagggcctgaacatgcttttctcctcaaagagatgtagtctgcctcggtggatatctaataccatgatacatattattagtttagatatgtatcacgtctgtatttttgtctgaaacgtttgacagtactcctaactcagtgtgctaaagttaaggacagtataattcagtgaaaggttaaattgaggtcggtatgtcggccagaatgttcttttgctgctctgtcaggaacactgtgatacaagtgtgagaataataaaaagaaacatttaaaaaaccaaaaaaaaaaa

SEQ ID NO: 108050 - protein, 1009 aa, Electrophorus electricus
MGKGFGRGSSSDEKKKDLDELKKEVALDDHKLSLTDLASRYGVDLNKGLTTKRAAEILERDGPNALTPPPTTPEWVKFCKQLFGGFSILLWIGAILCFFAYSIQVASEDEPVNDNLYLGVVLAAVVIITGCFSYYQESKSSRIMDSFKNMVPQQAMVIRDGEKRQINAEDVVAGDLVEIKGGDRILADVRFISCSGCKVDNSSLTGESEPQSRSPDFTHENPLETKNICFFSTNCVEGTGRGIVIATGDRTVMGRIATLASGLEVGQTPINIEIEHFIHIITAVAVVLGVAFFFLSLVLGYTWLEAVIFLIGIIVANVPEGLLATVTVCLTLTAKRMARKNCLVKNLEAVETLGSTSTICSDKTGTLTQNRMTVAHMWFDNQIQVADTTEDQSGCGAFDKTSPSWKALSRVAGLCNRADFLPGQESVPILKRDTAGDASESALLKCIELSCGSVRSLREKNNKVAEIPFNSTNKFQLSIHEIEESPTGHILVMKGAPERILDRCSSIMISGQDIPLNDEWTNAFQRAYMELGGLGERVLGFCHLNLPPSQFPRGFAFDSEDVNFPTEQMCFLGLMSMIDPPRAAVPDAVGKCRSAGIKVIMVTGDHPITAKAIAKGVGIISEGNETVEDIAERLQVPLSQVNPRDAKACVVHGSDLKDMTSEFLDDLLRNHTEIVFARTSPQQKLIIVEGCQRQGAIVAVTGDGVNDSPALKRADIGIAMGIAGSDVSKQAADMILLDDNFASIVTGVEEGRLIFDNLKKSIAYTLTSNIPEISPFLFFIIASVPLPLGTVTILCIDLGTDMVPAISLAYESAESDIMKRQPRNPKTDKLVNERLISIAYGQIGMIQALAGFFTYFVVLAENGFLPRGLLGLRVDWDSRDVNDIEDSYGQQWTYEQRKIVEFTCHTSFFVSIVVVQWADLIICKTRRNSVFQQGMRNKILIFGLFAETALAAFLSYCPGMDVALRMYPLKLFWWFCALPYSLLIFVYDEVRKLILRRYPGGWVEKETYY

SEQ ID NO: 108051 - DNA, 3270 bp, Vicia faba
  CDS (83)..(2938)
tcacattaactctgcatttagtttcatgattctgcaaaaaacttcacttcattaacattcgtaatttgaacggtgttccaacatgggaggtatcagtcttgaagagatcaagaatgagaacgttgatctggagcgaattccagtggaggaagtgtttgagcagctgaaatgttcgaaagaaggtttatcgtccgacgaaggagcgaatcggcttcaggtttttggtccgaacaaattggaagagaaaaaggagagcaagtttttgaagtttttagggtttatgtggaatcctttatcatgggttatggaagctgctgctattatggcgattgctttggctaatggaagtggaagacctccagattggcaggattttgttggtattatttctctgttggttattaactcaactatcagttttattgaagagaataatgctggaaatgctgctgctgctctcatggctggtttagcacccaaaacaagggttctcagagatggtcgctggtctgaagaagatactgcaattttagtccctggtgacataatcagcattaaattgggagatatcattcctgcggatgctcgtcttcttgagggtgatgctttgagtgttgatcagtcggctttaactggagaatctcttccggcaacaaagaatccctcggatgaatccttttccggatcaactgttaagaaaggtgagattgaagcagttgttattgctaccggagtgcacacatttttcggtaaagctgctcaccttgttgacaacacaaaccaagttggtcactttcagaaagttctaacagcaattggtaacttctgcatttgctcaattgctcttggaatactgattgagctcgttgtcatgtatccgattcaacaccgcaagtatagagatggaattgacaatcttttggttttattgatcggtggaattccaattgctatgcctactgttttgtctgttactatggctatcggctctcacaggctttctcaacaaggtgcaatcacaaagagaatgacggctattgaggaaatggcaggaatggatgttctctgcagtgacaaaactgggactctgaccttaaataagttgtctgttgataaaaacttgattgaggtttttgctaagaatgtagagaaggattatgttatccttcttgcagcaagggcttctaggactgagaatcaggatgcaatagatgctgcaattgttgggatgcttgctaatccaaaggaggcacgagctggtgtaagggagattcattttttcccattcaaccctgtagacaagagaactgctttaacctacattgactctgatggaaattggcatcgatcaagcaaaggtgcccctgagcagatattgaacctctgcaactgcaaagaggatgtcaggaagaaagctcattccgtaattgacaagttcgctgagcgtggactacgttctttgggtgttgctagacaggaagtacctgagaaaaataaagatagccctggtgcaccatggcaatttgttggtctgttaccgttgtttgatcctcctaggcatgacagtgctgaaaccatcacaagagctctgaaccttggtgtgaacgttaagatgattactggtgatcagcttgccattgccaaggaaactggccgaagacttgggatgggaacaaacatgtatccatcttcgtcattactcggtcaaagcaaggatgctgctgttgcagctcttccagttgatgagttgattgagaaggctgatggatttgctggagtatttcctgaacacaaatatgaaattgtaaagaggctgcaagagaggaaacatatatgtggtatgacaggtgatggtgtcaatgatgctcccgcattaaagagagcagatattggtattgctgttgctgacgctacagatgctgctagaggcgcttctgatattgtccttactgaacctggtctaagtgtcattattagtgcagtgctcaccagcagggcaattttccaaaggatgaagaactatactatctatgctgtgtcaatcaccattcgtattgtgtttggtttcatgttcatcgcgttgatctggaagtttgattttgcacccttcatggtgttgattatcgccatactaaatgatggtaccattatgacaatatccaaggatagagtgaaaccatctccactaccagacagttggaaactgaaagagatatttgcaactggtgttgtgctaggtagctacatggcactaatgacagtagtatttttctggctcatgaaggataccgacttcttctcggacaagttcggtgtgaggtctatcagaaaaaaccctgatgaaatgatggcagccctctacctacaagtcagtattataagccaggccctaatttttgtcaccaggtcccgtagctggtcctttttagaaagacctggtcttctcctattgggtgcttttatgattgctcagctggtggcaacttttatcgcagtatatgccaattggggctttgcaagaattaagggaatgggatggggttgggctggtgtaatctgggtgtacagtctagtgacatatttccctcttgatatactcaaattcgtaatccgctatgttctaagtggaaaagcttgggataatcttttggagaacaagactgctttcacaacaaagaaagactacggcaaagaagagagagaagcacagtgggcaactgctcagaggactctccatggtcttcaatcacccgaaacaaccaaccttttcaatgacaagaatagctacagggagctttctgagattgctgagcaagccaaaagacgcgctgaggttgcacggcttagggagcttcatactctaaagggtcacgtcgaatcagttgtgaagcttaagggacttgatattgacactatgcaacaacattacactgtttaagaagcttggacagccttcaagaagaacagggttatgtgctgttcaagaagcaaaaacaagaaatacagtggtgaagataaagttaatcttctgtctttagattaggttcaagggccttttgtgaaagtttgaatggttactcctataccccaggagttagaggagatactattctcttaggtactaaataacttggttgataggatttacttgcgtcttagttttggaaatgttagtgacattaaggtcacataaagctctattttttagctgaacaaaactcaatagttcgatcttgactaatgttgttcaataatgaatgaaatgcgatc

SEQ ID NO: 108052 - protein, 951 aa, Vicia faba
MGGISLEEIKNENVDLERIPVEEVFEQLKCSKEGLSSDEGANRLQVFGPNKLEEKKESKFLKFLGFMWNPLSWVMEAAAIMAIALANGSGRPPDWQDFVGIISLLVINSTISFIEENNAGNAAAALMAGLAPKTRVLRDGRWSEEDTAILVPGDIISIKLGDIIPADARLLEGDALSVDQSALTGESLPATKNPSDESFSGSTVKKGEIEAVVIATGVHTFFGKAAHLVDNTNQVGHFQKVLTAIGNFCICSIALGILIELVVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKNVEKDYVILLAARASRTENQDAIDAAIVGMLANPKEARAGVREIHFFPFNPVDKRTALTYIDSDGNWHRSSKGAPEQILNLCNCKEDVRKKAHSVIDKFAERGLRSLGVARQEVPEKNKDSPGAPWQFVGLLPLFDPPRHDSAETITRALNLGVNVKMITGDQLAIAKETGRRLGMGTNMYPSSSLLGQSKDAAVAALPVDELIEKADGFAGVFPEHKYEIVKRLQERKHICGMTGDGVNDAPALKRADIGIAVADATDAARGASDIVLTEPGLSVIISAVLTSRAIFQRMKNYTIYAVSITIRIVFGFMFIALIWKFDFAPFMVLIIAILNDGTIMTISKDRVKPSPLPDSWKLKEIFATGVVLGSYMALMTVVFFWLMKDTDFFSDKFGVRSIRKNPDEMMAALYLQVSIISQALIFVTRSRSWSFLERPGLLLLGAFMIAQLVATFIAVYANWGFARIKGMGWGWAGVIWVYSLVTYFPLDILKFVIRYVLSGKAWDNLLENKTAFTTKKDYGKEEREAQWATAQRTLHGLQSPETTNLFNDKNSYRELSEIAEQAKRRAEVARLRELHTLKGHVESVVKLKGLDIDTMQQHYTV

SEQ ID NO: 108053 - DNA, 3130 bp, Vicia faba
  CDS (75)..(2951)
aggtcacataaagttgataatagcttacatagaaacagaaacagggtggaacttgtgttgaaccagacacaaacatggctgaagaacaaaagcctgaaacgttacaagctgttcttaaagaaactgttgatttggagaatatacccattgatgaggtttttgagaatctgagatgtagtagagaagggcttactagtgaggctgctgagcagaggctaactatttttgggcataacaagcttgaagagaagagagagagtaagctgttgaagtttttgggatttatgtggaatcctctctcatgggttatggaggcagctcgtataatggcgatagctcttgcaaatggagggaacaaagctcctgattggcaagattttgtgggtattatcaccttgcttatcatcaattcaaccattagttttattgaccagaacaatgccggtaatgctgctgcagctcttatggctagtcttgccccgaaagctaaggttcttcgagatggtaggtggagtgagcaagatgctgcgatcctggttcctggtgacatcatcagtatcaaacttggagatattgttcctgcagatgctcgtcttcttgaaggagatcctttgaaaattgatcagtctgcactcacaggtgagtccctgccggtgacaaaggctcccggtgatggtgtttattctggttctacctgcaaacaaggagagattgaatgtgttgtcatagctactggtgttcatacctttttcggtaaagctgctcaccttgtggatactacaaatcaagtcggtcattttcaaaaggtcttgactgcaatcggaaacttctgcatatgttcgattgctgtggggatgcttattgagcttgttgttatgtatcccatccaacatcgtcgctatcgtcctggaattgataacctccttgtgcttctcattggaggaattccaattgccatgcccacagttttgtcagtgaccatggccattggatctcacaggctatctcagcagggggctatcacaaagaggatgacagccattgaagagatggcaggcatggatgtgctttgcagtgataagactggaactctaacattaaataagcttacggttgacaaaaatcttgttgaggtttttgcaaaaggagtggatgctgaaaccgtcgttttgatggcggctcgagcttcaagacttgagaatcaagatgcaatagatactgccatagttgggacgctcgctgatccaaaggaggcacgtgctggcatacaagaagtacattttcttccgttcaatcctaccgataagcggacagcattgacttatacggaccaagagggtaaaatgcatagagttagcaaaggtgcaccagaacagatcctaaatctggcacacaataagacagacattgaacgcagagttcatgcagtaatagataagtttgcagagcgtgggttgcggtctcttgctgttgcataccaagaagttccagagggaaggaaagagagtcctggaagcccgtggcaatttatcggactcatgccgcttttgcatccaccaagacatgatagtgccgaaacaatacggagggcattggaccttggagtaaatgtcaaaatgattacaggggatcagctagctataggaaaggaaacaggtcgacgcttgggaatgggtaccaatatgtatccttcatctgctttacttgggcagcacaaggatgaatccattgctgccttacccgttgatgatctaatagaaaaggctgatggatttgctggcgtatttcctgagcacaagtatgagattgtgaaacgcttgcaagctaggaaacatatttgcggaatgaccggtgatggagtgaatgatgcacctgctctcaagaaggcagacattggtatagctgttgcagatgctactgatgcagctcgtagtgcatctgatattgttttaactgaacctggccttagtgttattataagtgctgttttgaccagccgagctatcttccagagaatgaaaaattatacaatttatgcagtctcaattacaattcgtattgtgcttggtttcatgttgttggctctgatatggaagtttgactttccgccttttatggtgcttatcattgccatcctaaacgatggtactattatgacaatatcgaaagatagggtaaaaccatcgcctcttccagatagctggaagctatccgagatatttactactggcgttgtgcttggtaggtacttggcaatgatgacagttatattcttctgggcagcgtacaaaactgattttttcccgaaagtgtttggagttgcgactcttgaaaaatacgctcacgatgatttccgaaaactcgcctctgcaatctatcttcaagtgagcactattagtcaggcacttatatttgtaactcgatcccgaggttggtcatacgttgagcgccccggtttattgctggttgctgcatttattgtcgcccaacttattgcaacattgattgcggtttatgctagctggagttttgctgcaattgaaggaataggttggggttgggctggtgttatctggctatacaacataatattctatatcccgctcgatttcattaaatttttcactcgctatgctttgagcggaagggcttgggatcttgtcattgagcaaaggattgctttcacaaggcaaaaggactttgggaaggaacaacgtgagcttcaatgggcacatgcgcaaagaacgctgcacggattacaaccaccagacaccaagatgttcaccgagcgaactcatgtcaccgaactcaatcaaatggccgaagaagctaaaaggagagccgaaattgcaaggttgagagagcttcatacactgaagggtcatgtagaatcagttgtgagattgaagggacttgacatcgacaccattcagcaagcatatacagtttaaagatgcttaatatatatttgcatatttaaatatgtaaaggtttacatcctaatgttgctgagatgagcggattatatataatgaagtgagtgtgatgattaaactctaaagttttgataacattttatttgctgtttgttttgagcacttaagaagaggagtgcttttgtgacttcaaa

SEQ ID NO: 108054 - protein, 958 aa, Vicia faba
MAEEQKPETLQAVLKETVDLENIPIDEVFENLRCSREGLTSEAAEQRLTIFGHNKLEEKRESKLLKFLGFMWNPLSWVMEAARIMAIALANGGNKAPDWQDFVGIITLLIINSTISFIDQNNAGNAAAALMASLAPKAKVLRDGRWSEQDAAILVPGDIISIKLGDIVPADARLLEGDPLKIDQSALTGESLPVTKAPGDGVYSGSTCKQGEIECVVIATGVHTFFGKAAHLVDTTNQVGHFQKVLTAIGNFCICSIAVGMLIELVVMYPIQHRRYRPGIDNLLVLLIGGIPIAMPTVLSVTMAIGSHRLSQQGAITKRMTAIEEMAGMDVLCSDKTGTLTLNKLTVDKNLVEVFAKGVDAETVVLMAARASRLENQDAIDTAIVGTLADPKEARAGIQEVHFLPFNPTDKRTALTYTDQEGKMHRVSKGAPEQILNLAHNKTDIERRVHAVIDKFAERGLRSLAVAYQEVPEGRKESPGSPWQFIGLMPLLHPPRHDSAETIRRALDLGVNVKMITGDQLAIGKETGRRLGMGTNMYPSSALLGQHKDESIAALPVDDLIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWKFDFPPFMVLIIAILNDGTIMTISKDRVKPSPLPDSWKLSEIFTTGVVLGRYLAMMTVIFFWAAYKTDFFPKVFGVATLEKYAHDDFRKLASAIYLQVSTISQALIFVTRSRGWSYVERPGLLLVAAFIVAQLIATLIAVYASWSFAAIEGIGWGWAGVIWLYNIIFYIPLDFIKFFTRYALSGRAWDLVIEQRIAFTRQKDFGKEQRELQWAHAQRTLHGLQPPDTKMFTERTHVTELNQMAEEAKRRAEIARLRELHTLKGHVESVVRLKGLDIDTIQQAYTV

SEQ ID NO: 108055 - DNA, 3404 bp, Debaryomyces hansenii
  CDS (1)..(3231)
atgcaaaaagaagtacgtcgatcgattgagaacagtaaagatgaaccgcacattagtcaaatctatgaaaatgaaagctgtgaaaaatcgaaaactcatgtgaatgctaattcgagtgaaggtaaattagcttatagattaacagttgaacaagtagcaaataacttcgatgttgatgttgcaaagggactagaagattcccgggcgaaggccaatttagacaagtatggcagaaataacttgggtaaagaagaaaaaatttcacttacgaagatttttgcccatcaggtgttcaatgctatgattttggtgttgattatctcgatggtgatagcacttgctattaaggattggatttctggtggagttattggctttgttgtgttcattaacatttttgtcggctttatccaggaatataaggctgagaaaactatgggatctttgagatcgttaagcactccttcagccagagttcttagagatggagtagaaagtgatattaatgcagaggaagttgttcctggggatgttgtttgcatcaaagtgggagatactatcccagctgatttgcggttgatagactcgatgaaccttgaaactgatgaagctttgcttacaggtgaatcattaccagtagcaaaatgtgccgaggatgtttataccgacctgtcgattccagtaccagtaggagacaggttgaatatgtgtttcagttcatcagtcgtttcaaaaggtagaggtacaggtatcgctgtatctactgcattaaatacagagatcggtaaaattgcgaagtcattaagatctgacgaagatgctctcattgttaaggtggataagtcaaattctaatttcaaggcttatatagtcgctattgcaaaatctactaaaaatattatctgcaatgttttgggtacaaacgttggtacaccactacaaagaaggttggcttggttggcaatcattttattttgggttgccgtcttatttgcaattgttgtaatggcatcgcaagaaatgaatgttaacaggagtgttgcaatatacgctatttgtgttgcgttatctatgattccatcgtcgttaatcgttgtattaacaatcacaatggcgattggagctcaagttatggtgactaaaaatgttattgtcagaaaattagattctttagaggctttaggaggtatcaatgatatttgttcagataagacaggtacattgaccatgggtaaaatgattgctagaaaagtatggattccatctaccgggacttacgccgttactaattccaatgaacccttcaatccaaccgtcggtgatctttcctttgctgattcgtctcctaaattcattaaagaaaccgacgaagaaactgattttgcatcgaagttgcctgagccaactcccaaattatttgagaaatggctagaaactgctacattagctaatattgccactgtagatcaggttaaaggtgaaaatggtacccctgaatgggaggctaatggtgatgctactgagattgctattaatgttttcactacgagattgggactttcaagaaaacaaatggtagaaggtaatttaaagcatattgccgaatttccttttgactcttcaattaagagaatgtccgtgatttaccagaataatcagaatagttcgtttatttatactaaaggagctgttgaaagagttttagattgttgttcttactggtatggcatggatggtaaagaagatatgctgccgttaacggaagccgataaatcgattatcgaactgaacatgaatgcgctatcatctgaaggacttagagttttagcatttgcccaaaggtccatcaacattgagaaagaagatatatccaaacgtgaaagtgttgaatctaaccttatatttttgggtttgattggtatttacgatccaccaaggccagagagtgctccatcggtgaaattatgtcataaggctggaatcaacgtccatatgttgactggtgatcatcatggaactgcaagggctattgctcaagaagtcggtattttaccgagtaatttgtatcattatactgaagaagttgttaaatccatggttatgacagcaaatgattttgatgctttgagtaacgatgaaattgacaatttaccggtattgccattggtgattgcaagatgtgctcctcaaaccaaggttcgaatgatcgaggctttacatcgccgtggtaaatttgttgctatgacaggggatggggtcaatgattctccttccttgaaaaaggcagatgtcggtattgcgatgggtcttaatggttctgatgtggctaaggatgcctcagatattgttttgaccgatgacaattttgcatcaattttaaacgctattgaagaaggaagaagaatgtcatcgaatattcaaaaattcgttttgcagttgttagcagaaaatgttgcccaagcgttatacttgatgatcggcttagcgtttatggacaaggatggattttccgtttttccgttggctccagttgaagtgttgtggattattgtggtaacatcatgtttccctgctatgggattaggacaagagaaagcaaatgatgatatcttagagcagcccccaaacgcaacaattttcacttgggaagtgattattgatatgattgcttacggtttctggatggcatgctgctgtctaacttgttttgttctcatcgtctttgctgtgggtgatggtaatcttggttccaattgcaacgactctgggggcgactcgtgtaacttagtcttcagaggtagatctggagcatttgcaacgttcacatggtgtgcgttattattagcctgggaatgtattcatatgagatattcgtttttcaatatgcgtccagagctggaaatttcttcgtggaaagcaatagctatagacttatgggataatcagttcttattctggtctattattggcggctttttatcagttttcccagtcgtctacattcctgtaatcaatgacatagtctttttacatgatcctatcggttatgaatggggactcgccgttggctttacacttatattccttcttggagccgaattatggaagtggttcaagagaatttacttccgtaaatcaacgatcaaaaacccagagtacgacttagagaagaatgatccatttatgaaatattcttcattctcgaaatcgaacacaatggaggtttcttaattggtcattgtgttcaccatttgttttctttatcctttcttcaaactccctatttatattcgtagcttattagactagaattgccttcaggcattaatacaaatcttgagcttctctatgaagcatttcactttaaaaaaaaaaaaaaaaaattcctgcggccgcgattcttc

SEQ ID NO: 108056 - protein, 1076 aa, Debaryomyces hansenii
MQKEVRRSIENSKDEPHISQIYENESCEKSKTHVNANSSEGKLAYRLTVEQVANNFDVDVAKGLEDSRAKANLDKYGRNNLGKEEKISLTKIFAHQVFNAMILVLIISMVIALAIKDWISGGVIGFVVFINIFVGFIQEYKAEKTMGSLRSLSTPSARVLRDGVESDINAEEVVPGDVVCIKVGDTIPADLRLIDSMNLETDEALLTGESLPVAKCAEDVYTDLSIPVPVGDRLNMCFSSSVVSKGRGTGIAVSTALNTEIGKIAKSLRSDEDALIVKVDKSNSNFKAYIVAIAKSTKNIICNVLGTNVGTPLQRRLAWLAIILFWVAVLFAIVVMASQEMNVNRSVAIYAICVALSMIPSSLIVVLTITMAIGAQVMVTKNVIVRKLDSLEALGGINDICSDKTGTLTMGKMIARKVWIPSTGTYAVTNSNEPFNPTVGDLSFADSSPKFIKETDEETDFASKLPEPTPKLFEKWLETATLANIATVDQVKGENGTPEWEANGDATEIAINVFTTRLGLSRKQMVEGNLKHIAEFPFDSSIKRMSVIYQNNQNSSFIYTKGAVERVLDCCSYWYGMDGKEDMLPLTEADKSIIELNMNALSSEGLRVLAFAQRSINIEKEDISKRESVESNLIFLGLIGIYDPPRPESAPSVKLCHKAGINVHMLTGDHHGTARAIAQEVGILPSNLYHYTEEVVKSMVMTANDFDALSNDEIDNLPVLPLVIARCAPQTKVRMIEALHRRGKFVAMTGDGVNDSPSLKKADVGIAMGLNGSDVAKDASDIVLTDDNFASILNAIEEGRRMSSNIQKFVLQLLAENVAQALYLMIGLAFMDKDGFSVFPLAPVEVLWIIVVTSCFPAMGLGQEKANDDILEQPPNATIFTWEVIIDMIAYGFWMACCCLTCFVLIVFAVGDGNLGSNCNDSGGDSCNLVFRGRSGAFATFTWCALLLAWECIHMRYSFFNMRPELEISSWKAIAIDLWDNQFLFWSIIGGFLSVFPVVYIPVINDIVFLHDPIGYEWGLAVGFTLIFLLGAELWKWFKRIYFRKSTIKNPEYDLEKNDPFMKYSSFSKSNTMEVS

SEQ ID NO: 108057 - DNA, 3235 bp, Brachydanio rerio
  CDS (62)..(3133)
agacacttgtgtctccaaacaagtcaacaaggcaaaatttgggttgaaataaacttggaaaatggggcttggaacagggaatgatgactacaggttgacaccaacatctgaggatgaactcaaaaagactaaaaagggaaagaggaagaaggatgtggatgaactgaagaaagaagtggaactggatgaccacaagctgacactggatgaactttctcgcaaatatggcacaggcatgatcaagggtttgtcttcatttcgtgcaaaagagatcctggagcgcgatgggccgaatgcattgaccccacctcctacaactccacaatgggtgaagttctgcaaactgctcttcggtggtttccaaactctgctgtggttcggtgcattcctttgtttcttagcttatggaatccaggtggcatctgtggaagacgcggcacatgacaatctgtatctgggacttgtgcttgcgtttgtggtcatagtcaatggatggttctcattctatcaggaatccaagagttccaaaatcatggagtctttcaggaatcttgttccacagcaagctctagttgtgcgggatggagagaaaaaggtcatcaatgctgaggaggtcgttgtcggtgatcttatagaggtctgtggtggagacagaatccctgctgatctgcgcattgtctatgcacaaggatgcaaggtggacaactcttccctcactggtgaatctgagccgcagtctcgttctcctgaattctcccatgaaaaccctctagagacaaaaaacattgcatttttctctaccaactgtgttgaaggtacagccagagggattgccatcagcaccggtgaccgcacgattatgggtcgcattgcatcacttgcctccagcctggaaggtggacagacaccaatcgctcgagagatcgagcacttcatccacattatctctgctgtgtctattttcctgggtgtgaccttcttcgtcctgtccctgatccttggatatgcgtggattgaagcagttgttttccttattggaatcattgttgctaatgtgcctgaaggtctccctgctactgtaactgtgtgtctgactctcactgccaaacgaatggcaaagaagaactgcctggtgaagaatcttgaagctgtggagactcttggatcgaccaccaccatttgctctgacaaaacaggaactttgacccagaatcgcatgactgttgctcacatgtggttcgacagccagattcatgaagcagacaccacagagaaccagagtggaacctcctttgacagaagctctcctacttgggcggccctcgctcgtgttgccggcctctgcaatcgcgccgtcttccgtgctgaacaaagccatctccctgtccttaatagagagacagctggtgatgcctcagagtctgccctcctgaagtgtattgagctgtgctgcggatcagtcattgaaatgagagagaagtacagaaagatttgtgagattcctttcaactccaccaacaagtatcagctctcggtccacaagaatcccagttcctcaggtactaaacacctgctggtgatgaagggagcacctgagagaatcttggaccgatgctccaccattttaattaatggaaaagagcagcctatggacgacgaaaataaagattcttttcaaagtgcttatgtggaactcggaggtcttggagaaagagtcctgggtttctgccaatataacctgcctgatgaccagtttcctgagggttttgcatttgatcctgaggatgttaacttccccactgagaacctgtgctttcttggcctcatgtccatgattgatcctcctcgtgccgctgtaccagatgctgtagccaagtgccggagtgctggaatcaaggtgatcatggttactggtgaccatccaattacagctaaagctattgcaaaaggtgtgggcatcatctcagaaggcaatgagactgttgaagacattgccgctcgcatgaacatccctgttggagaggttaatccgagagaagctaaggcctgtgtggtccatggtggagagctgaagaatatgaatgacagtgacctggatgagatcctccgttatcatacagaaatagtgttcgccagaacgtctccgcaacaaaagctgatcattgtggaaggttgtcaaagacagggcgccattgtagccgtaaccggtgatggtgtcaatgattctccagctctgaagaaggctgacattggtgtggctatgggtatttctggatctgacgtatccaaacaggctgctgacatgatccttctggacgacaactttgcctcaattgtcactggagtagaggaaggtcgtctgatcttcgacaacttgaaaaagtccattgcctacacactgactagtaagatcccggagatgtcacccttcctcatgtttgtcgttgttggtattcctctacctttgggcaccgtcaccattctcttcattgacctgggcactgacttgattccagctatctcctacgcctatgagaatgcagaaaatgacatcatgaaacggcaacccagaaatgctcagaaggacaggcttgtgaatgagaggctaatcagtatggcatatggtcaaatcgggatgatccaagcagtagcagggttcttcacctacatcacggttatggccgagaatggatttagaccctcttatttgccaggacttcgcgttggctgggaagatagatctattggtgatctggaagacagctatggccagcaatggacctacgaaggaagaaagattatagagtctacatgccacacagcattcttcattagtattgtggttgtgcaatgggctgacttgctcattgtaaagaccaggaggaactccatcctgcagcagggaatgaaaaataaggtcctgatctttgctttctttgaggaaggtgctctggcagctttcttgtcctactgcccaggcatggacattgcagtcagaatgtatcctctaagaccactgtggtggttcactgccttaccatacgctcttatcatctttttctatgatgaaattagaaaatacatcctgcgacggaatccaggaggctttgtggaaaaagaaacgtactactgaaacaagaagaccttctactgcaaacttatgttcagagactctcaaagaaaagcgataaagaatctggtgtatttcagcaaataaattcaacactgagtttga

SEQ ID NO: 108058 - protein, 1023 aa, Brachydanio rerio
MGLGTGNDDYRLTPTSEDELKKTKKGKRKKDVDELKKEVELDDHKLTLDELSRKYGTGMIKGLSSFRAKEILERDGPNALTPPPTTPQWVKFCKLLFGGFQTLLWFGAFLCFLAYGIQVASVEDAAHDNLYLGLVLAFVVIVNGWFSFYQESKSSKIMESFRNLVPQQALVVRDGEKKVINAEEVVVGDLIEVCGGDRIPADLRIVYAQGCKVDNSSLTGESEPQSRSPEFSHENPLETKNIAFFSTNCVEGTARGIAISTGDRTIMGRIASLASSLEGGQTPIAREIEHFIHIISAVSIFLGVTFFVLSLILGYAWIEAVVFLIGIIVANVPEGLPATVTVCLTLTAKRMAKKNCLVKNLEAVETLGSTTTICSDKTGTLTQNRMTVAHMWFDSQIHEADTTENQSGTSFDRSSPTWAALARVAGLCNRAVFRAEQSHLPVLNRETAGDASESALLKCIELCCGSVIEMREKYRKICEIPFNSTNKYQLSVHKNPSSSGTKHLLVMKGAPERILDRCSTILINGKEQPMDDENKDSFQSAYVELGGLGERVLGFCQYNLPDDQFPEGFAFDPEDVNFPTENLCFLGLMSMIDPPRAAVPDAVAKCRSAGIKVIMVTGDHPITAKAIAKGVGIISEGNETVEDIAARMNIPVGEVNPREAKACVVHGGELKNMNDSDLDEILRYHTEIVFARTSPQQKLIIVEGCQRQGAIVAVTGDGVNDSPALKKADIGVAMGISGSDVSKQAADMILLDDNFASIVTGVEEGRLIFDNLKKSIAYTLTSKIPEMSPFLMFVVVGIPLPLGTVTILFIDLGTDLIPAISYAYENAENDIMKRQPRNAQKDRLVNERLISMAYGQIGMIQAVAGFFTYITVMAENGFRPSYLPGLRVGWEDRSIGDLEDSYGQQWTYEGRKIIESTCHTAFFISIVVVQWADLLIVKTRRNSILQQGMKNKVLIFAFFEEGALAAFLSYCPGMDIAVRMYPLRPLWWFTALPYALIIFFYDEIRKYILRRNPGGFVEKETYY

SEQ ID NO: 108059 - DNA, 3889 bp, Brachydanio rerio
  CDS (101)..(3154)
gagaagtggtatgttacctccaaaaaaaagccaccagtgtcttccacacgtgtgagggaagagtgggagaaatccgggcaccggctcattatcagcgaacatggggaaagggtacggacatgaaagcagcccggaggcggcaccaacggggggaaagaggaagaagaaggataaagatttagatgagctgaagaaagaggtgtcactggatgatcataagctgactctggatgagctcagtactcgttatggagttgaccttgccagaggtttgacccataagagagcgatggaaatcctggcgcgtgacggtccaaatgcgctgacccctccgcccaccaccccggagtgggtgaagttctgcaagcagctgtttggaggattctccatcctgctctggatcggtgccatcctctgctttctggcctacagtattcaggcagccacagaggacgagcctgtcaatgacaatttgtatctgggtgtggttctgtctgctgtggtcatcataaccggctgcttctcatattatcaagaagccaaaagctctcggatcatggactccttcaaaaacatggtgcctcagcaagctctggtgatccgggatggggagaagcttcagataaatgcagaggaggtggttcagggagacctggtggagatcaagggtggagatcgagtcccggctgacctgcgcatcatctcctccagtggctgcaaggttgataactcgtctcttactggagaatctgaacctcagactcgatctccagagtttactcatgaaaaccccctggagacccgaaacatcagcttcttctccaccaactgtgtggaaggtacagcccacggcatcgtgattgctacaggcgatcatacagtgatgggccgcattgcgactttggcatctggtctggaagtgggtcaaactcccatcaacatggagatcgagcacttcattcacatcatcacaggggtggccatctttctaggcatgtccttcttcatcctgtccatcattctgggctacacctggctggaggccgttatcttcctcatcggcatcattgtcgctaatgtccctgagggtctgctggctactgtcacagtctgcttgactctgacagcaaagcgtatggctcgcaaaaactgcctggtgaagaatctggaagctgtggagactttgggttccacctccaccatctgctcggataaaactgggaccctgactcagaaccggatgaccgtcgctcacatgtggtttgacaaccagattcacgaggccgacaccactgaggatcaatcaggttgtgactttgataaaagctctcccacctggttctctctgtctcgagtgggggggctttgtaatcgtgctgttttcaaagcaggacaagaggagattcctatacgcacgagggatacagcaggagacgcctcagaatctgctctgttgaagtgtgtggagatcttgtctggcaatgttgagactctcagagggaacaaccggaaagtggccgaaattccattcaattcaactaacaaataccagctgtctattcacgagttagaagacagtcctactggacacctgctggtgatgaaaggcgctccagagagaattttggacaggtgcagtactataatgatcaacggagtggaattcccaatagacgatgactggatggatgcatttcagggagcctatatggagctgggaggactgggagaaagagttctgggtttctgccacctgtttctctctccctctcagtttccaagagggtttgagtttgattgtgacgacgtgaattttccagtcaatcagctctgtttcctgggcctaatctccatggtcgatcctccccgagctgccgtgccagatgctgtgggcaaatgccgttctgcgggtattaaggtcataatggtgacgggtgaccatcctataactgccaaggccattgctaaaggtgttggcattatctctgagggcaatgaaacggtggaggatatcgctgaaagacttaatataccactgagccaagtcaatccacgagaggctaaagcctgtgtggtccacggttcagacctgaaggacatgagctccgagtatctggatgatattctgaggaaccacacggagattgtgtttgctcgcacttcacctcagcaaaagctcatcatcgtggagggctgccagagacagggtgccatagtggcagtgacaggtgacggggtgaacgactctccagctctgaagaaggctgacatcggcgttgccatgggaatcacaggctcagacgtctccaagcaagcagctgacatgatcctgctggacgacaactttgcttcaatcgttacaggagtggaagagggtcgtctgatcttcgacaacctaaagaagtcgattgcgtacacgctgaccagtaatatcccagagatcacacccttcctgctcttcatcatcgccagtgttcctctgcctctgggcaccgtcaccatcctctgcatcgaccttggcactgacatggttcctgcaatctctctggcgtacgagtcggcagagagtgacattatgaagcgtcagccccgaaaccccaaaactgacaagctggtgaatgaaaggctcatcagcatggcttacggacagatcggtatgatccaggctctgggaggtttcttcacctattttgtgataatggctgaaaatggatttctgcctcaaacgctgctgggaattcgactggattgggatgatcgtacagttaatgacctggaggacggctatggccagcaatggacgtacgagcagcgtaagatcatcgagttcacctgtcacacgtcgttcttcgtcagcattgtggtggtgcagtgggccgatctcatcatctgcaagacacgcaggaactccgtcttccagcagggcatgaagaataggattctcattttcggcctgtttgccgagacggctctagcagccttcctgtcctactgccccggtatggacgttgccctgaggatgtacccactcaagattatgtggtggttctgtgctttcccgtacagtctgcttatctttgtgtatgatgagatccgtaagtttatcctgcggagaaatccaggaggctgggtggaaatagagacctactattaacaacaatatgcaatctctgtgcatgactgccagtgtacgtgtgcgcgcgcgtgtgtgtgtgtgtgtgtgtgtgtatgcgtgcgtgcgtgtgcgtgtgtgcgtgtgcgtgtgtgcgtgtgtgtgtgtttgtgtgtgtgtgtgtttgtgtgtaaaagacatgaaggtaatgggcaaatgaaagatcagacaatcgtgtcatttatcatgtaagactgaatgtatgcgactgtgtgtgcagtgtgtaaatccaccgtgcataatctgtttacatgatgtatcctgaatatcgttatgctcaataatgtgatgatttaatagccgaatagtgttcaggatcattacatttctactgatttgatttttgctgtgagtttattacttttcgcctggttgtaagctttcatttagagttcattttctttacgttggcacttgtgtgtgaaatgtagtacactgctcatatatttcttttcaattcgtctttatgtacttcttgttttttgtttgtttttttggtggtgctagttcattaaacttttaatgtaatattgctatcataattatttgggttttgtttaaatacatctaaaaacaaaacaaaataataaaatgcaataaaaagtgtgtgaatatagcccattagtttgacttttatgttggacttggcattttctatataattctctgtgcaacatcaactgtaaagataaaaatgaaataaaaattgtaatggca

SEQ ID NO: 108060 - protein, 1017 aa, Brachydanio rerio
MGKGYGHESSPEAAPTGGKRKKKDKDLDELKKEVSLDDHKLTLDELSTRYGVDLARGLTHKRAMEILARDGPNALTPPPTTPEWVKFCKQLFGGFSILLWIGAILCFLAYSIQAATEDEPVNDNLYLGVVLSAVVIITGCFSYYQEAKSSRIMDSFKNMVPQQALVIRDGEKLQINAEEVVQGDLVEIKGGDRVPADLRIISSSGCKVDNSSLTGESEPQTRSPEFTHENPLETRNISFFSTNCVEGTAHGIVIATGDHTVMGRIATLASGLEVGQTPINMEIEHFIHIITGVAIFLGMSFFILSIILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGCDFDKSSPTWFSLSRVGGLCNRAVFKAGQEEIPIRTRDTAGDASESALLKCVEILSGNVETLRGNNRKVAEIPFNSTNKYQLSIHELEDSPTGHLLVMKGAPERILDRCSTIMINGVEFPIDDDWMDAFQGAYMELGGLGERVLGFCHLFLSPSQFPRGFEFDCDDVNFPVNQLCFLGLISMVDPPRAAVPDAVGKCRSAGIKVIMVTGDHPITAKAIAKGVGIISEGNETVEDIAERLNIPLSQVNPREAKACVVHGSDLKDMSSEYLDDILRNHTEIVFARTSPQQKLIIVEGCQRQGAIVAVTGDGVNDSPALKKADIGVAMGITGSDVSKQAADMILLDDNFASIVTGVEEGRLIFDNLKKSIAYTLTSNIPEITPFLLFIIASVPLPLGTVTILCIDLGTDMVPAISLAYESAESDIMKRQPRNPKTDKLVNERLISMAYGQIGMIQALGGFFTYFVIMAENGFLPQTLLGIRLDWDDRTVNDLEDGYGQQWTYEQRKIIEFTCHTSFFVSIVVVQWADLIICKTRRNSVFQQGMKNRILIFGLFAETALAAFLSYCPGMDVALRMYPLKIMWWFCAFPYSLLIFVYDEIRKFILRRNPGGWVEIETYY

SEQ ID NO: 108061 - DNA, 3371 bp, Prunus persica
  CDS (128)..(2992)
tgccccgaaaactcagacccggaatccgaaaccggacccgattcggcttacctcatcctcatcctcatcagcatcctagagacttttcatgctctgagctcctccgagctcaccgctactctcagccatgggcggcgacaaggccatcagcctcgaggagatcaaaaacgagtccgtcgatctggaacggattccaatagaggaagtctttgagcagctaaaatgtacaagagaaggtctaaccggagacgaaggagccaaccggcttcaagtgtttggaccaaacaaattagaagagaaaaaggagagcaaactactcaagttcttgggatttatgtggaatcctttatcctgggtcatggaagctgctgctgtgatggctatagccttggcaaatggtggtggaaggcctcctgattggcaggactttgttggaatagttgtcctgctggtcattaactctactataagtttcattgaagaaaacaatgctggaaatgcggctgcagcccttatggctggtcttgctcccaaaactaaggttcttagagatggtcgatggactgagcaagaagcttcaattttggtccctggagacataatcagtattaaattgggagatatagttcctgctgatgcccgccttctcgagggtgatcctttaaaaattgatcaatctgcgcttacgggcgagtcccttcctgttactaagaatccctcagaagaagtgttttctggctcaacatgtaagcagggtgaaattgaagcagttgtgattgccactggtgtgcacaccttctttggtaaagctgcacatctggtggacagcaccaatcaagttgggcactttcagaaagttctcactgcgattgggaacttctgcatttgttcaattgctgtggggatactaattgagcttatagttatgtacccaatacagaagcgcaagtacagggatggaattgacaatttgctggttctcttgattggaggaatcccaattgccatgccaactgttttatctgtcaccatggctattggctcccacaggctttctcagcaaggtgctattaccaaaagaatgactgccattgaggaaatggctggcatggatgtcctctgcagtgacaagactgggactctgaccctgaacaagctgtcagttgacagaaatctgattgaagtgtttgccaagggtgtggagaaagagcatgttatgcttcttgcggcaagagcttctaggactgaaaatcaggatgctattgatgctgcaattgtaggaatgcttgctgatccgaaggaggcacgagttggtatcagagaagtccatttccttccattcaaccctgtagacaagaggactgctctgacctacatcgattctgatggaaattggcatagagctagcaaaggtgcccctgagcagatattagccctgtgcaactgcaaggaagatttcaagaaaagggttcatgcagtgattgataagtttgctgaacgtggacttcgttctctagccgttgcaagacagcaagtaccagagaaaacaaaggagagtccagggacaccatggcagtttgttggtttgttgcctttatttgatcctcccaggcatgacagtgcagaaacaattcgcagagctctcaatctcggtgtgaatgtgaagatgattactggggatcagcttgccattggcaaggaaactggaaggagacttgggatgggaacaaacatgtacccatcttccgcattgcttggccaagataaggatgcatccattgcttccctccctgtggatgaattgattgagaaggctgatgggtttgctggagtatttccagaacacaaatatgaaattgtaaagaggctacaggagaggaagcacatctgtggaatgacaggagatggtgtcaatgatgctcctgctttgaaaaaagcagacatcggtattgctgtagctgacgctactgatgctgctagaggtgcttcggatattgttctcacggaaccaggtttaagtgtgatcataagtgcagtactgacaagcagggccatattccagaggatgaagaactatactatctatgctgtttctattaccatacgtatagtgtttggatttatgttcattgcattgatatggaagtttgactttgcacccttcatggtattgatcattgccatcctaaatgatggaacaatcatgacaatatccaaggaccgagtgaagccatctcctcagccagacagctggaaactgaaagaaatttttgctactggcattgttcttggaggttacatggcgctaatgacagttgtcttcttctggcttatgaaagataccaaattcttctcgaacacatttaatgtaagacatttgggcgatagacctgaacaaatgatggcagcattgtacttacaagtgagtattgttagccaagcccttatttttgtcacaaggtctcgtagctggtcttttgttgaacgtcctggacttctcttactcggagctttcatggttgctcaactggtagcaactctcatagcagtctatgccaactgggctttcgcacggatagagggatgtggctggggctgggctggtgtaatctggttattcagcgtggtgacatatttccctcttgacttacttaaattcgcaatccgctacattctaagtgggaaagcttgggataaccttttggagaacaagactgcttttactacaaagaaagactatgggaaagaggagagagaagctcagtgggctgctgctcagaggaccctacatggccttcaaccaccagaaaccaacaaccttttcagtgagaagaacagttacagggagctttcagagatcgcagaacaagccaagcggagggctgaggttgcaaggctgcgggagttgcacacactgaagggtcatgttgagtcagttgtgaagctcaaaggactcgacatcgacacaattcaacaacattatacagtttgagggagggctttcttaaaggggaacagaaggcttaagcttctaccttgaatgagaagcgaaaaatgaatgatgacgatgatgatgatgatgatgaagctctttagtaataaccttgtgtctttagattagggtaatactcctcttgctagaaaagaagtttcaactagtttacttttgatgccaatttggcaggggatgtctcttttgtagccaaaataacttaaattacagttttactatttgagtttttactcaatatcgtccgtcatgtgattggcgctatgtcttttgcgttattttactgtacatagtaggagcccctacaaagaagtaataaggatccgttattattaaaaaaaaaaaaaaaaaaaaaaaaaaa

SEQ ID NO: 108062 - protein, 954 aa, Prunus persica
MGGDKAISLEEIKNESVDLERIPIEEVFEQLKCTREGLTGDEGANRLQVFGPNKLEEKKESKLLKFLGFMWNPLSWVMEAAAVMAIALANGGGRPPDWQDFVGIVVLLVINSTISFIEENNAGNAAAALMAGLAPKTKVLRDGRWTEQEASILVPGDIISIKLGDIVPADARLLEGDPLKIDQSALTGESLPVTKNPSEEVFSGSTCKQGEIEAVVIATGVHTFFGKAAHLVDSTNQVGHFQKVLTAIGNFCICSIAVGILIELIVMYPIQKRKYRDGIDNLLVLLIGGIPIAMPTVLSVTMAIGSHRLSQQGAITKRMTAIEEMAGMDVLCSDKTGTLTLNKLSVDRNLIEVFAKGVEKEHVMLLAARASRTENQDAIDAAIVGMLADPKEARVGIREVHFLPFNPVDKRTALTYIDSDGNWHRASKGAPEQILALCNCKEDFKKRVHAVIDKFAERGLRSLAVARQQVPEKTKESPGTPWQFVGLLPLFDPPRHDSAETIRRALNLGVNVKMITGDQLAIGKETGRRLGMGTNMYPSSALLGQDKDASIASLPVDELIEKADGFAGVFPEHKYEIVKRLQERKHICGMTGDGVNDAPALKKADIGIAVADATDAARGASDIVLTEPGLSVIISAVLTSRAIFQRMKNYTIYAVSITIRIVFGFMFIALIWKFDFAPFMVLIIAILNDGTIMTISKDRVKPSPQPDSWKLKEIFATGIVLGGYMALMTVVFFWLMKDTKFFSNTFNVRHLGDRPEQMMAALYLQVSIVSQALIFVTRSRSWSFVERPGLLLLGAFMVAQLVATLIAVYANWAFARIEGCGWGWAGVIWLFSVVTYFPLDLLKFAIRYILSGKAWDNLLENKTAFTTKKDYGKEEREAQWAAAQRTLHGLQPPETNNLFSEKNSYRELSEIAEQAKRRAEVARLRELHTLKGHVESVVKLKGLDIDTIQQHYTV

SEQ ID NO: 108063 - DNA, 2898 bp, Medicago truncatula
  CDS (1)..(2898)
atggtggaggggaccatgtctcttgatgctgttataaaggaagctgttgatctggagaacattcctattgatgaggtttttgataatctcaaatgcacaaaagaaggtttaacctgtgaggaagtacaggagaggctagagttgtttggatacaataaacttgaagaaaagaaggaaagtaaaatactaaagtttttagggtttatgtggaatcctttgtcatgggttatggaagctgctgctatcatggccattgctatggcacatggaggccgtaacatggatggaacgaagaaacaaggagattatcaagattttgttggcataattattttgctaattataaactctaccataagtttcatagaagaaaataatgctggtaatgcagcagctgcccttatggcaagattggctccaaaagcaaaggtacttcgtgacggaaaatggagcgaggaagatgcttcagtgttggtccctggagacatagtcagtatcaaactaggtgacattattcctgcagatgcacgtctcctcgaaggcgaccctttgaagattgatcagtctgctcttactggagagtcacttcctgtgacaaaacatcctggagaaggaatatattctggttcaacttgcaagcaaggagaaattgaggccatagtcattgcaactggagttcacacatttttcgggaaagcagctcatcttgtcgaaaacacaacacatgttggacatttccagaaggttctaacatctattgggaatttctgcatctgttcgattgctattggaatggttattgaaatcatcgtgatatacggcgtccacgggaagggatacagaaacggtattgataacctccttgttctgctaattggtggaatccctattgcaatgccaactgttctttcagttacaatggccattggttcacataagttgtctcagcagggtgctataacaaagagaatgactgctattgaagaaatggctggaatggatgtgttatgtagtgacaaaacaggcacattaactcttaacaagcttacagtcgacaaggatatgattgaggtttttgccaaaggagttgacaaggatttggttgtactaatggctgcaagagcatcaaggttggagaaccaagatgcaattgactgtgcaattgtttcaatgttggcagacccaaaggaggcacgaactggaattaaagaagttcatttccttccattcaatccaactgataaaagaactgcacttacatacattgatgctgccggtaatatgcacagggttagcaaaggtgcaccagagcagattctcaatcttgcacgtaacaaagcagaaattgcacaaaaggttcattcaatgattgacaagtttgcagaacgtggacttcgttctcttggggttgctagacaggaagtacctgagggaagtaaggatagtccaggaggaccatgggagtttgttgcccttctccctctttttgaccctcctcgccatgatagcgcagaaacaatcagaagagctcttgatcttggcgttagtgtcaaaatgatcaccggtgatcaacttgcaataggaaaggaaacgggaaggcgtctaggaatggggactaacatgtatccttcttcatcactgcttggtgataataaagatcaattaggtgctgtttccattgatgatctcattgagaatgctgacggttttgctggtgtctttcctgagcacaagtatgagattgtgaagaggttacaggctagaaagcacatttgtggcatgactggtgatggagtgaatgatgcacctgccttaaagatagctgacataggtattgcagtagcagattctacagacgctgcaagaagcgcttctgacatagtgctgacagaacctggtttgagtgtcatcataagtgcagttttaaccagtcgagcaattttccagaggatgaaaaactacacaatatatgctgtatctatcactattcgtattgtgttgggcttcatgttacttaacagcttttggagttttgactctccaccctttatggttcttatcattgccattctcaatgatggtaccattatgacaatatccaaagatagggttaagccttcaccacttcctgatagttggaagcttagtgaaatttttgctactggggttattcttggtacctatctggctataatgacagtcatcttcttctggatagttatggaaacaaacttctttcctaattttggtgtgcaccgcttccgccctgatctaaaggctcctgtcactagtgaaatgacagagaagttggcttctgctgtctatcttcaagtcagtacaattagtcaagccttaatctttgtgacacggtctaggggttggtcttatacagaaagacctggtcttttgcttgtttttgcctttgctatagctcagctggttgcaactgttatatcagcacaagccacttggaaaattgctggaatcagaggcataggttggggctgggcaggagtcatttggttgttcaatattgtaacttatgtttttcttgatcctttaaagtttgttgttgcttatcaacaaagcggaagggcgtggaatctggtggtaaaccaaaggactgcattcaccaacaaaaatgactttggaaaagaagctcgtgaggctgcatgggctgctgaacagagaaccttgcatggtcttcgctctgctgagataaaagggtttgcagagaagcacaaccatagagaaattaatacaatggcagacgaggctaagagacgagcagagttagcaaggttgagagagcttcacactctgaaaggaagagtggaatcatttgccaagctacggggtttggacattgataccatgaatggacactacactgtctaa

SEQ ID NO: 108064 - protein, 965 aa, Medicago truncatula
MVEGTMSLDAVIKEAVDLENIPIDEVFDNLKCTKEGLTCEEVQERLELFGYNKLEEKKESKILKFLGFMWNPLSWVMEAAAIMAIAMAHGGRNMDGTKKQGDYQDFVGIIILLIINSTISFIEENNAGNAAAALMARLAPKAKVLRDGKWSEEDASVLVPGDIVSIKLGDIIPADARLLEGDPLKIDQSALTGESLPVTKHPGEGIYSGSTCKQGEIEAIVIATGVHTFFGKAAHLVENTTHVGHFQKVLTSIGNFCICSIAIGMVIEIIVIYGVHGKGYRNGIDNLLVLLIGGIPIAMPTVLSVTMAIGSHKLSQQGAITKRMTAIEEMAGMDVLCSDKTGTLTLNKLTVDKDMIEVFAKGVDKDLVVLMAARASRLENQDAIDCAIVSMLADPKEARTGIKEVHFLPFNPTDKRTALTYIDAAGNMHRVSKGAPEQILNLARNKAEIAQKVHSMIDKFAERGLRSLGVARQEVPEGSKDSPGGPWEFVALLPLFDPPRHDSAETIRRALDLGVSVKMITGDQLAIGKETGRRLGMGTNMYPSSSLLGDNKDQLGAVSIDDLIENADGFAGVFPEHKYEIVKRLQARKHICGMTGDGVNDAPALKIADIGIAVADSTDAARSASDIVLTEPGLSVIISAVLTSRAIFQRMKNYTIYAVSITIRIVLGFMLLNSFWSFDSPPFMVLIIAILNDGTIMTISKDRVKPSPLPDSWKLSEIFATGVILGTYLAIMTVIFFWIVMETNFFPNFGVHRFRPDLKAPVTSEMTEKLASAVYLQVSTISQALIFVTRSRGWSYTERPGLLLVFAFAIAQLVATVISAQATWKIAGIRGIGWGWAGVIWLFNIVTYVFLDPLKFVVAYQQSGRAWNLVVNQRTAFTNKNDFGKEAREAAWAAEQRTLHGLRSAEIKGFAEKHNHREINTMADEAKRRAELARLRELHTLKGRVESFAKLRGLDIDTMNGHYTV

SEQ ID NO: 108065 - DNA, 3404 bp, Oryctolagus cuniculus
  CDS (28)..(3099)
cggcgccgggctccgagtaccgccaccatggggaagggggttggacgcgataaatatgaacctgcagccgtctccgaacatggcgacaaaaagggcaaaaaggccaagaaggagagggacatggatgaactgaagaaagaagtttctatggatgaccacaaactaagccttgatgagctgcatcggaaatacgggacagacctgagccgaggcttgacaactgctcgagctgctgagatcctggcccgagacggccccaacgccctcactccccctcccaccactcctgaatgggtcaagttctgtcggcagctgttcgggggcttctccatgctgctgtggatcggagcgattctctgcttcctggcttacggcatcctagctgctacagaagaggattttgacaatgataatctgtaccttggcgtggtgctggccgcggtcgtgatcatcactggctgcttctcctactatcaggaagcgaaaagctcaaagatcatggagtccttcaaaaacatggtccctcagcaagccctggtgattcgaaatggtgagaagatgagcataaatgcggaggatgtggtggtcggggacctggtggaagtgaaggggggagaccgcatccctgctgacctcagaatcatatcggcgaacggctgcaaggtggataactcctcactcactggtgaatcagaaccccagaccaggtctccggattttacaaatgaaaacccgctggagacgaggaacatcgccttcttttccaccaactgcgttgaaggcactgcacgtggcatcgttatatacactggggaccgcacagtgatgggaagaatcgccacgcttgcttctgggctagaagggggccagacacccattgctgctgaaattgaacattttatccacattatcacgggtgtggctgtgttcctgggtgtgtctttcttcatcctttctctgatccttgaatatacctggcttgaagctgtcatcttcctcattggcatcatcgtagccaacgtgccagaaggtctgctggccactgtcacggtgtgtctgacacttactgcaaaacgcatggcaaggaaaaattgcttggtgaagaacttggaagccgtggagaccttggggtccacatccaccatctgctcagataaaactggaactctgactcagaaccggatgacagtggcccacatgtggtttgacaatcagatccacgaagctgacacgacagagaaccagagtggtgtctcattcgacaaaacgtcagccacctggctcgccttgtccagaatcgcaggcctctgtaacagggcggtatttcaggccaaccaggaaaacctgcctattcttaagcgggctgttgcaggggacgcctccgagtcggcactcctgaaatgcatcgagctgtgctgcggttccgtgaaggagatgagggagagatacaccaaaatcgtcgagatacccttcaactccaccaacaagtaccagctgtccattcataagaacctcaacgccaatgagccacggcacctgctagtgatgaagggcgctccagaaaggatcctggaccggtgcagctctatcctcttgcacggcaaggagcagcccctggacgaggagctgaaggacgcctttcagaacgcctacctggagctggggggcctcggcgagcgagtgctagggttctgccaccttcttctgccagacgaacagttccctgaaggattccagtttgacaccgatgaagtgaacttccctgtcgataacctctgctttatcgggctcatctccatgatcgaccctccacgggcggccgtccccgatgccgtgggcaagtgccgcagtgctggaattaaggtcatcatggtcacgggagaccatcccatcacagccaaagccatcgccaaaggtgtgggcatcatctctgaaggcaatgagaccgtagaagacattgctgcccgcctcaacatcccagtgagccaggtgaaccccagagatgccaaggcctgcgtcgtgcacggcagtgacctgaaggacatgacttccgagcagctggatgacatcctgaagtaccacacggagatcgtgttcgccaggacctccccgcagcagaagctcatcatcgtggaaggctgccagcggcagggcgctatcgtggctgtcaccggcgacggtgtcaatgactctcctgctctgaagaaggcagacatcggcgtggccatgggcatcgcgggctccgacgtgtccaagcaagcagcggacatgatcctcctggatgataacttcgcttccattgtgactggcgtggaggaaggtcgtctgatctttgataacttgaagaaatccatcgcctacaccctgaccagtaacattccagagatcacccccttcctgatatttatcattgcaaacattccactgccactggggaccgtcaccatcttgtgcattgacctgggcactgacatggttcctgccatctccctggcttatgagcaagctgagagcgacatcatgaagaggcagcccagaaatcccaaaacggacaagctggtgaacgagcggctgatcagcatggcctacggacagattggtatgatccaggccctcgggggcttcttcacgtacttcgtgattctggccgagaacggtttcctccccttccacctgctgggcatccgagtggactgggatgaccgctggatcaacgacgtggaagacagctacgggcagcagtggacctacgagcagaggaagatcgtggagttcacctgccacacggccttcttcgtcagcatcgtggtggtgcagtgggctgacctggtcatctgcaagaccaggaggaattccgtcttccagcagggcatgaagaacaagatcttgatatttggcctctttgaagagacagccctggctgccttcctctcctactgccctggaatgggtgttgcccttaggatgtatcccctcaagcctacctggtggttctgtgccttcccctactctctcctcatcttcgtgtatgatgagatcaggaagctcatcatcaggcggcgccctggaggctgggtggagaaggaaacctactactagtgcccccatcccgcaccctctgcatccgtcccccgccccctttgtgtactccagccttgggattcggaactccgcccgggtaggaaagcaccggagcatgtggggagacgtcctggaatgaagcatgtcgctctggggggaggggggagggctgcctgacaaacaccgtgtagggaatgacgacagcgtggaaggtttttatgtgcctttttgtttttgtaaaaaaggagaacctggagagactgagagaatacattttatatctggatttttacaaataaagatggctattataacggaaaaaa

SEQ ID NO: 108066 - protein, 1023 aa, Oryctolagus cuniculus
MGKGVGRDKYEPAAVSEHGDKKGKKAKKERDMDELKKEVSMDDHKLSLDELHRKYGTDLSRGLTTARAAEILARDGPNALTPPPTTPEWVKFCRQLFGGFSMLLWIGAILCFLAYGILAATEEDFDNDNLYLGVVLAAVVIITGCFSYYQEAKSSKIMESFKNMVPQQALVIRNGEKMSINAEDVVVGDLVEVKGGDRIPADLRIISANGCKVDNSSLTGESEPQTRSPDFTNENPLETRNIAFFSTNCVEGTARGIVIYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYTKIVEIPFNSTNKYQLSIHKNLNANEPRHLLVMKGAPERILDRCSSILLHGKEQPLDEELKDAFQNAYLELGGLGERVLGFCHLLLPDEQFPEGFQFDTDEVNFPVDNLCFIGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPFHLLGIRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEIRKLIIRRRPGGWVEKETYY

SEQ ID NO: 108067 - DNA, 2754 bp, Candida albicans
  CDS (1)..(2754): transl_table=12
atgagtgctaatccatatgatatagagcataagttaccaccacaacgtgcaaacaccccatcactcaagtactctcaaaaatcaattgaagaaactgcagcagacttacaaaccgacatcaaattgggtttaaccaatagtcaggacgtgttaaatagacgatccattcatggaatcaacgaattaaatggagatgaagaggagagcctattgtggaaattcatttcatcattctaccaagatcctttgattttgcttttgattggttctgctgtgattagtttttggatgggcaataaggatgacgccatatcgatcacattagccatcactatagttgtaactgttggatttgttcaagaatatagatccgaaaagtctttggaagcattaaataagttagtccctgcagaggctaagttaacaagaactggaagcacatccagtgtgttggcccaggttttagttccaggtgatttggtccatttctcacaaggtgacagaatccccgcagacattagattgacagaggcggttcatttaaccattgatgaaagtaatttaactggtgaaaacaggcccgtgaaaaagaccgtagacacggttaactcttctgatccagcagttacagaaagaactgacattgcattcatgggtacattggtcagagacggacatggtagtggtattgttgttgcaacagcaggtcaaaccgtgtttgggtcagtgtttgaaatgatgagcgacattgaaaagcccaaaaccccattgcaacaagcaatggataaattggggaaggacttgtcgattttcagttttattgttattggtataatttgtctcattgggatattccaaggccgttcgtggctagacatgtttcaaatttctgtgtctttggcggttgctgctattcctgaagggttacctattattgttaccgttaccttagcattgggtgtgttacgtatggccagacaaaaggcaattgttagacgtttaccaagtgttgaaacattgggatctgtcaatgttatttgctcagacaaaaccggtacattaacccaaaatcacatgacagtcaccaaaatatggacagccgacttcaaaggaagcttcaacaccccctttttggcagtagaaagacttgatgacaatactttgcatcatcaacttacatccaatatgcacaaagttttagagtgtggtaatatttgtaacaacgccagatattctacagagagtgagaaatacgttgggaacccaagtgatattgcccttgttgaatgcttgccccattttggtttggaagatatgagaggacagaaacaaagactttatgaattaccactttcttcaaatagaaaatacatggcagtttgtgtgcatactggcgacattgaaaaatccgaaaccattgccaaaggtgccaccgagaaaatattgcaactttgtgatcgttactatgacgaaaatggatccgtgaaaccattgacagaagctattgaggagtccattcacgaaaagtctcgttcgttggcaagagatgggttgagagtgttagcgtttgctaaaaacaataagaaatttgacgaaaagacaacagaacccacagatttggtgttttgcggtttaattggtatgaaagatccaccaagaccaaaagtgggacaatcgatcgcaaggttaatgcaaggtggtgtgcatgttattatgattactggagactcccctacaactgcagtaaatattgccagacaaatcggtatccctgtggttggagaccatgctgtattgacaggtgaccaaattgatagtttgagtgaagaagcccttaccaaagctattcacgatgtttcggtgtttgcgagaaccactccggagcacaaagtcactattgtgaaagctttgcaaagaagaggcgatatcgttgctatgactggggatggtgtgaatgacgcaccagctttgaaattggctgacattggtatagcaatgggtaaaaatggtacagatgttgctaaagaagctgcagatatggttttgacagatgacgacttttctacaatccttagtgctattgaagaaggtaaaggtattttcaacaacatacagaatttcattactttccaattgagtaccagtattgctgcattgactttggttgccttatctacttttttcggtttgcctaaccccttgaatgctatgcaaatcttgtggattaatatcttgatggatggtcctccagcccagtctcttggtgtcgagccagttgatcacgaagttatgaataaacctccaagaaaacgtaacgatgtgattcttacccaacaggttatcaaaagagttttgcaatctgctgccattatcattgttggcaccatgtatgtgttcattaaagagatgactgacggtgtgattactgctagagacacgaccatgacctttacgtgttttgtgttgtttgatatgtttaatgccttgtcgtgccgtcatcattccaagctgattttcgaattgggaatgactaatcaaatgtttaattttgctgtccttggatcattgataggccaattttgtgccgtttatgtgccttttttccaaagcattttccaaacagaggctctaaactttggagatattttgcgtttggttattttgacaagtactgtatttgctgtggatgaaattagaaagtggttacgtagaaggaaaactgtgtataccaataactatagttatggtgtatag

SEQ ID NO: 108068 - protein, 917 aa, Candida albicans
MSANPYDIEHKLPPQRANTPSLKYSQKSIEETAADLQTDIKLGLTNSQDVLNRRSIHGINELNGDEEESLLWKFISSFYQDPLILLLIGSAVISFWMGNKDDAISITLAITIVVTVGFVQEYRSEKSLEALNKLVPAEAKLTRTGSTSSVLAQVLVPGDLVHFSQGDRIPADIRLTEAVHLTIDESNLTGENRPVKKTVDTVNSSDPAVTERTDIAFMGTLVRDGHGSGIVVATAGQTVFGSVFEMMSDIEKPKTPLQQAMDKLGKDLSIFSFIVIGIICLIGIFQGRSWLDMFQISVSLAVAAIPEGLPIIVTVTLALGVLRMARQKAIVRRLPSVETLGSVNVICSDKTGTLTQNHMTVTKIWTADFKGSFNTPFLAVERLDDNTLHHQLTSNMHKVLECGNICNNARYSTESEKYVGNPSDIALVECLPHFGLEDMRGQKQRLYELPLSSNRKYMAVCVHTGDIEKSETIAKGATEKILQLCDRYYDENGSVKPLTEAIEESIHEKSRSLARDGLRVLAFAKNNKKFDEKTTEPTDLVFCGLIGMKDPPRPKVGQSIARLMQGGVHVIMITGDSPTTAVNIARQIGIPVVGDHAVLTGDQIDSLSEEALTKAIHDVSVFARTTPEHKVTIVKALQRRGDIVAMTGDGVNDAPALKLADIGIAMGKNGTDVAKEAADMVLTDDDFSTILSAIEEGKGIFNNIQNFITFQLSTSIAALTLVALSTFFGLPNPLNAMQILWINILMDGPPAQSLGVEPVDHEVMNKPPRKRNDVILTQQVIKRVLQSAAIIIVGTMYVFIKEMTDGVITARDTTMTFTCFVLFDMFNALSCRHHSKSIFELGMTNQMFNFAVLGSLIGQFCAVYVPFFQSIFQTEALNFGDILRLVILTSTVFAVDEIRKWLRRRKTVYTNNYSYGV

SEQ ID NO: 108069 - DNA, 3171 bp, Aspergillus niger
  CDS (1)..(3171)
atgtcaaggtccgcaacgcccgcgctccctttccataatgcccagatccccgattcgagaccgaggtcgacaaccccggcggacgtgcgctccagtccttccccttctacgtctacctcgacatattcgctcttagatccgcaagagaccgcggagcgcttacagacctccctcgtccatggccttaatcccgccgaggccgaggtgcgcctggcacaagagggacccaacgaactcccgcacgaagaaccagagcccatctggctccgctttctcaagcagtttaaggagaccttgatcctcctccttttggcctccgctgcgatctcctttttcatgggaaactatgacgatgcagtcagcattaccctcgccgtcacaatcgtggtcaccgtcggattcgttcaggaatatcggtcggaaaagtctctggaggcactgagtcgtctggtgccgcaccatgcgcatctaattcgcgatgttcctttgaatggccctccagtggccggcaccattcccccggctcctggtgcggagatggagttgcaggagctgcgaagcaagagcccatccatttccaccgccgtcaaggcctcgactaccgtgcccgccacggaactcgtgccaggcgacttggtcctcttcaccgtcggagaccgcattccggcagacataaggatcactgccgccacggatctctccatcgatgagtccaacttgacaggcgaaaacgaaccggttgtcaagtaccccgatgccattcgcagccccaagcaccttccgtcgcactcccctaagattgtgagcccgcctcgatcgccattttacgatgccccggccagtggcgccgtgggagccgacatccgcttgaatgaacaacacaacatcgcttttatgggtacgctggttcggtcgggatacggacagggaattgtgatcggaacaggtgcgaagacggagtttgggagcatttccgcctccctccaggaaattgaaagcccgcggacgcctctccagctgtcaatggaccgtttgggccaggaattgagttacatctcgttcggtgtcatcggactgatcgttctcattggtttgatccagggtcgcaagctcctcgagatgttcaccatcggtgtttcgctcgcggtggctgcgattccggaaggtctccctatcattgtcaccgtgacgctggctttgggagtgctgcgcatggccaagcgaggagctatcatgcgacggctgccgagtgtcgagacgctaggctctgtaaacgtcgtttgcagtgacaagaccggtactctgactctgaaccacatgacggttaccaaaatgtggcactttgactgccccgagccttttgaggtccataatgatatttcctccttgacgcccgggcctgcagcgcggaccgttctgcgaatcggcaacattgccaacaatgccagactatctcgcgtgcatgctaactctccagctagcgcctcctctgccgcggtcttgtcctccacggacgacagggcttctggaagtatccgtagcagatgggttggccagcctactgacgtggctattctggatttgctggatacattcggcgaggacgatgtgcgtgagcgtatcagcgcccgtgtcgcggaaactccattcagttctgagcgcaaatggatgggtgtaatcattggcaacggcacctccggtgacaatgtggcctatatcaagggagccctcgagcaggtattgacccggtgcgatacttacttgaccaaggatggccgtgaggttatcctggatgaaccacggcgccagtcgataaggcacgcagccgaacatatggcggcagagggcttgcgggtcttggctttcgccagtggagcagttagggacacttcgagaggaagagcgtttggcagcagatcgggtacgcccgtgtcaaagtccagcagccagagtgatgacgatgaccggtacaatggactagtctttgcgggcttggtgggcatgaacgaccctccgcgcaaggatgtccacaagtccatccggcgtctcatggctggaggagtgcgggtcatcatgatcacgggagatgcggagacgaccgctgtggccatcgcgaagaaactaggaatgccggtcagtgacgctcccggatcacggcctgtcatgaatgggcatgagatcgatcggatgagcacccaggagctcgcgcaagccatatcctcgacctcggtctttgcgcgcaccagtccggaccataaaatgaagattgtgcgtgccttgcaatcccgtggcgatgtagtggctatgaccggcgatggcgtgaacgacgccccggcactcaagaaggcggacattggtatctcgatgggcaagctgggcacagatgtcgccaaggaggccgcggatatgattttgacagacgacgacttctcgaccatcttgcgtgccattgagcagggcaagggcatcttctacaacatccagaatttcattacctttcagctcagtaccagtgttgctgcactgagtctcgtattgctgagcaccaccttgggcttcaagaacccgttgaacgccatgcaaatcctatggatcaatatcctcatggatggcccccctgcgcagtcgctaggagtggaacctgttgatccgtccatcatgaaccggccaccccgaccccggaatgcccgcgttctcacaaggccgctcgttcagcgggtgctcacctccgcgatgatgatcatgctcggcactctggccatctacatccacgaaatgggcgacgccgacgacaccgccaaccccggcgtgcactcccgcgtggtgaccgcccacgacaccacgatgacctttacatgcttcgtgctgttcgacatgttcaacgcattgacgtgccgcagcgagggcaagtcggtgctccgtggcgagatctctctctttggaaacaagatgttcaactacgccgttctgggctcgctcgcgggacaggcgtgtgtgatttaccttcccttcttgcagcgcatcttccagacggagcccctgggctttggacatttgttccggctggtgtgtatttcgagtaccgtattttgggttgatgaggcccgcaagtattatatggcgttgaaacgacggggcacggtgggggtaggatacagtgtcaatgtttaa

SEQ ID NO: 108070 - protein, 1056 aa, Aspergillus niger
MSRSATPALPFHNAQIPDSRPRSTTPADVRSSPSPSTSTSTYSLLDPQETAERLQTSLVHGLNPAEAEVRLAQEGPNELPHEEPEPIWLRFLKQFKETLILLLLASAAISFFMGNYDDAVSITLAVTIVVTVGFVQEYRSEKSLEALSRLVPHHAHLIRDVPLNGPPVAGTIPPAPGAEMELQELRSKSPSISTAVKASTTVPATELVPGDLVLFTVGDRIPADIRITAATDLSIDESNLTGENEPVVKYPDAIRSPKHLPSHSPKIVSPPRSPFYDAPASGAVGADIRLNEQHNIAFMGTLVRSGYGQGIVIGTGAKTEFGSISASLQEIESPRTPLQLSMDRLGQELSYISFGVIGLIVLIGLIQGRKLLEMFTIGVSLAVAAIPEGLPIIVTVTLALGVLRMAKRGAIMRRLPSVETLGSVNVVCSDKTGTLTLNHMTVTKMWHFDCPEPFEVHNDISSLTPGPAARTVLRIGNIANNARLSRVHANSPASASSAAVLSSTDDRASGSIRSRWVGQPTDVAILDLLDTFGEDDVRERISARVAETPFSSERKWMGVIIGNGTSGDNVAYIKGALEQVLTRCDTYLTKDGREVILDEPRRQSIRHAAEHMAAEGLRVLAFASGAVRDTSRGRAFGSRSGTPVSKSSSQSDDDDRYNGLVFAGLVGMNDPPRKDVHKSIRRLMAGGVRVIMITGDAETTAVAIAKKLGMPVSDAPGSRPVMNGHEIDRMSTQELAQAISSTSVFARTSPDHKMKIVRALQSRGDVVAMTGDGVNDAPALKKADIGISMGKLGTDVAKEAADMILTDDDFSTILRAIEQGKGIFYNIQNFITFQLSTSVAALSLVLLSTTLGFKNPLNAMQILWINILMDGPPAQSLGVEPVDPSIMNRPPRPRNARVLTRPLVQRVLTSAMMIMLGTLAIYIHEMGDADDTANPGVHSRVVTAHDTTMTFTCFVLFDMFNALTCRSEGKSVLRGEISLFGNKMFNYAVLGSLAGQACVIYLPFLQRIFQTEPLGFGHLFRLVCISSTVFWVDEARKYYMALKRRGTVGVGYSVNV

SEQ ID NO: 108071 - DNA, 3398 bp, Vicia faba
  CDS (112)..(2970)
ttgctctcatattacacaattctcactttctcttcccaattctcttcctcatgaaccctttccctctttctctccactgattcttccctatttccaccaatcttcttcctcatggccaccaacaaatccatcaccctcgaagaaatcaagaacgagaccgttgatctggaacatattcctgttgaggaagtgtttgagcaattgaaatgtacgaaagaaggtttgtccttggaggaaggagccaatcggcttcaaatatttggaccaaacaagctagaggagaaaaaggaaagcaagcttctcaagtttcttgggttcatgtggaatcctctgtcatgggtcatggaagctgctgctttgatggcaattggtcttgcgaatggtgacggaaagcctccggattggcaagattttgtcggtattgtttgcttgttggtgatcaactccaccatcagtttcattgaagaaaacaatgccggtaatgctgctgcagcccttatggctggtcttgctcctgagacaaaggttcttagggatggtaaatggtctgagcaggaagctgcaattttagtccctggagacatcattagcatcaaactaggtgatattgttccagctgatgctcgtcttcttgaaggtgaccctttaaagattgatcagtctgctttgactggagaatcacttcctgtgactagaagtcctgggcaagaagttttctctggctcaacttgtaagcaaggagaaattgaagctgttgtcattgcaactggtgtccacacatttttcgggaaagcagctcaccttgtcgacagtaccaaccaagttggacatttccagaaggtgcttaccgcaattggaaacttctgtatttgttccattgcagttggtatgttggctgagatcatagtcatgtacccaattcagcaccgcaagtacagagacggaattgacaaccttttggtccttttgatcggaggaattcctattgctatgtccactgtgttgtctgtaacaacggctattggttcacacaggctctctcagcaaggtgctattaccaagcgaatgactgctattgaagaaatggctggtatggatgtgctttgcagtgacaagactggtacacttacacttaacaagttgagtgttgacaagaacttgattgaggtctttgaaaagggtgtggacaaggaacatgtgatgcttcttgctgcaagggcttccaggattgaaaatcaggacgcaatagatgccgccattgttggaactctagcagatccaaaagaggcaagggctggagtaagagaggttcatttcttaccattcaacccagttgacaaaagaactgccttgacttacatcgatagcaatggaaattggcaccgtgcaagcaaaggtgctccggagcagatcatgaatctgtgtaaccttagggaagatgcaaagaggaacatccatgctattattgacaagtttgcagagagaggtcttcgttctcttgctgtttctagacaggaggttcctgagaaaactaaagaaagtgctggtggtccttggcagtttgttggtttgttgtcactgtttgacccacctaggcatgacagtgctgaaactattcgaagagctcttcatcttggtgtcaatgttaagatgattactggtgatcaactggccatagcaaaggagaccgggaggagacttgggatgggaactaatatgtacccttctgctacattgcttggtcaagacaaagatgcaagtattgctgctcttccagttgaagagctgattgagaaggcagatggatttgctggggtatttccagagcacaaatatgaaattgtaaagaagttgcaagaaagaaaacacatctgcggaatgactggagatggtgtcaacgatgctccggctttgaagaaggctgatattggaatcgctgttgcggatgctacggatgccgcaagaggagcttctgatattgtattgacagaacctggattgagtgtcatcatcagtgcagtcttaactagtagggcgattttccaaaggatgaaaaactacacgatctatgcagtatctatcactatccgtatagtgtttggattcatgttcattgcactgatctggaaatttgacttctcacctttcatggtcttgattattgccattcttaatgatggaacaatcatgacaatttcaaaagatagagtggttccatctcccttacccgatagctggaaactgaatgaaatatttgctactgggattgttcttggaggttatttagctctgatgactgtaatattcttctgggcaattaaagaaactcatttcttccctgacaaatttggagttaggcacctgattcatgatgaaatgatgtctgctttgtatcttcaagtcagtatagttagccaggctttgatatttgtgactcgttctcgtggttggtcgtttcttgaacgccctggagccctattagtcattgctttcctcattgctcagctgattgcgacattaatagcagtatatgccaactggggatttgcaaaggtacaaggaattggttggggctgggcaggagttatctggctctacagtattgttttctatattccactcgacgtgatgaagtttgccatccgctacatattgagtggcaaggcatggaacaatctcctagacaacaagactgccttcaccaccaagaaagattacggaaaagaggagagagaagctcaatgggcacatgctcagaggactctacatggacttcaaccaccagagagttctggtattttcaacgagaagagcagttacagagaactctctgagattgctgagcaggccaaaagaagagctgaagttgcaaggcttcgtgagctgcacacactcaaaggacatgtcgagtcagtagtgaagctaaaaggtttggacatcgataccatccagcagcactacactgtgtgagaatctatctaaaattgtagataccagattggccaaagttgaacattgtaatatgtgaatgaaagcaataaaagtcaaagaggaggcctaactactttagtgcttaccaggaatggagagaggagagtgtgaaccttttgatatttagcctagttttttcctgtgtacttttaagttctgcctaaatggatcgtctttgccttctatttgcttccatgataagagcaaaaactagtttcaatttcgtttcccttaagtaaattagtttcagtttcagtccttgactttctcatgtttttttgttatcatatatggtttttggtgtttcctcattttaattgtatgccacatggcagtcatcatataatgttgatattgggatttttttttaaggtgggtgaataaagtggttttgtatggtttttgtg

SEQ ID NO: 108072 - protein, 952 aa, Vicia faba
MATNKSITLEEIKNETVDLEHIPVEEVFEQLKCTKEGLSLEEGANRLQIFGPNKLEEKKESKLLKFLGFMWNPLSWVMEAAALMAIGLANGDGKPPDWQDFVGIVCLLVINSTISFIEENNAGNAAAALMAGLAPETKVLRDGKWSEQEAAILVPGDIISIKLGDIVPADARLLEGDPLKIDQSALTGESLPVTRSPGQEVFSGSTCKQGEIEAVVIATGVHTFFGKAAHLVDSTNQVGHFQKVLTAIGNFCICSIAVGMLAEIIVMYPIQHRKYRDGIDNLLVLLIGGIPIAMSTVLSVTTAIGSHRLSQQGAITKRMTAIEEMAGMDVLCSDKTGTLTLNKLSVDKNLIEVFEKGVDKEHVMLLAARASRIENQDAIDAAIVGTLADPKEARAGVREVHFLPFNPVDKRTALTYIDSNGNWHRASKGAPEQIMNLCNLREDAKRNIHAIIDKFAERGLRSLAVSRQEVPEKTKESAGGPWQFVGLLSLFDPPRHDSAETIRRALHLGVNVKMITGDQLAIAKETGRRLGMGTNMYPSATLLGQDKDASIAALPVEELIEKADGFAGVFPEHKYEIVKKLQERKHICGMTGDGVNDAPALKKADIGIAVADATDAARGASDIVLTEPGLSVIISAVLTSRAIFQRMKNYTIYAVSITIRIVFGFMFIALIWKFDFSPFMVLIIAILNDGTIMTISKDRVVPSPLPDSWKLNEIFATGIVLGGYLALMTVIFFWAIKETHFFPDKFGVRHLIHDEMMSALYLQVSIVSQALIFVTRSRGWSFLERPGALLVIAFLIAQLIATLIAVYANWGFAKVQGIGWGWAGVIWLYSIVFYIPLDVMKFAIRYILSGKAWNNLLDNKTAFTTKKDYGKEEREAQWAHAQRTLHGLQPPESSGIFNEKSSYRELSEIAEQAKRRAEVARLRELHTLKGHVESVVKLKGLDIDTIQQHYTV

SEQ ID NO: 108073 - DNA, 2853 bp, Nicotiana plumbaginifolia
  CDS (1)..(2853)
atggctgaagatctggagaaaccattgctaggtcctgaaaatttgagggaggaagggattgatctggaaaacttgccacttgaagaagttttcgaacaattgataacatcaaaggaaggactttcagctgaagatgcagagcgacgactcaaaatttttggacctaacaagcttgaagagaagcgagagaacaagtttcttaagtttcttaggttcatgtggaacccttgttcttgggtgatggaagcagcagcaatcatggctattggactagctaatggcggagggcaaggtcctgattggcaggactttgtaggcattgtttgtctgttgttgataaattcaacaattagtttcatagaggaaaataatgctggaaatgctgcagcagctctaatggcacgtttagctcctcgaactaaggttcttagagatgggaggtggcaagaaaaagatgccgctattttagttccaggagacatcattagcataaaactcggtgatatcatccctgcagatgcccgattgctcgaaggagatcccttgaaagttgatcagtcagctcttactggggaatctctacccatcacgaaaaagacaggagatgaagtgttttctggatctacttgtaaacatggagaaatagaagctgtagtaattgccacgggggttaattcgttcttcggaaaagctgcacatctcgttgactctactgaagccagtggtcacttccagaaggtccttgcttccattggaaatttctgcatatgctcaatagctgtgggaatgatatttgaaatcattatcatgtacgctgttcagcgtcgttcatataggactggaattaacaaccttcttgttctcttaattggtggaataccaatagctatgccaacagtcctatcagttacactcgctattggctcccatcgactctctcaacagggagctattacaaaaaggatgacggcaattgaagagatggccggtatggatgtactctgcagtgacaagacagggacgctgaccctgaatcgcctcactgttgataggaatcttattgaggtgttccagagagatatggacaaagatatggttgtgttacttgctgctagagcatcaagattggaaaatcaagatgctatcgatgcagcaattatcaacgtgcttgctgatccaaaggaggcgcgtgcaaatatcaggcaagtgcatttccttccattcaatcctgtggataaacggactgcaatcacttacattgattcagatggcaagtggtatcgagccagcaaaggagctcctgaacagatactggatttgtgccaagagaagcaacagatatctgcaaaagtgcatacaatcattgacaggtttgccgaaagagggttacgctctctagctgttgcctttcaggaaattccagaaaattcgaaggagagtcctggcgggccttgggcattttgtggattgcttccgttgtttgatccaccaaggcacgatagtgctgagaccatccggagagcactcaatttaggagtttgcgttaagatgattacaggtgaccagttggccattgcaaaggaaacaggccgacgacttggaatgggaacaaatatgtacccctcattttcattttttggtcgtgacaaggatgaaaatgaagctttaccagttgatgagctcattgaaaaagcagatggctttgctggtgtattccctgaacacaaatatgagatagtaaagattctgcaagcaaacggccacatagttggaatgactggtgatggagtaaatgatgctccagcactcaagaaagcagatattggtatagcagttgctgatgctacagatgctgctaggagcgcttctgatcttgtcttgactgagcctggcttaagcgtgattgtcagtgctgttttgactagcagggctatatttcaaagaatgaaaaattatacaatttatgctgtctccataaccatacgaattgtgcttggtttcatgcttctggcactaatatgggaatatgactttcctccattcatggtactgataattgcaatcctaaatgatggtactatcatgactatttccaaagatcgtgttaaaccatctccaggacccgacagttggaagcttaacgagatctttgcaactggcattgtgattggcacctatcttgctttagttagtgtgttgttttactggcttgcagacagcactctattctttgagactcacttccatgtaaaatctataagtggaaatactgaagaaatctcagcagccatatatcttcaagtcagtattattagccaggcgctaatatttgttacgcgtagtcagagttggtcatttatagagagaccagggcttcttttgatgtttgcatttgtggttgcccaactggttgctaccttgatagcagtttatgcacatattgaattcgcgtcaattagtggcattggctggggatgggcaggagtcatatggttatatagtcttattttctatattcccttagatataattaaattcattgttcgttatggtctgaccggagacgcctggaacctactttttgataagaagactgcttttacatctaaaaaggactatggaagggaagacagagagaccaagtgggtgctttctgtgagaacactacaaggggtaatatcaccagagtttgaaactaaaagcagaagaccttccatgattgctgaacaagctaagcgtcgagcagaaataaccaggcttcgagagttgtatacattgagaggtcatattgaatcagtagcaagacttaagaatctggactttaacaaaattcaaacggctcatacagtttga

SEQ ID NO: 108074 - protein, 950 aa, Nicotiana plumbaginifolia
MAEDLEKPLLGPENLREEGIDLENLPLEEVFEQLITSKEGLSAEDAERRLKIFGPNKLEEKRENKFLKFLRFMWNPCSWVMEAAAIMAIGLANGGGQGPDWQDFVGIVCLLLINSTISFIEENNAGNAAAALMARLAPRTKVLRDGRWQEKDAAILVPGDIISIKLGDIIPADARLLEGDPLKVDQSALTGESLPITKKTGDEVFSGSTCKHGEIEAVVIATGVNSFFGKAAHLVDSTEASGHFQKVLASIGNFCICSIAVGMIFEIIIMYAVQRRSYRTGINNLLVLLIGGIPIAMPTVLSVTLAIGSHRLSQQGAITKRMTAIEEMAGMDVLCSDKTGTLTLNRLTVDRNLIEVFQRDMDKDMVVLLAARASRLENQDAIDAAIINVLADPKEARANIRQVHFLPFNPVDKRTAITYIDSDGKWYRASKGAPEQILDLCQEKQQISAKVHTIIDRFAERGLRSLAVAFQEIPENSKESPGGPWAFCGLLPLFDPPRHDSAETIRRALNLGVCVKMITGDQLAIAKETGRRLGMGTNMYPSFSFFGRDKDENEALPVDELIEKADGFAGVFPEHKYEIVKILQANGHIVGMTGDGVNDAPALKKADIGIAVADATDAARSASDLVLTEPGLSVIVSAVLTSRAIFQRMKNYTIYAVSITIRIVLGFMLLALIWEYDFPPFMVLIIAILNDGTIMTISKDRVKPSPGPDSWKLNEIFATGIVIGTYLALVSVLFYWLADSTLFFETHFHVKSISGNTEEISAAIYLQVSIISQALIFVTRSQSWSFIERPGLLLMFAFVVAQLVATLIAVYAHIEFASISGIGWGWAGVIWLYSLIFYIPLDIIKFIVRYGLTGDAWNLLFDKKTAFTSKKDYGREDRETKWVLSVRTLQGVISPEFETKSRRPSMIAEQAKRRAEITRLRELYTLRGHIESVARLKNLDFNKIQTAHTV

SEQ ID NO: 108075 - DNA, 2901 bp, Nicotiana plumbaginifolia
  CDS (1)..(2901)
atgggcacagaaaacacaaccactactcttgaggctatcaacaatgagactgttgatctggaaaatattcctattaaggaggttttcgagaacctgaaatgtacagaagaaggactcaactctacagaggttgagaaacgtctaaatgtatttggtcataacaaactcgaagagaaaaaggagagcaaaatactgaagttcttgggatttatgtggaatcctctttcatgggtaatggaagtagcagcaatcatggctctttttcttccacacggaaagcacaaggaaattgattaccaagactttgttggcattgttgcactacttatcataaactcaacaattagttttatagaagagaataacgctggaaatgcagctgcagctcttatggctcggttagctccaaaagccaaggttttacgggatgggaaatggagtgaagaggatgcagctgtcttggttcctggcgacatcattagcataaagctcggggatataattccagctgatgcacgtttacttaacggtgatcctttgaaaattgatcagtctgctcttactggagaatcacttccagttaccaaaaatccaggtgatggtgtatactctgggtcaacatgcaaacaaggtgaaatagaagctgttgttattgctactggagtccacactttctttggaaaggctgctcatctcgtagaaaatactacacatgttgggcattttcagaaggtattagcctcaattggtaacttttgcatctgctcaattgcaattggtatggtcattgagctcattgtaatatttggggggcaacatcgaccacctcgtgaagccattgacagccttcttgttctgctcattggtggtatccccattgccatgcctacagttctctctgtaactatggccattggttcccatcgactatctcagcagggagctatcacaaaaagaatgacagctatagaggagatggctggtatggatgtcttgtgcagtgataaaactggcactctaactctaaacaaactatcagtggacaaaaatctgattgaggtttttgccaaagatgttgaaaaggatacggtggttttgatggctgcaagagcttcaaggttggaaaatcaagatgcaattgatactgctatagtatccatgcttgccgaccctaaggaggcacgagctggtatcacagagattcatttccttccattcaatccaactgataagaggacagctcttacctacgttgacagcgctggaaaaatgcacagagtgagcaaaggtgccccagagcagattttgaacctggcatggaacaaatcagacattcaaaatagagtgcatacggtgatagaaaaatttgctgagcgtgggcttcgatctcttgcagttgctcgccaggaagtaccggcaggtacaaaggacagtcctggtggcccttgggaatttgttggtcttctccctctctttgatccgccacgtcatgacagtgctgaaacaatcagaagagcccttgaacttggagttagtgttaagatgattacaggtgaccagttggctataggtaaggaaactgggagacgtctcggaatggggacaaacatgtatccttcatcgtttttgcttggagaacaaaaggatgcttcagctgcagtccttccaattgaagaactcattgaaagtgctgatggatttgccggtgtctttccagagcacaagtacgaaatcgtgagaatcttacaaagcaggaaacacatttgtggtatgactggtgatggagtcaatgatgcacctgccctgaagaaagcagatataggaattgccgtggcagattcaacagatgcagctcgaggcgcttcggatattgttctgactgagccaggactaagtgttattatccatgctgttttgacaagccgtgccatttttcagagaatgaaaaattacacaatatatgcagtgtccatcacaatccgtattgtgttgggattcatgttgctgactgcattttggagattcaattttccccctttcatggtccttgtcattgccattcttaatgatggcacaatcatgactatatccaaagacagagtaaagccatccccgcttcctgatagttggaagctcagcgaaatctttgcaacaggaattgtgataggcagttaccttgccttgatgactgctttattcttctatttaatgtttgagaccagcttctttgcgcatgcctttaatgtggaagatttcaacaaacgtattccagcaaacaaggtcataactgattctctaaatgcaaaactagcttcagctgtgtatctccaagttagcactatcagccaagcactgatctttgttacccggtccagagggtggtcattcatggaaagacccggccttctccttgttgctgcctttattgttgctcagatggttgcaacctttatgtctgctatggtaacatcggttaaatttgctgggattgagaagattggatggaaatggactggtgtaatttggttgtttaatattgttacctattttctacttgatcctatcaaatttgctgttcgatatgctctcagtgggagagcctggggcttactactgaaccaaaaaacggctttcaccaacagaaaggattttggtaaggaagcacgcgaagcagcatgggctgctgaacagagaacaattcatggccttcaatccgtggaaactagaacgtttccagagaattacactttcagggacatcagcttgatggctgaggaagcaaaacggcgcgcagagattgcaaggttaagggaacttcacacactgaaagggagagtagaatcctttgcaaagcttagaggattagatgtcgatcatgtgaatccacattacaccgtctaa

SEQ ID NO: 108076 - protein, 966 aa, Nicotiana plumbaginifolia
MGTENTTTTLEAINNETVDLENIPIKEVFENLKCTEEGLNSTEVEKRLNVFGHNKLEEKKESKILKFLGFMWNPLSWVMEVAAIMALFLPHGKHKEIDYQDFVGIVALLIINSTISFIEENNAGNAAAALMARLAPKAKVLRDGKWSEEDAAVLVPGDIISIKLGDIIPADARLLNGDPLKIDQSALTGESLPVTKNPGDGVYSGSTCKQGEIEAVVIATGVHTFFGKAAHLVENTTHVGHFQKVLASIGNFCICSIAIGMVIELIVIFGGQHRPPREAIDSLLVLLIGGIPIAMPTVLSVTMAIGSHRLSQQGAITKRMTAIEEMAGMDVLCSDKTGTLTLNKLSVDKNLIEVFAKDVEKDTVVLMAARASRLENQDAIDTAIVSMLADPKEARAGITEIHFLPFNPTDKRTALTYVDSAGKMHRVSKGAPEQILNLAWNKSDIQNRVHTVIEKFAERGLRSLAVARQEVPAGTKDSPGGPWEFVGLLPLFDPPRHDSAETIRRALELGVSVKMITGDQLAIGKETGRRLGMGTNMYPSSFLLGEQKDASAAVLPIEELIESADGFAGVFPEHKYEIVRILQSRKHICGMTGDGVNDAPALKKADIGIAVADSTDAARGASDIVLTEPGLSVIIHAVLTSRAIFQRMKNYTIYAVSITIRIVLGFMLLTAFWRFNFPPFMVLVIAILNDGTIMTISKDRVKPSPLPDSWKLSEIFATGIVIGSYLALMTALFFYLMFETSFFAHAFNVEDFNKRIPANKVITDSLNAKLASAVYLQVSTISQALIFVTRSRGWSFMERPGLLLVAAFIVAQMVATFMSAMVTSVKFAGIEKIGWKWTGVIWLFNIVTYFLLDPIKFAVRYALSGRAWGLLLNQKTAFTNRKDFGKEAREAAWAAEQRTIHGLQSVETRTFPENYTFRDISLMAEEAKRRAEIARLRELHTLKGRVESFAKLRGLDVDHVNPHYTV

SEQ ID NO: 108077 - DNA, 2865 bp, Nicotiana plumbaginifolia
  CDS (1)..(2865)
atggcggatcagaagggaaccgtaagcttggatgatatcaagaaggagaacgtcgatctcgaaagaataccagtggatgatgtatttaggatattgataagttccaaggagggattggcatctgatgaagctgagagaaggcttgttgtctttggcgcaaacaaacttgaggagaaaaaggagaacaagatcttaaaattcttcggtttcatgtggaaccccttgtcatgggtcatggaagttgctgctgtcattgccattgcattagcaaatggacagaataggcctccagattggcaagatttccttggtattgtggtcttacttgttatcaactctaccgtcagtttcattgaagaaaacaatgcgggcaatgccgcagcagcactgatggcaggccttgctcccaagtcaaaggtattgagagatggtagctggaaagagatggatgcagcaatgctagtacccggggatgtgataagtattaagttgggggatatcctaccagcagatgctcgtttacttgaaggtgatccgctcaaaattgatcaatctgctctcacgggtgagtcattacccgtgacaaagcacccaggcgaaggagtgttctctggttccacctgtaaacaaggtgaaattgaggctgttgtcattgccactggaatcagtacctttttcggaaaagctgctcaccttgttgatagtaccaataatgtcggccacttccagaaggttttgacagcaataggaaacttctgcatatgctccattctggttggaattgtcatagagatattggtgatgtacccaattcagcacagaaagtacagagatggaattgataatctgcttgttcttctcattggaggaattccaatagctatgcctactgtattatcagttactatggcaattggatcccacaagctgtcgcaacaaggtgccatcaccaagaggatgactgctatagaagagatggctggaatggatgtactatgtagtgacaagacaggaactcttacattaaacaagcttgaagtagacaaaaacttagttgaggttttcgcaaaggatattgaccaagatacagttattcttctcggggccagagcttcaagggtggaaaatcaggatgctattgatgcttgcattgtaggaatgttggcagatgccaaagaggctagagctgggatccaagaagtgcacttcctgcctttcaaccctgtcgacaagcgcacagctattacctacatagatgccaatggcaattggcatagagttagcaaaggtgcacctgaacagatcattgagctttgtggcctaagcgaggatgtaaagaggagagctcactccgtcattgacaagtttgctgatcgtggtcttcgctctcttgcagtggctcaacagacagtaccagagaggacaaaggaaagtccaggagggccttggctctttgtaggactcttgcctctttttgaccctccaaggcatgatagtgcagagacaattaggcgcgctcttgtccttggcgtcaatgtcaaaatgataactggtgatcagcttgccatagcaaaggaaactggtcggaggcttggtatgggaacaaatatgtatccttcttcttccctcctggggcagcacaaggatgaaaatactgctaacctccctgtcgatgagctcattgaaatggctgatggctttgctggtgtctttccagagcacaaatatgagattgtgaagaagctccaagaaagaaagcacatttgtggtatgactggagatggtgtgaatgatgcccctgctttgaaaaaagcagatataggcatagctgtggctgacgctactgatgctgcccgtggtgcatctgacatagttctcacggagccaggactaagtgtgatagtgagtgctgtattgaccagccgagctatatttcagaggatgaagaattataccatttatgctgtttctataaccatccgaatcgtgctaggcttcatgctcattgcactaatatggaagttcgatttctcacctttcatggttcttatcattgccattctcaatgatggaaccatcatgaccatatctaaagacaaggtgaagccgtcacccatgcctgactcatggaaactgcgagaaatttttgccactggcatagttcttggcacttacctagccgttatgactgttatcttcttttgggctgctcaccagtcaaatttcttcagtgacaagtttggggtaagatcgattagagacaatgtacacgagctcaattcagcactatatcttcaagtcagcatcgttagtcaggcactcatatttgtaactaggtcaaggagttggtcttatgtagaacgtcccggtctccttctgctagctgcttttgctatagcacaactggttgccaccctaattgcagtatatgcaaactggggttttgctaggattcatggtattggttggggttgggctggtgttatttggctttacagtattattttctacatacctctggatattttaaaattcgccatcagatacactttgagtggcagggcctggaataatatgatggagaacaaggttgctttcacaagcaagaaggattatggtaaaggagaaagggaggcacaatgggcgttggctcaacgcacattgcatggacttcaagctcctgatagttcccaggtgttcgacaacaaaagctataaggaattgtctgaaatagccgaacaggccaagaggcgtgctgaagttgccaggctaagagagcttcatactctaaaggggcatgtagaatcagtggtgaagctcaagggacttgacattgagacaattcagcaacattacactgtttaa

SEQ ID NO: 108078 - protein, 954 aa, Nicotiana plumbaginifolia
MADQKGTVSLDDIKKENVDLERIPVDDVFRILISSKEGLASDEAERRLVVFGANKLEEKKENKILKFFGFMWNPLSWVMEVAAVIAIALANGQNRPPDWQDFLGIVVLLVINSTVSFIEENNAGNAAAALMAGLAPKSKVLRDGSWKEMDAAMLVPGDVISIKLGDILPADARLLEGDPLKIDQSALTGESLPVTKHPGEGVFSGSTCKQGEIEAVVIATGISTFFGKAAHLVDSTNNVGHFQKVLTAIGNFCICSILVGIVIEILVMYPIQHRKYRDGIDNLLVLLIGGIPIAMPTVLSVTMAIGSHKLSQQGAITKRMTAIEEMAGMDVLCSDKTGTLTLNKLEVDKNLVEVFAKDIDQDTVILLGARASRVENQDAIDACIVGMLADAKEARAGIQEVHFLPFNPVDKRTAITYIDANGNWHRVSKGAPEQIIELCGLSEDVKRRAHSVIDKFADRGLRSLAVAQQTVPERTKESPGGPWLFVGLLPLFDPPRHDSAETIRRALVLGVNVKMITGDQLAIAKETGRRLGMGTNMYPSSSLLGQHKDENTANLPVDELIEMADGFAGVFPEHKYEIVKKLQERKHICGMTGDGVNDAPALKKADIGIAVADATDAARGASDIVLTEPGLSVIVSAVLTSRAIFQRMKNYTIYAVSITIRIVLGFMLIALIWKFDFSPFMVLIIAILNDGTIMTISKDKVKPSPMPDSWKLREIFATGIVLGTYLAVMTVIFFWAAHQSNFFSDKFGVRSIRDNVHELNSALYLQVSIVSQALIFVTRSRSWSYVERPGLLLLAAFAIAQLVATLIAVYANWGFARIHGIGWGWAGVIWLYSIIFYIPLDILKFAIRYTLSGRAWNNMMENKVAFTSKKDYGKGEREAQWALAQRTLHGLQAPDSSQVFDNKSYKELSEIAEQAKRRAEVARLRELHTLKGHVESVVKLKGLDIETIQQHYTV

SEQ ID NO: 108079 - DNA, 2994 bp, Neurospora crassa
  CDS (1)..(2994)
atggaggcggcgtttgcaaagcccgtcgatgaggtcctcagcacctttggtgtcgaccctaccaccggtctaagtgacgagcaagtagctcagtccagggctaagtacggtagaaatgccattccagaggaacctccgacacccatctgggagcttatcttggaacaattcaaagaccagctggtcctcatccttctgggctctgccgccatctcgttcgtactcgcgctcttcgaagacgagggcggctggagcgccttcgtcgaccccgccgtcatcataacgatcctagttctcaacgctgttgtcggagtgtcccaggaaagcagtgccgagaaggcgattgctgctttgcaagagtattcggccaacgaggccaacgtggtgcgcaatgggcagattactcgtatcaaggccgaggatcttgtgccaggcgatgtcgttgacattgctgttggtgctcgcgtccctgctgactgcagattgatctcgattgagagtaacagctttgctgtggaccaggccatcttgaccggagaaagcgagagcgtcgggaaagacttccaggccgttgttagcgacgacaaggctgtcttgcaggaccaggtcaatatgctgttttcgggcacaactgttgtcactggtcacgccaaagccgtcgttgtcttgactggctccaatacagctatcggcgacattcacgagagcatcaccgcccagatctccgagcctacccccttgaagcaaaagctcaatgacttcggagaccagctcgccaaggttatcactgtcatctgcgttctcgtctggctcatcaacatccctaatttcgccgaccctagccatggaaactggaccaagggtgccatttactacctcaagatcgccgtttcccttggcgttgcggccatccccgagggtcttgcggtcgtcatcaccacctgccttgcccttggaactcgcaagatggcagctaagaacgccgtggtgagaagtcttccgtctgttgagaccctgggcagttgcagcgtcatttgctctgacaagaccggcactttgaccaccaaccaaatgagcgttaacaaaatcgtccatttcaaccaagatggtactgatctggaggagctggatgttgagggaactacctttgaacccaagggtgctatcatgtcgcagggcaagaaggttaccgaccttgctcaaaactccgctaccattcttcagttgaccgaagttgccgctctctgcaacgatgcccgccttgactaccatccctctaccggcactttctcgaacgtgggcgaagctaccgaaggcgccctccgcgttttgaccgagaagatcggcccctgcgccccctctgattgtcctcccaaggatcgcgttcactacgctagctcctggtacgagaagcagtatcagcgtcttgccacctacgagttttcgcgtgaccgcaagagcatgtctgtcttggttgagcgtgatggacagcagaagcttctcgttaagggagcccctgaatcgctcatcgaacgctgtactcacgctctcctcggtcccgatggcaagaaggtacctttggacagtaacatgtccgaactcctcatgaaggaggttgttgagtatggcaaccgcggtctgcgtgtgatcgcactggctagtctggacaacgttgctggtaaccctcttcttcacaccgccaagtctaccgccgaatatgcctctctcgaacagaaccttactctcatcggtctcgtcggcatgcttgaccctccgcgtcctgaagttgctgcttctatcaagaagtgcaaggatgcaggtattcgcgttgtcgtgattaccggtgataaccgcaacaccgctgagagcatctgccgtcagatcggtgtctttggatctaacgaggatttaactggcaagagctacactggtcgcgaattcgataaccttacccctagtgaacagctcgaggccgccaagactgcttctctgttctctcgcgtggagcctactcacaagtctaagctggttgatctcctccagtctctcggtgaggtcgttgctatgactggcgacggtgtcaacgatgctcctgctctgaagaaggctgatattggtgttgctatgggttccggtaccgacgtgtcgaagctcgctgctgacatggtgcttgctgatgataactttgccactatcgaagtcgccatcgaggaaggccgcgccatctacaacaacacccagcagttcatccgctacctcatctcttcgaacatcggtgaggtcgtctctatctttttgacggccgctctcggtatgcctgaggctctcatcccggttcagcttctatgggtgaacttggtcaccgacggtctccccgctaccgccttgtccttcaacccccctgaccacgatatcatgcgtcgcaaccccagaaagcgtgacgaggctctcatcggcggatggctcttcttccgttatctggtcattggtacctatgtcggtctcgccacggtcgccggttacgcttggtggttcatgttctactcggagggtcctcagatcagcttctaccagctatctcacttccatcgctgctctaccgagttccctgagattggctgcgccatgttctcgaacgacatggccaaggccggttcgaccgtctcgctctccatcttggtcgtcattgagatgttcaatgccatgaacgccctctcttccagcgagtctctcttgacgctccctgtttggaagaacatgatgctcgtctatgctatcggtctgtccatggccttgcacttcgcccttctctacactcccatccttcagaccctcttttcgattctccccatgaactgggcagagtggaaagccgtgatcgtcatcagtgcaccagttgtgcttcttgacgaacttctcaaggccgtggaacgcaagtactttgtacagagcacccccagctcgacgtcctcagataagaagaaggatctctag

SEQ ID NO: 108080 - protein, 997 aa, Neurospora crassa
MEAAFAKPVDEVLSTFGVDPTTGLSDEQVAQSRAKYGRNAIPEEPPTPIWELILEQFKDQLVLILLGSAAISFVLALFEDEGGWSAFVDPAVIITILVLNAVVGVSQESSAEKAIAALQEYSANEANVVRNGQITRIKAEDLVPGDVVDIAVGARVPADCRLISIESNSFAVDQAILTGESESVGKDFQAVVSDDKAVLQDQVNMLFSGTTVVTGHAKAVVVLTGSNTAIGDIHESITAQISEPTPLKQKLNDFGDQLAKVITVICVLVWLINIPNFADPSHGNWTKGAIYYLKIAVSLGVAAIPEGLAVVITTCLALGTRKMAAKNAVVRSLPSVETLGSCSVICSDKTGTLTTNQMSVNKIVHFNQDGTDLEELDVEGTTFEPKGAIMSQGKKVTDLAQNSATILQLTEVAALCNDARLDYHPSTGTFSNVGEATEGALRVLTEKIGPCAPSDCPPKDRVHYASSWYEKQYQRLATYEFSRDRKSMSVLVERDGQQKLLVKGAPESLIERCTHALLGPDGKKVPLDSNMSELLMKEVVEYGNRGLRVIALASLDNVAGNPLLHTAKSTAEYASLEQNLTLIGLVGMLDPPRPEVAASIKKCKDAGIRVVVITGDNRNTAESICRQIGVFGSNEDLTGKSYTGREFDNLTPSEQLEAAKTASLFSRVEPTHKSKLVDLLQSLGEVVAMTGDGVNDAPALKKADIGVAMGSGTDVSKLAADMVLADDNFATIEVAIEEGRAIYNNTQQFIRYLISSNIGEVVSIFLTAALGMPEALIPVQLLWVNLVTDGLPATALSFNPPDHDIMRRNPRKRDEALIGGWLFFRYLVIGTYVGLATVAGYAWWFMFYSEGPQISFYQLSHFHRCSTEFPEIGCAMFSNDMAKAGSTVSLSILVVIEMFNAMNALSSSESLLTLPVWKNMMLVYAIGLSMALHFALLYTPILQTLFSILPMNWAEWKAVIVISAPVVLLDELLKAVERKYFVQSTPSSTSSDKKKDL

SEQ ID NO: 108081 - DNA, 4998 bp, Drosophila melanogaster
  CDS (574)..(3279)
gcacttccattcgaaagcctgacgatgtgccatcttccgggccgttgttgacgcggtgaatcgaggcggaaaaatcgattgtgctcgtgtgattatttttgttttgatttgcggcctcccgctctcgtaatcctcgcgcggccgcggccacatgactcatgccaggcaggaacaatgaaaaatcacaataagtacgtcaaattgccccaagacctcgatctgagtttccacagtgatttggacctgctgccggatacggcagccgacatcgacgtagaactagacccggctgcggacacggatgtggccgcgctcagtgtgaacgtgcccgcgtctctgggcctggacgaggacgacgacgacgaggtcattatcgcccccggcggcggaggccttcgactagctcccacggcggcggaggcagtggcggcacacaggcagcatcatcagcagcaccagcagtgcaagcagctaaagaaccagctggagcagaagcagattctgcccaagagcaagatctgcggactaggcagcgacagcatcgtcgagacgggccttaccctcacacctgaaatgctgttgtccacctcggaatcatcgacccacagtgcctccgaggtcgccggacgactgcaggtcgacgtgcgtaccggcctcaaatggacagaggccaagtatcgtgccaagatcatcgggcataacgagctgctgctcgtggcggaggatccgacatggaaaaagtacattgagcagtttaggaacccgctaattctgctgcttcttggttctgctctggtgtccgtaatcatgaagcagtttgacgacgccgtgagcataaccattgccatcctaattgtggtcacggtggcctttatccaggagtaccgctccgagaagagtctggaggagcttaagaagctggtgccccctgaatgccactgcctgcgggaaggtcgtctagacacattcctggcacgcgaactggttcccggggacatagtgcacctcaacgtgggcgaccgggtgccggccgacgtgcgtcttttcgaagctgtggacctatctatcgacgagagcagttttaccggcgaaacagagccggcgcgcaaaattactgatgttttgcttaacaatacgaacgtaaaggaccacagcaacatgaagaacattgccttcatgggcactctggtgcgatgtggcaacgggaagggcatagttgtcagcactggggagcgcagtgagttcggtgaggtcttcaaaatgatgcaggcagaggaggctccgaagacgccactgcagaagtcgatggacattctaggcgctcagttgagcttctactccttcctgattatcggtgtcatcatgctgctgggctggctacaaggtaagccgctttcggaaatgttcaatatcagcgtttcactggccgttgcggccatccccgagggccttcctatcgtggtaactgtgactctagcgcttggcgtaatgcggatggctaaacgaaattcaatcgttaaaaagctgcctactgttgagactttgggctgcgttaacgttatctgctctgataagaccggaactttgaccaagaacgagatgacggccacgatcatcatcacttccgacggatacatggcggacgttaccggtgccggttacaatgatcagggtgaaatccacatacggcattgcaacaacgtggagatggctaagaccaatattacaaacctccttgaaatcggggcggtctgcaataacgcttacatacaaaatggcaccctcctaggacaacccactgaaggagcccttgtggcggtagccatgaagaacggaatgtacgccacagctgagaactacgttcgcatccaggagtatcccttcagctcggagcagaagatgatggctgtaaagtgcatccacaagtacaacaacaacaaggaagagattttcttcgccaagggggctctagagaccctgttaccgcagtgcaccaagtatcagtttggtacccagacggtaccacttaccaagcagaacgaggcagagttcctagccgaggcgtacgagatcgggcgcaagggccttcgcgtgttggccctggcaaagggccggtccatgcaagatctgatctactgcggcctagtcggcatcactgacccaccaaggccccttgttcgagagtctattgaaatgttgatgcagagcggagtgcgtgttaaaatggtgactggagatgcccaggaaacggccttggccattgcgaatctcatcggtatcgatacaatccatcaccagacgctttccggtcaggaaatggatcaaatgaacgagcaccaactggacaaggtagccaacaacgtgagcgtattctaccgcgtatcgccacgccacaaactggagatagtcaagtccttgcagcgcagtggcaacatagtcggcatgacgggcgacggggtgaacgacggagtggccctgaagaaggcggacatcggcatagccatgggaaagaacgggacagatgtgtgtaaggaggcggctgatatgatcctggtcaatgatgatttccacaccataatcgccgccatcgaggagggcaagggcatattctacaacattcgaaacttcgtgcgctttcagcttagcacatcaatagctgccctggccctgattgccctggccactctgatggacattgctaacccgctaaatgccatgcagattttgtggatcaacatcataatggacggtccgcccgcacagtctctgggcgtggagcccgtcgaccacgatgtgctcaaacagaaaccacggaacgtgaaacagccaatgatcacaaagtcagtggtggtgaacgttctgcttagtgccagtataattgtactgggcacgctgtgggtgttccagcgcgaaatggccgacgggacgctgggaaagaccaaacgggacacaacgatgacctttacttgtttcgtgtttttcgacatgtttaacgccctgtcttgccgctcgcagacaaagagtgtctttaccatcggactcactaccaatcgaatgttcttgctggccgtcgctttttcgatcattggtcaaatgctcgttgtctactttccgccgctgcaaatggttttccagacggaagctcttacgccgtatgacatattcttcctggtctccctaacctcatctgtgctggttgtttcagagataaagaaatggttcgagcgtaccatggagcgcaagatgtacagcacccgctccgagctggattttgtatgacaaaacgcaagcgctagagaagatttgcaccccaaaaccgagtaaattaaataactaacaaaaaaatccattaaaaaagtaaaactatgccaaaacaagcgaggagcgcggagaagtgcagttcgaaagaaaagccgaaaataagagcgacggaccaaggatgtgtgtgtttaattttacatttgacttgaccaattaagaatgatttaattgttattgtgggttttcaaccagattgcacagcagggattttcatagatttgaaatcctactcgttcttccccacagagaagcaaccggattataaacaagtgaccacttactataatccgagtatgttcaccgggaaagtgcattaccactgggtcacagtcaacatacataaaaataaaacggatgcgagacaaaaaaggcatgaaatggacaaagctaagcgaggcgtagtaacgtaaaacatggcttttttttggtattattgataaataatttattcggtatttgaaagcaagcattcaatttgtgtaaaattgaggcaaatcaaaactctagcgtgctatcaaaataaaacaatttttgacgaactcatcccaaatcaactttaaaaggagagttcagatcaacaaaagatttttgtatgtaatcaaaaatgctataatttcagcatactttgtgggcgttgatgtgatgctttgataattaagttcatgattaatgggcttaccaaaacgaagtaatgcacgaagcaaatgagaaatacgaagcaatcagcaccgcgtttactcgaatgtaaagaaattttcgctcatatacttaaataaaaaataaattcataggaaagcatggttctttgtactattctgttgtttgttgtttaaattgaactttgatgcaatagattactaaacggcaaaagaaatttacaactaaagcttatccagattgtagtcaaaagtatacatctcaataaaaaattaatgaattttgaaaaaataaacaaattctatagattaccaatacttgggtaccccttataaattaacttaaatatcattgacataaaattcatatcataccaactcagagttcactgttgcactggaagcatatcacaatttgtccatgtttttatacccgttattaaaaaagtaaaaggcaattctgtattcgtagaaatgtaaaccctatcaaagaatatatattgttgctcactctgtccgtccgtatgtctatccgtataaatgtagaaatcttggcagctataaaagctagaggttaggcatgtaattttccagaccaccacaagcgcggcccataactgccacggcttcattttctagaaatgattttatatttttaagttataagtcttgtcaattcccaatgatatatccaagtttttttttttaattttgatatttttttttataaattttatcgataattaaaaacaattttgaaatacttccctggcactcccactagtcgagtaacgggtatttatagtcgagatattggactttagcgttttcatttttttatttgaatgagcttgtattcaacatttttcacaaaatttcaacttggttatagcaatttatgcgcaccctgcagatcgcatttaaaggaccaatcgttaaatacttcatttgatcacacacattaagatcagcttacgctcaacaaaaacgcactcatatcatggcaaaaaaaaaaaaatga

SEQ ID NO: 108082 - protein, 901 aa, Drosophila melanogaster
MLLSTSESSTHSASEVAGRLQVDVRTGLKWTEAKYRAKIIGHNELLLVAEDPTWKKYIEQFRNPLILLLLGSALVSVIMKQFDDAVSITIAILIVVTVAFIQEYRSEKSLEELKKLVPPECHCLREGRLDTFLARELVPGDIVHLNVGDRVPADVRLFEAVDLSIDESSFTGETEPARKITDVLLNNTNVKDHSNMKNIAFMGTLVRCGNGKGIVVSTGERSEFGEVFKMMQAEEAPKTPLQKSMDILGAQLSFYSFLIIGVIMLLGWLQGKPLSEMFNISVSLAVAAIPEGLPIVVTVTLALGVMRMAKRNSIVKKLPTVETLGCVNVICSDKTGTLTKNEMTATIIITSDGYMADVTGAGYNDQGEIHIRHCNNVEMAKTNITNLLEIGAVCNNAYIQNGTLLGQPTEGALVAVAMKNGMYATAENYVRIQEYPFSSEQKMMAVKCIHKYNNNKEEIFFAKGALETLLPQCTKYQFGTQTVPLTKQNEAEFLAEAYEIGRKGLRVLALAKGRSMQDLIYCGLVGITDPPRPLVRESIEMLMQSGVRVKMVTGDAQETALAIANLIGIDTIHHQTLSGQEMDQMNEHQLDKVANNVSVFYRVSPRHKLEIVKSLQRSGNIVGMTGDGVNDGVALKKADIGIAMGKNGTDVCKEAADMILVNDDFHTIIAAIEEGKGIFYNIRNFVRFQLSTSIAALALIALATLMDIANPLNAMQILWINIIMDGPPAQSLGVEPVDHDVLKQKPRNVKQPMITKSVVVNVLLSASIIVLGTLWVFQREMADGTLGKTKRDTTMTFTCFVFFDMFNALSCRSQTKSVFTIGLTTNRMFLLAVAFSIIGQMLVVYFPPLQMVFQTEALTPYDIFFLVSLTSSVLVVSEIKKWFERTMERKMYSTRSELDFV

SEQ ID NO: 108083 - DNA, 3302 bp, Caenorhabditis elegans
  CDS (264)..(2969)
aaccataagaaacttggaatctatacggaacaatgaatggatcagtggctccgccgggagtcccggggaaggacaaagaggcgccgcaatcgacggcggcaatattccgagtacaaggtaacactacaaccaccactacaagtacaacaagtactaacggaattgctcagaagcatcaaccaacaacaccactagtaaaagcagaagtctcaacaaatcacatttcaaaagatcgttcaaaatcaatatcaaaagacgatataatgattgaaacactgacatcagaacaagcagcatcacatgaagttgttccatgtacacatcaacttcgaacaaatcttgaagagggtctcacaacggcagaagccacaagaaggagacaatatcatggatataatgaatttgatgttggagaagaggaacctatttataaaaaatatttggaacaattccaaaatccattgattcttctcttattggcttctgcatttgtgtcgattgttatgaaacaatatgatgatgcgatatcgattacggtagctgttgtcatagttgttactgttggatttgtgcaggaataccgttccgaaaagacgctggaacaactcaccaaactcgttccaccaacgtgtcacgtgctccgtgatggaaaagaggcaatgatgttggctcgggagcttgtacccggtgatattgtacttctgaacacgggagatcggatcccgtccgatttacgaatcgccgagagcttctcacttcaaatcgacgagagctcactgaccggagaaactgagccgaagcataaggaaacccgttcagtgccggccgcatctgccaccggatccgatgttgaacatctcacatgcatcgccttcatgggaactcttgtctgcgctggccgtggccgaggaatcgtcatttcgacggccgccaattcacagtttggagaagtggtaaagatgatgatgggtgaggagtctccgaagactccactgcaaaagagtatggatgatctgggaaagcagctttcgatctactcatttggcgtcatcgccgttattttcctaatcggaatgtttcagggtcgaaatgtggttgatatgttcacaattggtgtctccctcgccgtcgctgcaattcctgaaggtcttccaatcgtagttgccgtaacactagcaatcggagtaatgagaatggccaaacgcagagctgtcgtgaagaagatgccagcagtcgagactctcggatgtgtaacagtaatatgttcggataaaactggaacactgacaaaaaatgagatgacagcacaagccatcgctacaccagaaggaaaactcgctgaaatcactggaatcggatattcagcagaaggaggtgttgttcagtatcaaggagaacaagttcatcaatggacacatccagaatttgcgagaattattgaagctggattagtttgtaataatgctactattgaagcggataagcttatcggacaacccacggagggagcaattgtagtgttggcaaagaaagcacagttggaaggagtacgatcagagtataagagacttcgagaaatgccattctcttcagatactaaatggatgggggttcagtgtgctgatgcacatgggcagaatgtttattttattaaaggagccctggaccgtgtgcttgatcaatgtggaacatactattcatcggataatcaacgtaaacagtgtgatcaatattctcgtcaacacattcttgaaatcggaaaagagctcggccaaaaagggctccgtgtgctcggtttggcacgtggagagagtatgcaatctttgatgtttctgggaatgattggaatgatggacccaccacgtcctggtgctgcagatgcgattagtattgttaaagctagtggtgttgatgttaagcttatcactggagatgcaatggagacggctcagagcattggtcaatccctcggtatcctctcatcctccgattcctgcctctccggccaacaagtcgatcaaatgtcggatcacgatctggagctagtcatccgtcaagttaccgtattctaccgagcatcgccacgtcataagctgaaaatcgtgaaggcactgcaggcactcggtgaggtcgtcgcaatgaccggagacggtgtaaatgatgctgtggctcttaaaaaagcagatattggagtggcaatgggtgtatgtggaacagatgtatgtaaagaagcagctgatatgatcctttgtgatgatgatttttcaacgatgaccgcggcgattgaggagggaaaagccatttatcacaatatcacgaattttgtgaggttccaattgtcgacaagcgtcgccgccctgtcactaatcgccgcgtcaacaatgttcaaattcgataatccattaaatgcaatgcaaatcttatggattaatattataatggacggaccaccggcacaatcacttggagttgaaccagttgatgatgatattattaggcaacgaccacgaaatacgaaacaaccaatgttaaccggaaaattgattgccgatattctcgcgtctgccgcgattattgttgtcggcacgttgagtgtgttttataaagagatgtcagccgacaataaagtaacaccacgtgacacgacaatgacattcacctgttttgtcctattcgatatgtggaatgccctttcatgcagatcatcacgtaaaatgatatggcaaatcggactgcgacggaatcgaatgttctcgttggctgtgtctgcctcacttatctgccagcttctcgtcatctactgggcaccacttcaacacatttttcagactgaagcactttctctttttgatctcatcttcctgacaacaatcacatcgtctgtgttcattttcaacgaaactcggaaatatttctcacttcgctccaaatcgctcaaccacgatcccctgtctgtcagcggaatttaaattcatttttttttgtttggaaatttcaaaaattctacgcatttccatgttttttcttctagtatcatatatttattaaattattttttccgattttttccctccttcctagattttagtgacacttttttttacaaaaccatacgggatacccataatttattcgacttttttctttctagttcatttatcgattttttctgatttaaaaaattccaaattttttgatgatctaggtctccccacattcacatcatatacaacaaaatcacccgaatcctgtgaaatgaaatgatgaatcttttgactgtgatatgaaatatactacaaact

SEQ ID NO: 108084 - protein, 901 aa, Caenorhabditis elegans
MIETLTSEQAASHEVVPCTHQLRTNLEEGLTTAEATRRRQYHGYNEFDVGEEEPIYKKYLEQFQNPLILLLLASAFVSIVMKQYDDAISITVAVVIVVTVGFVQEYRSEKTLEQLTKLVPPTCHVLRDGKEAMMLARELVPGDIVLLNTGDRIPSDLRIAESFSLQIDESSLTGETEPKHKETRSVPAASATGSDVEHLTCIAFMGTLVCAGRGRGIVISTAANSQFGEVVKMMMGEESPKTPLQKSMDDLGKQLSIYSFGVIAVIFLIGMFQGRNVVDMFTIGVSLAVAAIPEGLPIVVAVTLAIGVMRMAKRRAVVKKMPAVETLGCVTVICSDKTGTLTKNEMTAQAIATPEGKLAEITGIGYSAEGGVVQYQGEQVHQWTHPEFARIIEAGLVCNNATIEADKLIGQPTEGAIVVLAKKAQLEGVRSEYKRLREMPFSSDTKWMGVQCADAHGQNVYFIKGALDRVLDQCGTYYSSDNQRKQCDQYSRQHILEIGKELGQKGLRVLGLARGESMQSLMFLGMIGMMDPPRPGAADAISIVKASGVDVKLITGDAMETAQSIGQSLGILSSSDSCLSGQQVDQMSDHDLELVIRQVTVFYRASPRHKLKIVKALQALGEVVAMTGDGVNDAVALKKADIGVAMGVCGTDVCKEAADMILCDDDFSTMTAAIEEGKAIYHNITNFVRFQLSTSVAALSLIAASTMFKFDNPLNAMQILWINIIMDGPPAQSLGVEPVDDDIIRQRPRNTKQPMLTGKLIADILASAAIIVVGTLSVFYKEMSADNKVTPRDTTMTFTCFVLFDMWNALSCRSSRKMIWQIGLRRNRMFSLAVSASLICQLLVIYWAPLQHIFQTEALSLFDLIFLTTITSSVFIFNETRKYFSLRSKSLNHDPLSVSGI

SEQ ID NO: 108085 - DNA, 3581 bp, Oreochromis mossambicus
  CDS (205)..(3237)
gaagtattagagagcaaagggaggaagctgtttcccgcgtgatgctccccttgaaactgcaaaatttcgtttgaaaaacgtcccccaaggggaaattgaagcctaagcttgccgaaggcaaggcattttgatatagttcaacgtgaggggctgacacctttcaagccgggcattacctgaaaggaaaagagtgactgggtcaacatgggggacaaagatgaccgattccccaagaagaagaaggggggaaccaaggacatggatgccctgaagaaggaagtacccattacggaacacaaaatgtccgtagaggaagtatgcaggaaattccagactgacgttgtccagggactgaccaatgccaaggccgcagagtttctgctcagggatggtcccaatgctctcacccctcctcccaccaccccagaatgggtcaagttctgtcgccagctgttcggtggattctccatcctgctgtggaccggtgccatcctctgttttctggcctacgctatccaggcagctactgaggacgagcctgcaggggacaacttgtaccttggtattgtgctcacagctgtcgtagtcatcaccggttgcttctcatactttcaagaggctaagagctctaaaatcatggagtctttcaagaacatggtacctcagcaagcactggtgatccgtgagggtgagaaggtgcaggtcaatgctgaggaagtgatggccggagatctgattgaagtgaagggtggagacaggatccctgctgacatcagggtgacttcagctcacggctgcaaggtggataactcttcccttacaggagaatcagagcctcagagcaggtcacctgactgtacccatgacaaccccctagagacccgaaacattgctttcttctccaccaactgtgttgaaggcacagcgcgtggtattgttatttgcactggagaccgcacagtcatgggccgcattgctactctgacgtccggcttggaaaccggcaaaacacctattgccgttgagatcgagcactttatccacattatcacaggagtggctgtcttcttgggcgtcacctttttcatcttggccatcattttgggttacacctggctgaaggccgtcatcttcctcattggcatcattgtggctaacgtgcctgaagggctgctggctactgtaactgtatgtctgactctgactgccaagcgtatggctaagaagaactgcctggtgaaaaacttggaagctgttgaaaccctgggctccacctccaccatctgctctgacaagacaggcaccctgacccagaacaggatgactgtggcccacatgtggtttgacaaccagatccacgaggctgacaccacagaggaccagtcgggtgctgcatttgacaagagctctgtgacatggctgtcactttctcgtgttgctcctctgtgtaaccgcgcacagttcaaacctcgacaagactccgtgtccatcctgaagcgtgatgtggctggtgatgcctcagagtcagctctgctgaagtgtatcgagctgtcatgcggctcagtcaggatgatgagggataagaacaagaaggtggctgagattccctttaaccccaccaacaaataccaactttctattcatgaaacagaagatccaaatgacaaccgctacttgctggtgatgaagggagcccttgagaggatcctggatcgttgttccaccatcatgctgcagggcaaggagcagcctatggatgaggagatgaaggaagctttccagaatgcttacatggagctgggaggactgggagagagagtactgggtttccgccacctgctgctgccagaggatcagtatcccaagggctttgcctttgacacagatgatgttaacttccagacagataatctctgcttcgttggcctcatgtccatgatcgaccctcctcgtgccgccgtgcctgatgctgttggcaaatgccgatccgctggtatcaaggtcattatggttaccggtgatcacccgatcacagccaaggccattgccaagggagtgggcatcatctcagagggcaacgagacagtggaggacatcgcagctcgtctcaacatacctgtcagccaggtcaatcccagagacgccaaggcctgtgtgattcatggctcagacctcaaggatctgtctcaggatcaaatggatgacatcctgaggaatcacacggagattgtgtttgccaggacctcacctcagcagaagctgatcattgtagaaggatgccagcgactgggtgctattgtagctgtgacaggtgatggtgtgaatgactcacctgcactgaaaaaggctgacattggtgttgccatgggaatctcaggctccgatgtgtccaagcaggctgcagacatgatcttgttggatgacaactttgcttctattgtcactggagtggaagaaggtcgcttgatctttgataatcttaagaagtccattgcctacaccttgaccagcaacatcccagagatcacccccttcctattttttatcatagtcaacatcccattggcactgggaaccatcacaatcctgtgtattgacctgggaactgacatgggttcagccatctctctggcttatgaaacagctgagagtgacatcatgaagcgtcagcctaggaacccatgcagggacaagctggtgaatgagaggcttatcagcattgcctatggacaaattggtatgatccaggctctgggaggattcttctcctactttgtcatcttggctgaaaatggtttcctgccctctcagctagtaggcatccgacttaactgggacgaccgcagtttaaatgacctggaagacagctatggccagcaatggacatatgaacagaggaagatcgtggagtttacatgtcacacagccttcttcgtcagtattgtggtagtgcagtgggctgatctcatcatctgcaagaccaggcgcaactctgtcttccagcagggcatgaagaacaagatcttgatctttggcctgtttgaagaaacagccctggctgccttcctgtcctactgcccaggcatggatgtggcactcaggatgtatcctttaaagcctacctggtggttttgggcatttccttatagttttctcatctttgtttacgatgaagctcgaaaactcatcctttgccggaaccctggaggttgggtggaaaaggagacatactattgatcgttggagcactttcgctcaagcccctcacattttccacttgtttcttcccccggtcattccatcctcggcaaaacacatttccagatgtcccgcccccttaaagacaagaagcgctttgaagcaattttcatcacaactgccccaaagattaaaaacagcaaaagcccctttacaactttttacatcgacctgccctctttctccccacctcctatgatactctttgcatgtgttctctcacagctgtgtacataaaccaatatatctaccaaacggcagctgcatattgtgtatgtagattcgaatgagctaatgatacaaagggagtgtctatgctctgg

SEQ ID NO: 108086 - protein, 1010 aa, Oreochromis mossambicus
MGDKDDRFPKKKKGGTKDMDALKKEVPITEHKMSVEEVCRKFQTDVVQGLTNAKAAEFLLRDGPNALTPPPTTPEWVKFCRQLFGGFSILLWTGAILCFLAYAIQAATEDEPAGDNLYLGIVLTAVVVITGCFSYFQEAKSSKIMESFKNMVPQQALVIREGEKVQVNAEEVMAGDLIEVKGGDRIPADIRVTSAHGCKVDNSSLTGESEPQSRSPDCTHDNPLETRNIAFFSTNCVEGTARGIVICTGDRTVMGRIATLTSGLETGKTPIAVEIEHFIHIITGVAVFLGVTFFILAIILGYTWLKAVIFLIGIIVANVPEGLLATVTVCLTLTAKRMAKKNCLVKNLEAVETLGSTSTICSDKTGTLTQNRMTVAHMWFDNQIHEADTTEDQSGAAFDKSSVTWLSLSRVAPLCNRAQFKPRQDSVSILKRDVAGDASESALLKCIELSCGSVRMMRDKNKKVAEIPFNPTNKYQLSIHETEDPNDNRYLLVMKGALERILDRCSTIMLQGKEQPMDEEMKEAFQNAYMELGGLGERVLGFRHLLLPEDQYPKGFAFDTDDVNFQTDNLCFVGLMSMIDPPRAAVPDAVGKCRSAGIKVIMVTGDHPITAKAIAKGVGIISEGNETVEDIAARLNIPVSQVNPRDAKACVIHGSDLKDLSQDQMDDILRNHTEIVFARTSPQQKLIIVEGCQRLGAIVAVTGDGVNDSPALKKADIGVAMGISGSDVSKQAADMILLDDNFASIVTGVEEGRLIFDNLKKSIAYTLTSNIPEITPFLFFIIVNIPLALGTITILCIDLGTDMGSAISLAYETAESDIMKRQPRNPCRDKLVNERLISIAYGQIGMIQALGGFFSYFVILAENGFLPSQLVGIRLNWDDRSLNDLEDSYGQQWTYEQRKIVEFTCHTAFFVSIVVVQWADLIICKTRRNSVFQQGMKNKILIFGLFEETALAAFLSYCPGMDVALRMYPLKPTWWFWAFPYSFLIFVYDEARKLILCRNPGGWVEKETYY

SEQ ID NO: 108087 - DNA, 2787 bp, Yarrowia lipolytica
  CDS (1)..(2787)
atggacagccacacaagcacggagggcgtgcctctgtcggagaccaacaaccgctcgcacgccacgcccagcgcgcaatattgccaaatgacggtggaagaaacgtgttccaagctgcagaccaaccccgagacgggcctcacgtccagccaagaagccatgcaccggcgagacattcacggcagcaacgagtttgcacaggaggaggaggactcgctcatcaaaaagttttttgagcagttttccgaaaacccgctgctgctgctgctgattggcgccgcggcggtgtccttcttcatgggcaaccacgacgacgccatctccatcaccctggccattctcattgtcaccaccgttggctttgtgcaggagtaccggtccgaaaaatcgctggaggccctcaacaagctcgtgccccccgaagcccatctcatccgagcaggtaacagccagaccgttctggcctcgaccctggtgcccggagatctcgtcgaattctccgtcggagatcgaatcccggccgattgccgaatcgtcaaggccgtccacctgtctatcgacgagtccaacctcactggagaaactacgcccgtcaccaaggacacaaacccagtcacaggcactccccccatcggcctcgcagatcgaaccaataccgcatacatgggcaccttggttagagacggaaacggaactggaatcgtggtaggaacaggctcccacaccgcctttggagccgtctatgacatggtgtctgaaatctccacccccaagactcccctccaagccagcatggacaacctaggaaaggacctgtccctggtttcgttcggtgtcattggtgttatctgtctgattggtatgttccagggccgagattggctggagatgttcaccattggtgtctctctagctgtcgccgccattcccgaaggtctgcccatcattgttactgtgaccctggctctaggagttctgcgaatgtcgcgacagaaggccattgtgcgaaaactgccctctgtcgagaccctgggctctgttaacgtcatctgctccgataagacaggaaccctcacacgaaaccacatgtcctgcacaacctgctggaccgtcgacatgggagatctcgctaacgctgttaccctaaagcctggccagtcccataccgaggctgatcccaaggctgtggctgctctcaagaactctgtttcccttgcaaacatgctcaaggtcggcaacctgtgtaacaacagtaagttcaatcgagaagctggccacctggttggaaacgctacggacattgctctgattgaggtcctggattactttggactcgaggatacccgagagacccgaaagcgagtcgctgaggttcccttttcgtcttctcgaaagtggatgctcacctccaccaccacgggcgactcctccacccccatgatctctgtcaagggtgccggagaggtcattgctcctttctgcgagtactactgcaagaaggacggtaagaccgcccccttcaacgacgacatgcgaaagaaagtgaccgaaattgcgtcggaaatgtctaacgatggtctccgaatcattgccttcgcctacaagcagggcaagtacgaggagggctccgaggaggcccctgagggtcttgtgtttgctggtctcatgggtctctacgatcctcctcgacccgatgtgcctcgagccatccgacgactcacaactggtggagtccgagtcgttatgatcactggagactctgctgccaccgctctttccattggtcgacgaatcggaatgcctctgatgcctgggactcaatctgtggttgagggaagcaaactggccaccatgtccgaccaggctcttgatgagtgtctccaaaccgcgtctattttcgctcgaacctctcccgaggacaagatgaagattgtcaagggcttccaacgacgaggtgatgtggttgccatgactggagacggtgtcaacgatgcccctgccctcaagcttgccgatatcggcattgccatgggccagggaggaacagatgtggccaaggaggctgccgacatgattctgactgacgacgatttcgctaccattctgtcggccatcgaggaaggtaagggtatttttaacaacattcgaaacttcatcaccttccagctgtcgacatccatggccgctctgtcaattgtcgccgtggctaccattatgggtctggagaaccccctcaatcccatgcagattctgtggatcaatattctcatggacggtcctcctgcccaatctctgggagttgagcccgtggatcctgacgtgatgaacaagcctccccgacctcgaaacgagaaggtcatgacccccgatctggttaagaaatgtgtggaggccgccgtcatcattctagtcggtacaatgcttgtctacgtcacgcagatgcaggacggcgtcatcgacaagcgagacaccactatgactttcacttgtttcgtcttctacgacatgttcaacgccctggcctgccgatctgccaccaagtccgtgtttgagattggcttcttctctaacaagatgttcctgtacgcctgtggagcatcgatcattggccagctggcagtggtgtatgtgcccttccttcagagcgtgttccagacggaggctctgtcggtgaaggatctgctgtcgctggtgctcatttcgtcctctgtgtggattctcgacgaggccaaaaagtactttttgaagtcgcgtagtacaaataactacaccaacagtgtggtctag

SEQ ID NO: 108088 - protein, 928 aa, Yarrowia lipolytica
MDSHTSTEGVPLSETNNRSHATPSAQYCQMTVEETCSKLQTNPETGLTSSQEAMHRRDIHGSNEFAQEEEDSLIKKFFEQFSENPLLLLLIGAAAVSFFMGNHDDAISITLAILIVTTVGFVQEYRSEKSLEALNKLVPPEAHLIRAGNSQTVLASTLVPGDLVEFSVGDRIPADCRIVKAVHLSIDESNLTGETTPVTKDTNPVTGTPPIGLADRTNTAYMGTLVRDGNGTGIVVGTGSHTAFGAVYDMVSEISTPKTPLQASMDNLGKDLSLVSFGVIGVICLIGMFQGRDWLEMFTIGVSLAVAAIPEGLPIIVTVTLALGVLRMSRQKAIVRKLPSVETLGSVNVICSDKTGTLTRNHMSCTTCWTVDMGDLANAVTLKPGQSHTEADPKAVAALKNSVSLANMLKVGNLCNNSKFNREAGHLVGNATDIALIEVLDYFGLEDTRETRKRVAEVPFSSSRKWMLTSTTTGDSSTPMISVKGAGEVIAPFCEYYCKKDGKTAPFNDDMRKKVTEIASEMSNDGLRIIAFAYKQGKYEEGSEEAPEGLVFAGLMGLYDPPRPDVPRAIRRLTTGGVRVVMITGDSAATALSIGRRIGMPLMPGTQSVVEGSKLATMSDQALDECLQTASIFARTSPEDKMKIVKGFQRRGDVVAMTGDGVNDAPALKLADIGIAMGQGGTDVAKEAADMILTDDDFATILSAIEEGKGIFNNIRNFITFQLSTSMAALSIVAVATIMGLENPLNPMQILWINILMDGPPAQSLGVEPVDPDVMNKPPRPRNEKVMTPDLVKKCVEAAVIILVGTMLVYVTQMQDGVIDKRDTTMTFTCFVFYDMFNALACRSATKSVFEIGFFSNKMFLYACGASIIGQLAVVYVPFLQSVFQTEALSVKDLLSLVLISSSVWILDEAKKYFLKSRSTNNYTNSVV

SEQ ID NO: 108089 - DNA, 2727 bp, Salmonella typhimurium
  CDS (1)..(2727)
atgactgacatgaacattgaaaaccggaaactcaatcgcccggcgtcagaaaatgataagcagcataaaaaagtatttccgatcgaagcggaagcttttcatagcccggaggagacactggcgcggctgaacagccatcgtcagggcctcacgatagaagaggccagcgaacggttgaaagtgtatgggcgcaatgaagtggcgcatgagcaagttcctccggcgctgattcagcttctgcaggcattcaataacccgtttatttacgttctgatggcattggcaggggttagtttcatcacggattactggctcccgttacgccgtggcgaagagaccgatctcactggtgtgctgattattctgacgatggtcagtttgagcgggttattgcgtttctggcaggagtttcgcactaacagagcagcacaggcgctgaaaaagatggttcgcaccaccgccacggtgttgcgtcgtgggccgggcaatataggcgcggtgcaggaagagattcccattgaagaactggtgccgggcgatgtggtttttctggccgcaggcgatctggtgcccgccgacgttcgactgctggcgtcgcgcgatctctttatcagtcagtcaattcttagtggtgaatcattacccgtagaaaaatacgatgttatggctgatgtggcaggtaaagacagcgagcaattgcctgataaagataaaagcctgctagatttgggcaatatctgtctgatgggaaccaatgtaaccagcggcagagcgcaagcggtcgtggttgcgacgggaagccgtacctggttcggctcgctggcgaaatccattgtgggtacgcgtacccagacggctttcgatcgcggagtcaacagcgtgagctggctgttgatacgctttatgctgatcatggtgccggttgtcctgctgatcaatgggttcagtaagggagactgggtagaggcttcgctgttcgcgctggcagttgcggtggggttgacgccggaaatgttgcccatgattgtcagttccaacctggcaaaaggcgcgattgcgatgtcgcggcgcaaagtgatcgtcaagcgcctgaacgctattcaaaacttcggcgcgatggatgtgctgtgtacagataaaaccggcaccttaacccaggacaatatttttctggagcatcatctggatgtgagcggtgtaaaaagcagccgggtattgatgctggcctggctgaatagtagcagccagagcggcgcccggaatgtgatggatcgcgccatactgcgttttggcgagggtcgaatcgcaccatcgacaaaagcgcgcttcattaaacgcgatgaactgccattcgactttgtacgtcgccgggtatcggtcctggtggaggatgcgcagcatggagacagatgcctgatctgcaaaggcgccgttgaagagatgatgatggtagccacccatcttcgcgaaggcgatcgtgtggtggcgctgacggaaacacgccgcgagctactgctggcgaaaaccgaagattacaatgcgcagggattccgtgtattgctgatagcgacacgtaagctggatggttccgggaacaatccgacattaagtgtggaggatgagaccgaacttaccatcgaagggatgctcacttttctcgatccgccgaaagaaagcgccggaaaagctattgccgcgttgcgggataacggcgtggcggtcaaagtcctcaccggcgataatccggttgtgacggcgcgtatctgtctggaagtgggtattgatacgcacgatatcctgaccggaacccaggttgaggcgatgtcagatgccgaactggcgtctgaggtggagaaacgcgcagtattcgcccggctgacgccgttacaaaaaacgcgtattttgcaagcgctacagaaaaatggtcataccgttggttttcttggggatgggatcaacgacgcgcccgcgcttcgtgatgcggatgtggggatttccgtcgatagcgccgccgatattgctaaagagtcatcagatattattctgctggaaaaagatctcatggtgcttgaggaaggcgttatcaaagggcgggaaacctttggcaatatcattaaatatctgaatatgaccgccagctctaatttcggcaatgttttttcggtactggtagccagcgcgtttattccgtttctgccgatgctggcgattcatctgttgatccagaatttgatgtacgacatttcgcagttgtcgttgccgtgggacaaaatggataaagagttcctgcgtaagccgcggaaatgggacgcgaaaaatattggtcgttttatgctatggattggcccaacgtcttctattttcgatatcacaacctttgcgctgatgtggtacgtctttgcggctaataacgtagaggcgcaggcgctctttcagtccggctggtttattgagggtctgctctcgcagacactggttgtgcatatgctaaggacgcagaaaataccgtttatccaaagtcgggcgacgttgccggtattattgacgaccggcttgattatggcgataggcatttatattccattctcacctctgggcgcgatggttggactggagccgctgccgctgagctacttcccgtggttggtggcgacattattgagctactgtctggtggcgcaaggcatgaagcgcttttatatcaaacgctttggccagtggttttaa

SEQ ID NO: 108090 - protein, 908 aa, Salmonella typhimurium
MTDMNIENRKLNRPASENDKQHKKVFPIEAEAFHSPEETLARLNSHRQGLTIEEASERLKVYGRNEVAHEQVPPALIQLLQAFNNPFIYVLMALAGVSFITDYWLPLRRGEETDLTGVLIILTMVSLSGLLRFWQEFRTNRAAQALKKMVRTTATVLRRGPGNIGAVQEEIPIEELVPGDVVFLAAGDLVPADVRLLASRDLFISQSILSGESLPVEKYDVMADVAGKDSEQLPDKDKSLLDLGNICLMGTNVTSGRAQAVVVATGSRTWFGSLAKSIVGTRTQTAFDRGVNSVSWLLIRFMLIMVPVVLLINGFSKGDWVEASLFALAVAVGLTPEMLPMIVSSNLAKGAIAMSRRKVIVKRLNAIQNFGAMDVLCTDKTGTLTQDNIFLEHHLDVSGVKSSRVLMLAWLNSSSQSGARNVMDRAILRFGEGRIAPSTKARFIKRDELPFDFVRRRVSVLVEDAQHGDRCLICKGAVEEMMMVATHLREGDRVVALTETRRELLLAKTEDYNAQGFRVLLIATRKLDGSGNNPTLSVEDETELTIEGMLTFLDPPKESAGKAIAALRDNGVAVKVLTGDNPVVTARICLEVGIDTHDILTGTQVEAMSDAELASEVEKRAVFARLTPLQKTRILQALQKNGHTVGFLGDGINDAPALRDADVGISVDSAADIAKESSDIILLEKDLMVLEEGVIKGRETFGNIIKYLNMTASSNFGNVFSVLVASAFIPFLPMLAIHLLIQNLMYDISQLSLPWDKMDKEFLRKPRKWDAKNIGRFMLWIGPTSSIFDITTFALMWYVFAANNVEAQALFQSGWFIEGLLSQTLVVHMLRTQKIPFIQSRATLPVLLTTGLIMAIGIYIPFSPLGAMVGLEPLPLSYFPWLVATLLSYCLVAQGMKRFYIKRFGQWF

SEQ ID NO: 108091 - DNA, 3618 bp, Drosophila melanogaster
  CDS (93)..(3218)
catttggtagtcacgacttctaaaatatcgatacgttggaattgtgtaaattttccacatccctgggaataatcgagttaaattaaaataacatggcgttaaggtcggattacgagcatgggagggcggactcttatcgagtcgccacggttatagccaccgatgacgacaatcgcacagccgatggccagtacaagtcaagacgcaagatgccggccaaagttaataaaaaggagaatttagatgatctcaaacaggagttggatatcgattttcataaaatctctcctgaggaattgtatcagcgctttcagacacatcccgaaaatggtctaagtcacgccaaggccaaggaaaacttggagcgcgatggtcccaatgcgctgacgccacccaagcagacgcccgaatgggtgaagttctgtaagaacctgttcggtggcttcgccatgttgctgtggatcggtgctattctctgctttgtggcctattctatccaggccagcaccagcgaggagccggccgacgataatttgtatctgggtattgtactttccgctgtcgtcatcgtgacgggcattttctcatactatcaggaatcgaaaagttctaagatcatggaatcgttcaagaacatggtaccccagttcgccaccgtcatccgcgagggcgagaaactcacgctgcgcgctgaggatctcgttctgggcgatgtcgttgaggtgaagttcggcgaccgtatccccgctgatatccgcatcatcgaggcgcgcaacttcaaggtggacaactcctcgctgaccggcgagtcggagccgcagtcccgcggtgccgagttcacccatgagaatccgctggagaccaagaatctggccttcttctccaccaacgccgtcgagggcactgccaagggtgtggtcatcagctgtggcgatcacaccgtcatgggccgcattgctggccttgcctccggtctagacaccggcgagacgcccattgccaaggagatccaccatttcatccaccttattaccggcgtggccgtgttcctgggcgtcaccttcttcgtgattgccttcatcctgggctaccactggctggacgctgtcatctttttgatcggtatcatcgtcgccaacgtgcccgagggtctgctggccaccgtaactgtgtgcctgacccttaccgccaagcgtatggcctcaaagaactgtctggtgaagaatctggaggccgtggagacccttggctccacatcgaccatctgctccgataagaccggcaccctcacccagaaccgaatgacggtcgcccacatgtggttcgataatcagatcatcgaggccgacacaactgaggatcagtcgggtgttcaatacgatagaaccagccctggattcaaggcgctctctcgcattgccactctctgtaaccgtgccgagttcaagggaggccaagatggcgtcccaatcctcaagaaagaagtcagtggagatgcctccgaggctgctctgctcaagtgcatggaactggctctgggcgatgtgatgaacattcgcaagcgtaataagaagattgccgaggtgcccttcaactccaccaacaaataccaagtgtccatccacgaaaccgaggataccaacgatccccgctacttgctcgtaatgaagggagcccccgaacgtatcttggagcgctgctctaccatttttatcaacggcaaggagaaggttctggacgaggagatgaaggaggcgttcaacaatgcctacatggaactcggtggactgggtgagcgcgtgctcggtttctgtgactttatgctgccatccgacaagtatcccaacggctttaagttcaacaccgacgacatcaacttccccatcgataatctgcgtttcgtcggccttatgtccatgattgatcccccacgtgctgccgtgcccgatgccgttgccaagtgccgatcggccggcatcaaggtcatcatggtcaccggcgatcacccgatcactgccaaggccatcgccaagtctgtcggtattatatccgagggcaacgagaccgtcgaggacattgcccagcgcctcaacatacccgtctctgaagtgaatccccgcgaggccaaggccgccgtcgtccatggcgctgagcttcgtgatgtgtccagcgaccagctggatgaaatcctccgctaccacaccgagatcgtcttcgcccgtacctcgccccagcagaaattgatcattgtcgagggttgccagcgcatgggagctattgtggccgtgactggtgatggtgtcaacgattctcccgctctgaagaaagccgatatcggtgttgccatgggtatagccggttccgatgtgtccaagcaggctgctgacatgattttgctggacgacaactttgcctccattgtgactggtgtggaggagggtcgcctgatcttcgacaacctgaaaaagtccatcgcctacaccctgacctccaacattcccgaaatctcgcccttcctggccttcatcctctgcgatataccactgccactgggaaccgtgacgattctttgcatcgatctgggcactgacatggtgccagccatttcattggcctacgagcatgccgaagccgatattatgaagcgtccaccacgtgaccccttcaacgataaattagtgaactcaaggttgatttcgatggcctacggacagatcggcatgatccaggccgccgccggcttctttgtgtacttcgtcatcatggctgagaacggcttcttgcccaagaaactgtttggcattcgtaagatgtgggactcaaaggctgttaacgatctaactgattcctacggtcaagaatggacctaccgcgaccgcaagaccttggagtatacctgccacacggccttcttcatctcgatcgtggttgtgcaatgggccgatctgatcatctgcaagacgcgtcgtaactcgatcttccagcagggcatgcgcaactgggctttgaactttggcctcgtctttgaaaccgtgctggccgcgttcctctcatactgcccgggcatggagaagggtctgcgcatgtaccccctgaaactcgtctggtggttcccggctattccatttgcgctggccatcttcatctatgacgagacccgtcgtttctacttgcgccgcaaccccggaggctggttggagcaggagacctactattaaacacccacactgctacactcccacacacacagccacatgcccacacacgaatgcacaccacaacaagagcaaccaggaacacccgcaaacaacacctacaaaccatggagagcaacaaatagaaatgtttatgaaccacaaaacccacaaaagcaacacaaccacagtaatagcaacagcagcagcaacggcaacaacaacagcaacagctacgtctacaacaagctacagcaagaacatattacaatatattttatttttttaatttaattatttaaagtaaacgaggataaacaaaaatgcaagcgataattattttaaacgttaagtaaatttaaattataaattaaagctaaaaataagatttaaataaagtataaatgaaaataaaacaaacaac

SEQ ID NO: 108092 - protein, 1041 aa, Drosophila melanogaster
MALRSDYEHGRADSYRVATVIATDDDNRTADGQYKSRRKMPAKVNKKENLDDLKQELDIDFHKISPEELYQRFQTHPENGLSHAKAKENLERDGPNALTPPKQTPEWVKFCKNLFGGFAMLLWIGAILCFVAYSIQASTSEEPADDNLYLGIVLSAVVIVTGIFSYYQESKSSKIMESFKNMVPQFATVIREGEKLTLRAEDLVLGDVVEVKFGDRIPADIRIIEARNFKVDNSSLTGESEPQSRGAEFTHENPLETKNLAFFSTNAVEGTAKGVVISCGDHTVMGRIAGLASGLDTGETPIAKEIHHFIHLITGVAVFLGVTFFVIAFILGYHWLDAVIFLIGIIVANVPEGLLATVTVCLTLTAKRMASKNCLVKNLEAVETLGSTSTICSDKTGTLTQNRMTVAHMWFDNQIIEADTTEDQSGVQYDRTSPGFKALSRIATLCNRAEFKGGQDGVPILKKEVSGDASEAALLKCMELALGDVMNIRKRNKKIAEVPFNSTNKYQVSIHETEDTNDPRYLLVMKGAPERILERCSTIFINGKEKVLDEEMKEAFNNAYMELGGLGERVLGFCDFMLPSDKYPNGFKFNTDDINFPIDNLRFVGLMSMIDPPRAAVPDAVAKCRSAGIKVIMVTGDHPITAKAIAKSVGIISEGNETVEDIAQRLNIPVSEVNPREAKAAVVHGAELRDVSSDQLDEILRYHTEIVFARTSPQQKLIIVEGCQRMGAIVAVTGDGVNDSPALKKADIGVAMGIAGSDVSKQAADMILLDDNFASIVTGVEEGRLIFDNLKKSIAYTLTSNIPEISPFLAFILCDIPLPLGTVTILCIDLGTDMVPAISLAYEHAEADIMKRPPRDPFNDKLVNSRLISMAYGQIGMIQAAAGFFVYFVIMAENGFLPKKLFGIRKMWDSKAVNDLTDSYGQEWTYRDRKTLEYTCHTAFFISIVVVQWADLIICKTRRNSIFQQGMRNWALNFGLVFETVLAAFLSYCPGMEKGLRMYPLKLVWWFPAIPFALAIFIYDETRRFYLRRNPGGWLEQETYY

SEQ ID NO: 108093 - DNA, 2751 bp, Ajellomyces capsulata
  CDS (1)..(2751)
atggcacactccgctgcttcgggcgccgcctccgccgcccacttcgagaagaagacccccgaggtcgcccacgaggagaagaagccgccgctccccgaggaggaggatgaggacgaggacatggacgccctcatcgaggagctcgagtcccaggatggccacatcgacattgaggacgacgaagacggcgagcctggcggtgcccgccccgtgcccgacgagctgctcaccaccgacacgcgccacggtctgaccgatgccgaagtcgtcgcccgccgcaagaagtacggcctcaaccagatgaaggaggagaaggaaaacctggtcttgaagttcctcagctacttcgtggggcccatccagttcgtcatggaggccgccgccattcttgccgccggtctcgaggactgggtcgattttggtgtcatctgcgcgcttctcctgctcaacgcctgtgtcgggttcgtccaggaattccaggctggctccatcgtcgacgaattgaagaaaaccctcgcgctcaaggcggtcgtgctccgcaatggccgtctgactgaggtcgaggcccccgaggtcgtgcccggcgatatcctccaggtcgaggagggcaccatcatccccgctgacggccgcatcgtcaccgaagaggccttcctgcaagtcgatcagtctgccatcaccggtgagtcgctggccgtcgacaagcacaagggtgatacctgctatgcgtcctctgccgtcaagcgtggtgaggccttcatggtcatcaccgccaccggagacaacaccttcgtcggccgtggccccgctcttgtcaacgccgcctccgccggcactggccatttcactgaggtgctcaacggcattggcactgttttgctcatccttgtcatcctcactctgctggtcgtctgggtttcctccttctaccgttccaactccattgtcaccattctcgagttcaccctggccatcaccatcatcggtgtccccgtcggtctccccgcggtcgtgaccaccaccatggctgtcggcgccgcttacctggccaagaagaaggccattgtccagaaactgtccgccatcgagtcccttgccggtgtggagatcctctgctccgacaagaccggtactttgacaaagaacaagctctccctcgccgagccgtactgcgtttctggcgttgaccccgaggatctgatgctgaccgcctgtctggctgcctcccgcaagaagaagggtatcgatgccatcgacaaggcgttcttgaagtctctccgctactacccccgcgccaagtccgtcctcactcagtacaaggtcctcgagttccatcccttcgaccccgtctccaagaaggtcagcgccgtcgtgctgtccccccagggcgagcgcattacctgcgtcaaaggtgcccccctctcggtcctcaagaccgtcgaggaagaccaccccatccccgacgaagtcgatagcgcctacaagaacaaagtcgccgagttcgcaacccgtggtttccgctctctcggtgttgcccgcaagcgcggtgagggttcctgggaaatccttggaatcatgccctgctccgatcctccccgccacgacaccgccaagaccatcaatgaggctaagacgctcggtttgtccatcaagatgttgaccggtgacgcggtcggtatcgcccgtgaaacttctcgccagctcggtctcggaaccaatgtttacaacgctgagcgtcttggtctcggcggcggcggaaccatgcctggctcggaggtgtacgatttcgttgaggccgccgatggtttcgcggaggttttcccccagcacaagtacaacgtcgtcgagatcctgcaacagcgtggttacctcgtcgccatgacgggtgacggtgtcaacgacgccccatccctcaagaaggccgacaccggtatcgccgtcgagggtgcctccgacgccgcccgctccgccgccgacatcgtcttcctcgcccccggtctctctgccatcatcgacgcgctcaagacctcccgtcagatcttccaccgcatgtacgcctacgtcgtctaccgtattgccctgtctctccacttggaaatcttcctgggtctctggatcgccattctcaacacatccctcaacctccagcttgtcgtcttcatcgccatcttcgctgatatcgccaccctcgccatcgcctacgacaacgcccctttctccaagacgcccgtcaagtggaacctgcccaagctatggggaatgtccgtcctcctcggcatcgtcctcgccgtcggcacctggatcaccctcacaaccatgctcgtcggttccgagaacggcggtatcgtccagaacttcggtcgaacgcacccggtcctcttcctcgaaatctccctgaccgagaactggctcatcttcatcacccgcgcgaacgggcccttttggtcctcgatcccgtcgtggcaactgtccggtgccatcctgctcgtcgacatcatcgccaccttgttcacgatcttcggttggttcgtgggtgggcagacgtccatcgtcgccgtggttcgcatttgggttttctcgtttggctgcttctgcgtccttggtggactgtattatctgctccaaggctcggcgggctttgacaacatgatgcatgggaagagtccgaagaagaatcagaaacagagatcattggaggatttcgttgtttcactccaacgagtctccacacaacacgagaagagctcatga

SEQ ID NO: 108094 - protein, 916 aa, Ajellomyces capsulata
MAHSAASGAASAAHFEKKTPEVAHEEKKPPLPEEEDEDEDMDALIEELESQDGHIDIEDDEDGEPGGARPVPDELLTTDTRHGLTDAEVVARRKKYGLNQMKEEKENLVLKFLSYFVGPIQFVMEAAAILAAGLEDWVDFGVICALLLLNACVGFVQEFQAGSIVDELKKTLALKAVVLRNGRLTEVEAPEVVPGDILQVEEGTIIPADGRIVTEEAFLQVDQSAITGESLAVDKHKGDTCYASSAVKRGEAFMVITATGDNTFVGRGPALVNAASAGTGHFTEVLNGIGTVLLILVILTLLVVWVSSFYRSNSIVTILEFTLAITIIGVPVGLPAVVTTTMAVGAAYLAKKKAIVQKLSAIESLAGVEILCSDKTGTLTKNKLSLAEPYCVSGVDPEDLMLTACLAASRKKKGIDAIDKAFLKSLRYYPRAKSVLTQYKVLEFHPFDPVSKKVSAVVLSPQGERITCVKGAPLSVLKTVEEDHPIPDEVDSAYKNKVAEFATRGFRSLGVARKRGEGSWEILGIMPCSDPPRHDTAKTINEAKTLGLSIKMLTGDAVGIARETSRQLGLGTNVYNAERLGLGGGGTMPGSEVYDFVEAADGFAEVFPQHKYNVVEILQQRGYLVAMTGDGVNDAPSLKKADTGIAVEGASDAARSAADIVFLAPGLSAIIDALKTSRQIFHRMYAYVVYRIALSLHLEIFLGLWIAILNTSLNLQLVVFIAIFADIATLAIAYDNAPFSKTPVKWNLPKLWGMSVLLGIVLAVGTWITLTTMLVGSENGGIVQNFGRTHPVLFLEISLTENWLIFITRANGPFWSSIPSWQLSGAILLVDIIATLFTIFGWFVGGQTSIVAVVRIWVFSFGCFCVLGGLYYLLQGSAGFDNMMHGKSPKKNQKQRSLEDFVVSLQRVSTQHEKSS

SEQ ID NO: 108095 - DNA, 2700 bp, Kluyveromyces lactis
  CDS (1)..(2700)
atgtcagctgccactgaaccaaccaaggaaaagcctgttaacaaccaggactccgatgatgaagatgaagatatcgatcaattgatcgaagacttgcaatctcatcacggattagacgatgaaagtgaagatgatgagcatgttgctgctggttccgctagaccggttccagaagaattattacaaactgacccatcttacggtttgacttctgatgaagttaccaagagaagaaagaagtatggtttgaatcaaatgtctgaagaaactgaaaacctatttgtcaagtttttgatgttcttcatcggtccaattcaatttgttatggaagccgctgctattttagctgccggtttggaagattgggtcgatttcggtgttatctgtggtttattgtttttgaacgctgctgttggtttcatccaagaataccaagctggttctatcgttgacgaattgaagaagactttggctaactctgccgttgttatcagagatggtaacttggttgaagttccatctaacgaagtcgttccaggtgatatcttgcaattggaagatggtgttgttattccagccgatggtcgtttggtcactgaagactgtttcatccaaatcgatcaatctgctatcactggtgaatctttggccgtcgacaagagattcggtgactccactttctcttcttctactgttaagagaggtgaagctttcatgatcgttactgctactggtgactccactttcgtcggtagagctgctgctttggttaacaaggctgctgctggtagtggtcatttcactgaagttttgaacggtattggtacgatcttgttgatcttggttattgttaccttgttgctcgtttgggttgcctccttctacagaactaacaagattgttagaattttgagatacactttggctatcaccattgtcggtgtcccagtcggtttgccagctgtcgttaccaccaccatggctgtcggtgctgcttacttggctaagaaacaagccattgtccaaaaattgtctgccattgaatctttggctggtgtcgaaatcttgtgttctgacaagaccggtactttgaccaagaacaagttgtccttacatgaaccttacactgttgaaggtgttgacccagatgacttgatgttgactgcttgtttggctgcttctagaaagaagaagggtttggatgccattgacaaggctttcttgaaatctttgatctcttacccaagagccaaggctgctttgactaagtacaagttgttggaattccacccattcgaccctgtttccaagaaggttaccgctattgtcgaatctccagaaggtgaaagaatcatttgtgttaagggtgctccattgttcgtcttgaagactgttgaagaagaacatccaattccagaagatgtccgtgaaaactacgaaaacaaggttgctgaattggcttccagaggtttcagagccttgggtgttgccagaaagagaggtgaaggtcactgggaaattttgggtgttatgccatgtatggatcctccaagagatgacactgctcaaactgtcaacgaagctagacacttgggtttgagagttaagatgttaactggtgacgctgtcggtattgctaaggaaacttgtagacaattgggtttgggtactaacatttacaacgctgaaagattaggtctaggtggtggtggtgacatgccaggttccgaattggccgatttcgttgaaaatgctgatggtttcgctgaagttttcccacaacacaagtacaacgtcgttgaaatcttgcaacaaagaggttacttggttgctatgactggtgacggtgttaacgatgccccatctttgaagaaggctgataccggtattgctgtcgaaggtgctaccgatgccgctagatccgctgctgatattgttttcttggccccaggtttgtccgctattattgacgctttgaagacctctagacaaattttccacagaatgtactcttacgtcgtttaccgtatcgctttgtccctacatttggaaatcttcttgggtctatggattgctatcttgaacagatctttgaacattgacttggttgtcttcattgctattttcgctgatgttgctaccttggctattgcttacgataatgctccatactctccaaagcctgtcaagtggaacttgagaagactatggggtatgtccgtcatcttgggtataattttggctatcggtacttggatcaccttgaccactatgtttgttccaaagggtggtattatccaaaacttcggttccatcgatggtgttttgttcttgcaaatctccttgactgaaaactggttgattttcatcaccagagctgctggtccattctggtcctctatcccatcttggcaattatctggtgccgttctaatcgttgatatcatcgcaaccatgttctgtttgttcggttggtggtctcaaaactggaacgacatcgttaccgttgtcagagtctggattttctctttcggtgtcttctgtgtcatgggtggtgcttactacatgatgtctgaatctgaagcctttgacagattcatgaacggtaagtctagaagagacaagccatctggcagatccgtcgaagatttcttgatggctatgcaaagagtctccactcaacacgaaaaggaaaactaa

SEQ ID NO: 108096 - protein, 899 aa, Kluyveromyces lactis
MSAATEPTKEKPVNNQDSDDEDEDIDQLIEDLQSHHGLDDESEDDEHVAAGSARPVPEELLQTDPSYGLTSDEVTKRRKKYGLNQMSEETENLFVKFLMFFIGPIQFVMEAAAILAAGLEDWVDFGVICGLLFLNAAVGFIQEYQAGSIVDELKKTLANSAVVIRDGNLVEVPSNEVVPGDILQLEDGVVIPADGRLVTEDCFIQIDQSAITGESLAVDKRFGDSTFSSSTVKRGEAFMIVTATGDSTFVGRAAALVNKAAAGSGHFTEVLNGIGTILLILVIVTLLLVWVASFYRTNKIVRILRYTLAITIVGVPVGLPAVVTTTMAVGAAYLAKKQAIVQKLSAIESLAGVEILCSDKTGTLTKNKLSLHEPYTVEGVDPDDLMLTACLAASRKKKGLDAIDKAFLKSLISYPRAKAALTKYKLLEFHPFDPVSKKVTAIVESPEGERIICVKGAPLFVLKTVEEEHPIPEDVRENYENKVAELASRGFRALGVARKRGEGHWEILGVMPCMDPPRDDTAQTVNEARHLGLRVKMLTGDAVGIAKETCRQLGLGTNIYNAERLGLGGGGDMPGSELADFVENADGFAEVFPQHKYNVVEILQQRGYLVAMTGDGVNDAPSLKKADTGIAVEGATDAARSAADIVFLAPGLSAIIDALKTSRQIFHRMYSYVVYRIALSLHLEIFLGLWIAILNRSLNIDLVVFIAIFADVATLAIAYDNAPYSPKPVKWNLRRLWGMSVILGIILAIGTWITLTTMFVPKGGIIQNFGSIDGVLFLQISLTENWLIFITRAAGPFWSSIPSWQLSGAVLIVDIIATMFCLFGWWSQNWNDIVTVVRVWIFSFGVFCVMGGAYYMMSESEAFDRFMNGKSRRDKPSGRSVEDFLMAMQRVSTQHEKEN

SEQ ID NO: 108097 - DNA, 2856 bp, Triticum aestivum
  CDS (1)..(2856)
atgggcgggctcgaggagatcaggaacgaggccgtcgatctggagaacatccccatcgaggaggtgttcgagcagctgaaatgcacacgccaggggctcacctccgatgagggggcgcagcgtgttgaaatcttcggcctcaacaagctcgaagagaagaaggagagcaaagtcctcaagttcctgggattcatgtggaacccactctcctgggtcatggagatggccgccatcatggccatcgcgctggccaacggtggtgggaagcccccggattggcaggatttcgttggaatcattgttctcctggtcatcaactccaccatctccttcattgaagagaacaacgccggcaacgcagctgctgcgctcatggccaaccttgcgcccaagacaaaggtgcttagggatggtcgatggggcgagcaggaggcatcaatcttggttcctggtgacattgtcagcatcaagctcggtgacatcgtccctgctgatgctcgtctcctcgagggtgatcctttgaagattgatcagtctggacttacaggagagtctctcccggtgaccaagaaccctggggatgaggtcttttctggatcaacatgcaagcagggtgagattgaggctgtggtcattgccactggagtacacactttctttggcaaggctgctcatcttgttgacagcaccaaccaagtcgggcacttccagcaggtcctcactgccatcggaaacttctgcatcgtctcgattgcagtgggaattgtcattgagatcatcgtcatgttcccgatccagcgccgcaagtaccgtgccggtattgagaacctgttggtcctcttgatcggtggtattccgattgccatgcctacagttttgtcggtcaccatggctattggttcccacaagttgtcccagcagggtgctatcaccaagaggatgactgccattgaagagttggctggcatggatgtgctttgcagtgataagactggcacactcacccttaacaagctcagtgttgacaagaacctggttgaggtgtttgcgaaaggtgtcgacaaagaacatgtgctgttgttggctgcaagggcttcaagggttgaaaaccaggatgcaattgatgcttgcatggttggtatgcttgctgatcctaaggaggcaagagctggcatcagggaagtgcacttcttgccattcaaccctactgacaagaggactgctctgacttacatcgatgctgagggtaactggcaccgtgccagcaagggtgctcctgagcagattattaccctctgcaactgcaaggaggatgtgaagagaaaggtgcactctgtgattgagaagtatgctgagcgtgggcttcgttcgcttgctgttgcgagacaggaagtacccgagaaatccaaggattctcctggtggaccatggcaattcattggtctgttgcccctgtttgaccccccaaggcatgacagtgctgagaccatccgcaaggcacttgttcttggtgtcaacgtcaagatgatcacaggtgaccaacttgctattggaaaggagactggtaggaggcttgggatgggcacaaacatgtatccttcttctgcattgcttggccaaagcaaggacggttcacttgagtcacttcctgttgatgagctgattgagaaggctgatggatttgccggagtcttccctgagcacaagtatgagattgtgaagaggctgcaagagaagaagcacattgttggtatgactggcgatggtgtcaatgatgctcctgctcttaagaaggccgacattggtattgctgtcgatgatgctacagatgctgctcgaagtgcttcagacattgtgcttaccgagccaggtctcagtgtcattatcagtgctgtcctgaccagcaggtgcatttttcagaggatgaagaactacacgatctatgcagtttccatcaccatccgtattgtgcttggctttatgcttattgccctgatctggaaatttgatttcgctcccttcatggtccttatcattgccattctcaatgatggtactatcatgacaatatccaaggacagagttaagccatctcccttgcccgacagctggaagctcaatgaaatcttcgccactggtgttgtgctgggaacctaccttgctctggtgactgtcgtcttcttctggctcatccacaagacagacttcttcaccaacaaattcggtgtcgagtcaatcaggaacaccgaatttaaggagatgtctgcactgtacctccaagtcagtattgtgagccaggctcttatctttgtgactcgttcccgtagctggtcctttgttgagcgcccaggtttcctcttggttaccgccttcctcctcgcacaattggttgcaacactcatcgctgtctatgccaactgggacttcgcaaggatcaagggaatcgggtggggctgggctggtgttatctggctgttcagcattgtgttctacttcccactcgacattttcaagttcttcatccgatttgtgctgagtggaagggcctgggacaacctcctgcagaacaagactgctttcaccaccaaagagaactacggcaaaggggagagggaagcacaatgggctaccgcacagagaacactccatggccttcaagcaccggagccggcctcccacacactgttcaacgacaagagcagctaccgtgagctctctgagatcgctgagcaagcaaagagaagagctgagattgcaaggttgagggagctcaacacactcaagggccacgttgaatccgtggtgaagctcaagggccttgacatcgacaccatcaaccagaactacaccgtgtga

SEQ ID NO: 108098 - protein, 951 aa, Triticum aestivum
MGGLEEIRNEAVDLENIPIEEVFEQLKCTRQGLTSDEGAQRVEIFGLNKLEEKKESKVLKFLGFMWNPLSWVMEMAAIMAIALANGGGKPPDWQDFVGIIVLLVINSTISFIEENNAGNAAAALMANLAPKTKVLRDGRWGEQEASILVPGDIVSIKLGDIVPADARLLEGDPLKIDQSGLTGESLPVTKNPGDEVFSGSTCKQGEIEAVVIATGVHTFFGKAAHLVDSTNQVGHFQQVLTAIGNFCIVSIAVGIVIEIIVMFPIQRRKYRAGIENLLVLLIGGIPIAMPTVLSVTMAIGSHKLSQQGAITKRMTAIEELAGMDVLCSDKTGTLTLNKLSVDKNLVEVFAKGVDKEHVLLLAARASRVENQDAIDACMVGMLADPKEARAGIREVHFLPFNPTDKRTALTYIDAEGNWHRASKGAPEQIITLCNCKEDVKRKVHSVIEKYAERGLRSLAVARQEVPEKSKDSPGGPWQFIGLLPLFDPPRHDSAETIRKALVLGVNVKMITGDQLAIGKETGRRLGMGTNMYPSSALLGQSKDGSLESLPVDELIEKADGFAGVFPEHKYEIVKRLQEKKHIVGMTGDGVNDAPALKKADIGIAVDDATDAARSASDIVLTEPGLSVIISAVLTSRCIFQRMKNYTIYAVSITIRIVLGFMLIALIWKFDFAPFMVLIIAILNDGTIMTISKDRVKPSPLPDSWKLNEIFATGVVLGTYLALVTVVFFWLIHKTDFFTNKFGVESIRNTEFKEMSALYLQVSIVSQALIFVTRSRSWSFVERPGFLLVTAFLLAQLVATLIAVYANWDFARIKGIGWGWAGVIWLFSIVFYFPLDIFKFFIRFVLSGRAWDNLLQNKTAFTTKENYGKGEREAQWATAQRTLHGLQAPEPASHTLFNDKSSYRELSEIAEQAKRRAEIARLRELNTLKGHVESVVKLKGLDIDTINQNYTV

SEQ ID NO: 108099 - DNA, 3224 bp, Nicotiana plumbaginifolia
  CDS (66)..(2936): n means a or g or c or t/u
tattgatggtgtttttgatctgagagtgtttttgacagaaggcgaaagaacaagtttaaagaaagatgggagagaagcctgaagtgctggatgctgtcttgaaagagactgttgatttggaaaacatacccattgaggaagtttttgagaatttgagatgtacaaaggagggacttactgctactgctgcacaagagaggttgtccatttttgggtacaacaagctcgaggagaagaaggagagcaaattctcgaaatttttggggttcatgtggaaccctctctcatgggttatggaggctgctgctatcatggctattgctcttgccaacggaggaggaaagcctccggactggcaggattttgtgggtatcattacattgcttataatcaactccacaattagttttattgaggagaacaatgctggcaatgcagcagctgccctaatggctcgacttgctccgaaagccaaggtccttcgagatggaaaatggaaggaggaagatgctgctgttctcgttcctggggacataatcagtattaaactaggagatatcattccagctgatgctcgccttcttgagggcgatccgctcaaaattgatcagtctgctttgactggtgaatctcttcctgtaacaaaaggtcctggagatggtgtctactctggttccacgtgtaagcagggagagatagaagctgtagtcattgctacaggggttcataccttttttgggaaggcagctcaccttgttgacagtactaaccaagtgggacactttcagaaggttttgactgctataggaaacttctgcatctgttcaattgctgtggggatgataattgagattattgtgatgtaccctatccaacaccgcaaatatcgtcccgggatagacaatcttcttgttcttctgattggtgggattccaattgccatgccaactgttctctcagtcacgatggcaatcggttctcatcgtcttgctcaacagggcgccattacgaaaaggatgacggctatagaagagatggctggcatggatgttttgtgcagtgacaagacgggaaccctaacactgaacaagcttactgttgacaaataccttattgaggtatttgccagaggtgttgatgcagacactgtagttctaatggcagctcgagcctctcgaacagagaaccaggatgccattgatgctgctattgttgggatgttggctgatccaaaggaggcacgtgctggcattcgtgaaatacacttccttcctttcaatccaactgataaacgaacagcacttacttatcttgatggtgaaggaaaaatgcatagggtcagcaaaggtgcaccggaacagattctacatcttgcacacaacaagtcagatatagaacgtagagttcatgcagtgattgataagtttgctgagcggggtttgcgctcgcttgctgtggcatatcaggaagttccagagggaagaaaggagagcgctgggggaccatggcagttcattgctctcttacctttgtttgatccacctaggcacgacagtgctgagactataaggagggctttaaatcttggggtgaatgtcaaaatgatcacaggggatcaactggcaattggaaaagaaactgggcgccgtctgggtatgggtacaaatatgtatccttcatctgcactattgggacagactaaggatgaatctatctctgctttgccagttgatgaacttatagagaaggctgatggttttgctggtgttttccctgagcacaaatatgagattgtaaagcgcttgcaagctaggaagcatatctgtggtatgactggtgatggagtcaatgatgctcctgctctaaagaaagctgatattgggatagctgttgatgatgccactgatgcggctcgtagtgcttctgatattgtccttactgaacctggtcttagtgtcatcattagtgctgttttgaccagtcgagcaatctttcaaaggatgaaaaactacacgatatatgccgtttctatcacaatccgtattgtgcttggttttatgcttctggctctgatatggcagtttgactttccgcctttcatggtgcttatcattgcaattcttaatgatggtaccattatgacgatatcgaaggatagggtcaaaccatctccgctgcctgatagctggaaactggctgagatttttactactggagttgttcttggtggctacttggcaatgatgacggtcattttcttttgggcagcatacaaaacaaatttcttcccgcgagtttttggggtatcaacacttgagaaaacagcaactgatgattttaggaagctcgcctctgcaatttaccttcaagtaagcactatcagtcaggccctgatatttgtcacaagatctcgaagttggtcgtttatggagcgtcctgggttgttgctagtcgttgctttttttattgctcaactggttgctaccttgattgctgtttatgcaaattggagttttgctgcaattgaaggaattggctggggttgggctggagtgatctggctctacaatattgtgttctatatcccgctagatttgatnnagttcctcatccgttatgctctcagtgggaaggcctgggatcttgttattgagcaaaggattgctttcaccagaaagaaggatttcgggaaagaacagcgtgagcttcaatgggcacatgcacagagaaccctgcatggcctccaagttccagaccccaaaatatttagtgaaactaccaatttcaatgagcttaaccagttggctgaggaagcgaagaggagagctgaaattgctaggctacgtgagttgcacacactgaaaggtcatgtcgaatcagtggtgaagttgaagggtcttgacattgagacaattcagcaggcgtacaccgtttaaggggagagtgtggttgggaggtgtagttaggtgtggtcatggcagctataagatatcaatgtcatagttagttaccgtcgaaatagcatgttcatattagcttgtcttccacgttaccagtgcattataggttacttttatttttgaagttcttattttgcttcctgccttcatgtcctagctcctgtagatgtagcagtagtaacacagagtatgaacatcaagttatgccagcattctatgtctatattcgtgaaagcttttctctaatgatatttcgtgtttggc

SEQ ID NO: 108100 - protein, 956 aa, Nicotiana plumbaginifolia
  misc_feature (845)..(845): Xaa can be Ile or Met
  misc_feature (846)..(846): Xaa can be any amino acid
MGEKPEVLDAVLKETVDLENIPIEEVFENLRCTKEGLTATAAQERLSIFGYNKLEEKKESKFSKFLGFMWNPLSWVMEAAAIMAIALANGGGKPPDWQDFVGIITLLIINSTISFIEENNAGNAAAALMARLAPKAKVLRDGKWKEEDAAVLVPGDIISIKLGDIIPADARLLEGDPLKIDQSALTGESLPVTKGPGDGVYSGSTCKQGEIEAVVIATGVHTFFGKAAHLVDSTNQVGHFQKVLTAIGNFCICSIAVGMIIEIIVMYPIQHRKYRPGIDNLLVLLIGGIPIAMPTVLSVTMAIGSHRLAQQGAITKRMTAIEEMAGMDVLCSDKTGTLTLNKLTVDKYLIEVFARGVDADTVVLMAARASRTENQDAIDAAIVGMLADPKEARAGIREIHFLPFNPTDKRTALTYLDGEGKMHRVSKGAPEQILHLAHNKSDIERRVHAVIDKFAERGLRSLAVAYQEVPEGRKESAGGPWQFIALLPLFDPPRHDSAETIRRALNLGVNVKMITGDQLAIGKETGRRLGMGTNMYPSSALLGQTKDESISALPVDELIEKADGFAGVFPEHKYEIVKRLQARKHICGMTGDGVNDAPALKKADIGIAVDDATDAARSASDIVLTEPGLSVIISAVLTSRAIFQRMKNYTIYAVSITIRIVLGFMLLALIWQFDFPPFMVLIIAILNDGTIMTISKDRVKPSPLPDSWKLAEIFTTGVVLGGYLAMMTVIFFWAAYKTNFFPRVFGVSTLEKTATDDFRKLASAIYLQVSTISQALIFVTRSRSWSFMERPGLLLVVAFFIAQLVATLIAVYANWSFAAIEGIGWGWAGVIWLYNIVFYIPLDLXXFLIRYALSGKAWDLVIEQRIAFTRKKDFGKEQRELQWAHAQRTLHGLQVPDPKIFSETTNFNELNQLAEEAKRRAEIARLRELHTLKGHVESVVKLKGLDIETIQQAYTV

SEQ ID NO: 108101 - DNA, 26 bp, Artificial sequence
  primer
atgtttaaagaaatttttacccggct

SEQ ID NO: 108102 - DNA, 22 bp, Artificial sequence
  primer
ttattgccagccgtaacgacgg

SEQ ID NO: 108103 - protein, 188 aa, Artificial sequence
  Variant (2)..(15): xaa in position 2 to 15 is any amino acid
  Variant (17)..(25): xaa in position 17 to 25 is any amino acid
  Variant (27)..(35): xaa in position 27 to 35 is any amino acid
  Variant (37)..(37): xaa in position 37 is any amino acid
  Variant (39)..(39): xaa in position 39 is any amino acid
  Variant (41)..(72): xaa in position 41 to 72 is any amino acid
  Variant (74)..(74): xaa in position 74 is any amino acid
  Variant (77)..(82): xaa in position 77 to 82 is any amino acid
  Variant (85)..(86): xaa in position 85 to 86 is any amino acid
  Variant (90)..(90): xaa in position 90 is any amino acid
  Variant (92)..(105): xaa in position 92 to 105 is any amino acid
  Variant (107)..(112): xaa in position 107 to 112 is any amino acid
  Variant (118)..(118): xaa in position 118 is any amino acid
  Variant (120)..(121): xaa in position 120 to 121 is any amino acid
  Variant (123)..(171): xaa in position 123 to 171 is any amino acid
  Variant (173)..(177): xaa in position 173 to 177 is any amino acid
  Variant (179)..(180): xaa in position 179 to 180 is any amino acid
  Variant (183)..(184): xaa in position 183 to 184 is any amino acid
  Variant (186)..(187): xaa in position 186 to 187 is any amino acid
IXXXXXXXXXXXXXXEXXXXXXXXXLXXXXXXXXXVXRXGXXXXXXXXXXXXXXXXXXXXXXXXXXXXXXXXVXGDXXXXXXGDXXPADXRXXXXXXXXXXXXXXLXXXXXXLTGESXPXXKXXXXXXXXXXXXXXXXXXXXXXXXXXXXXXXXXXXXXXXXXXXXXXXXXGXXXXXVXXTGXXTXXG

SEQ ID NO: 108104 - protein, 53 aa, Artificial sequence
  Variant (2)..(14): xaa in position 2 to 14 is any amino acid
  Variant (16)..(33): xaa in position 16 to 33 is any amino acid
  Variant (35)..(42): xaa in position 35 to 42 is any amino acid
  Variant (44)..(44): xaa in position 44 is any amino acid
  Variant (52)..(52): xaa in position 52 is any amino acid
PXXXXXXXXXXXXXGXXXXXXXXXXXXXXXXXXEXXXXXXXXCXDKTGTLTXN

SEQ ID NO: 108105 - protein, 144 aa, Artificial sequence
  Variant (4)..(50): xaa in position 4 to 50 is any amino acid
  Variant (52)..(52): xaa in position 52 is any amino acid
  Variant (54)..(54): xaa in position 54 is any amino acid
  Variant (56)..(57): xaa in position 56 to 57 is any amino acid
  Variant (59)..(98): xaa in position 59 to 98 is any amino acid
  Variant (100)..(104): xaa in position 100 to 104 is any amino acid
  Variant (109)..(121): xaa in position 109 to 121 is any amino acid
  Variant (123)..(126): xaa in position 123 to 126 is any amino acid
  Variant (128)..(128): xaa in position 128 is any amino acid
  Variant (132)..(143): xaa in position 132 to 143 is any amino acid
KGAXXXXXXXXXXXXXXXXXXXXXXXXXXXXXXXXXXXXXXXXXXXXXXXGXRXLXXAXXXXXXXXXXXXXXXXXXXXXXXXXXXXXXXXXXXXXXXXGXXXXXDPPRXXXXXXXXXXXXXGXXXXMXTGDXXXXXXXXXXXXG

SEQ ID NO: 108106 - protein, 78 aa, Artificial sequence
  Variant (3)..(5): xaa in position 3 to 5 is any amino acid
  Variant (7)..(8): xaa in position 7 to 8 is any amino acid
  Variant (10)..(11): xaa in position 10 to 11 is any amino acid
  Variant (14)..(26): xaa in position 14 to 26 is any amino acid
  Variant (39)..(39): xaa in position 39 is any amino acid
  Variant (42)..(42): xaa in position 42 is any amino acid
  Variant (44)..(44): xaa in position 44 is any amino acid
  Variant (46)..(56): xaa in position 46 to 56 is any amino acid
  Variant (58)..(58): xaa in position 58 is any amino acid
  Variant (60)..(61): xaa in position 60 to 61 is any amino acid
  Variant (63)..(69): xaa in position 63 to 69 is any amino acid
  Variant (71)..(77): xaa in position 71 to 77 is any amino acid
FAXXXPXXKXXIVXXXXXXXXXXXXXTGDGVNDAPALKXADXGXAXXXXXXXXXXXAXDXXLXXXXXXXIXXXXXXXR

SEQ ID NO: 108107 - protein, 51 aa, Artificial sequence
  Variant (1)..(1): xaa in position 1 is Leu, Val or Ile
  Variant (2)..(2): xaa in position 2 is Val or Thr
  Variant (3)..(3): xaa in position 3 is any amino acid
  Variant (6)..(6): xaa in position 6 is Ile, Leu or Val
  Variant (7)..(7): xaa in position 7 is Val, Ile, Leu or Met
  Variant (8)..(8): xaa in position 8 is any amino acid
  Variant (9)..(9): xaa in position 9 is Leu, Ile, Val or Phe
  Variant (10)..(11): xaa in position 10 to 11 is any amino acid
  Variant (13)..(14): xaa in position 13 to 14 is any amino acid
  Variant (15)..(15): xaa in position 15 is Ile, Val or Leu
  Variant (16)..(16): xaa in position 16 is Pro, Ala, Ser or Gly
  Variant (17)..(17): xaa in position 17 is Ala, Cys or Ser
  Variant (19)..(20): xaa in position 19 to 20 is any amino acid
  Variant (21)..(21): xaa in position 21 is Leu, Ile, Val or Met
  Variant (22)..(27): xaa in position 22 to 27 is any amino acid
  Variant (28)..(36): xaa in position 28 to 36 is any or no amino acid
  Variant (37)..(37): xaa in position 37 is Val, Ile, Thr or Cys
  Variant (38)..(39): xaa in position 38 to 39 is any amino acid
  Variant (40)..(40): xaa in position 40 is Ser or Ala
  Variant (41)..(41): xaa in position 41 is any amino acid
  Variant (42)..(42): xaa in position 42 is Leu, Ile, Phe or Met
  Variant (46)..(46): xaa in position 46 is Ser, Ala, Thr or Asn
  Variant (47)..(47): xaa in position 47 is any amino acid
  Variant (48)..(48): xaa in position 48 is Pro, Ala or Ser
  Variant (49)..(50): xaa in position 49 to 50 is any amino acid
  Variant (51)..(51): xaa in position 51 is Lys, Arg or Met
XXXGDXXXXXXGXXXXXDXXXXXXXXXXXXXXXXXXXXXXXXTGEXXXXXX

SEQ ID NO: 108108 - protein, 25 aa, Artificial sequence
  Variant (1)..(1): xaa in position 1 is Phe, Tyr, Lys or Leu
  Variant (2)..(2): xaa in position 2 is any amino acid
  Variant (3)..(3): xaa in position 3 is Gly, Ser or Asn
  Variant (4)..(4): xaa in position 4 is Thr, Ser or Ala
  Variant (5)..(5): xaa in position 5 is any amino acid
  Variant (6)..(6): xaa in position 6 is Val, Cys, Ile or Ala
  Variant (7)..(8): xaa in position 7 to 8 is any amino acid
  Variant (10)..(14): xaa in position 10 to 14 is any amino acid
  Variant (15)..(15): xaa in position 15 is Val, Ala or Ile
  Variant (16)..(17): xaa in position 16 to 17 is any amino acid
  Variant (18)..(18): xaa in position 18 is Thr, Ile or Val
  Variant (19)..(19): xaa in position 19 is Gly, Ala or Ser
  Variant (20)..(21): xaa in position 20 to 21 is any amino acid
  Variant (22)..(22): xaa in position 22 is Thr or Ser
  Variant (23)..(24): xaa in position 23 to 24 is any amino acid
  Variant (25)..(25): xaa in position 25 is Gly or Ser
XXXXXXXXGXXXXXXXXXXXXXXXX

SEQ ID NO: 108109 - protein, 65 aa, Artificial sequence
  Variant (1)..(1): xaa in position 1 is Leu, Val or Ile
  Variant (2)..(2): xaa in position 2 is any amino acid
  Variant (3)..(3): xaa in position 3 is Leu, Ile, Val, Met or Phe
  Variant (4)..(4): xaa in position 4 is any amino acid
  Variant (5)..(5): xaa in position 5 is Val, Ile, Met or Ala
  Variant (6)..(6): xaa in position 6 is Ala, Gly, Ser, Val or Ile
  Variant (7)..(7): xaa in position 7 is any amino acid
  Variant (8)..(8): xaa in position 8 is Ile, Val or Thr
  Variant (10)..(10): xaa in position 10 is any amino acid
  Variant (11)..(11): xaa in position 11 is Gly, Ala, Met, Ser, Glu or Thr
  Variant (12)..(12): xaa in position 12 is Leu, Met, Ile or Phe
  Variant (13)..(15): xaa in position 13 to 15 is any amino acid
  Variant (16)..(16): xaa in position 16 is Val, Leu, Ile, Met or Thr
  Variant (17)..(17): xaa in position 17 is Thr, Ser, Ala or Asn
  Variant (18)..(19): xaa in position 18 to 19 is any amino acid
  Variant (20)..(20): xaa in position 20 is Leu, Met, Phe or Gln
  Variant (21)..(22): xaa in position 21 to 22 is any amino acid
  Variant (23)..(23): xaa in position 23 is Gly, Thr, Ala or Ser
  Variant (24)..(24): xaa in position 24 is Ala, Ser, Val, Thr, Ile or Met
  Variant (25)..(26): xaa in position 25 to 26 is any amino acid
  Variant (27)..(27): xaa in position 27 is Met, Leu or Ile
  Variant (28)..(30): xaa in position 28 to 30 is any amino acid
  Variant (31)..(33): xaa in position 31 to 33 is any or no amino acid
  Variant (34)..(34): xaa in position 34 is Ile, Leu or Val
  Variant (35)..(35): xaa in position 35 is Val, Thr, Ile or Met
  Variant (36)..(36): xaa in position 36 is Lys, Arg, Gln, Thr or Ser
  Variant (37)..(37): xaa in position 37 is any amino acid
  Variant (38)..(38): xaa in position 38 is Leu, Met or Ile
  Variant (39)..(39): xaa in position 39 is any amino acid
  Variant (40)..(40): xaa in position 40 is Ala, Ser, Thr or Ile
  Variant (41)..(41): xaa in position 41 is Val, Ile or Leu
  Variant (42)..(42): xaa in position 42 is Glu or Gln
  Variant (43)..(43): xaa in position 43 is any amino acid
  Variant (44)..(44): xaa in position 44 is Leu, Met, Phe or Ile
  Variant (45)..(45): xaa in position 45 is Gly, Ala or Ser
  Variant (46)..(46): xaa in position 46 is any amino acid
  Variant (47)..(47): xaa in position 47 is Met, Val, Thr, Ala, Cys or Ile
  Variant (48)..(48): xaa in position 48 is Asp, Ser, Thr, Asn, Glu or Gln
  Variant (49)..(49): xaa in position 49 is any amino acid
  Variant (50)..(50): xaa in position 50 is Ile, Leu or Val
  Variant (51)..(51): xaa in position 51 is Cys or Ala
  Variant (52)..(52): xaa in position 52 is Ser or Thr
  Variant (58)..(58): xaa in position 58 is Leu, Ile or Met
  Variant (60)..(60): xaa in position 60 is any amino acid
  Variant (61)..(61): xaa in position 61 is Asn, Asp or Gly
  Variant (62)..(62): xaa in position 62 is any amino acid
  Variant (63)..(63): xaa in position 63 is Met, Leu, Ile or Val
  Variant (64)..(64): xaa in position 64 is any amino acid
  Variant (65)..(65): xaa in position 65 is Val, Leu, Ile or Ala
XXXXXXXXPXXXXXXXXXXXXXXXXXXXXXXXXXXXXXXXXXXXXXXXXXXXDKTGTXTXXXXXX

SEQ ID NO: 108110 - protein, 47 aa, Artificial sequence
  Variant (1)..(1): xaa in position 1 is Gly or Ala
  Variant (2)..(5): xaa in position 2 to 5 is any amino acid
  Variant (6)..(6): xaa in position 6 is any or no amino acid
  Variant (8)..(8): xaa in position 8 is Pro, Ala or Thr
  Variant (9)..(9): xaa in position 9 is Pro, Glu, Ile, Leu or Val
  Variant (10)..(10): xaa in position 10 is Arg or Lys
  Variant (11)..(12): xaa in position 11 to 12 is any amino acid
  Variant (13)..(13): xaa in position 13 is Val, Ser, Ala or Thr
  Variant (14)..(15): xaa in position 14 to 15 is any amino acid
  Variant (16)..(16): xaa in position 16 is Ala, Thr, Ser or Leu
  Variant (17)..(17): xaa in position 17 is Ile, Val, Leu or Met
  Variant (18)..(23): xaa in position 18 to 23 is any amino acid
  Variant (24)..(24): xaa in position 24 is Gly, Ser or Asn
  Variant (25)..(25): xaa in position 25 is Ile, Val or Leu
  Variant (26)..(26): xaa in position 26 is any amino acid
  Variant (27)..(27): xaa in position 27 is Val, Pro, Thr, Ile or Leu
  Variant (28)..(28): xaa in position 28 is any amino acid
  Variant (29)..(29): xaa in position 29 is Met, Val or Ile
  Variant (30)..(30): xaa in position 30 is Ile, Leu or Val
  Variant (31)..(31): xaa in position 31 is Thr or Ser
  Variant (34)..(34): xaa in position 34 is His, Gln, Asn, Ala, Ser or Tyr
  Variant (35)..(36): xaa in position 35 to 36 is any amino acid
  Variant (37)..(37): xaa in position 37 is Thr, Ile or Val
  Variant (38)..(38): xaa in position 38 is Ala, Gly or Thr
  Variant (39)..(40): xaa in position 39 to 40 is any amino acid
  Variant (41)..(41): xaa in position 41 is Ile, Thr, Val, Met or Leu
  Variant (42)..(42): xaa in position 42 is Ala, Gly, Cys or Ser
  Variant (43)..(44): xaa in position 43 to 44 is any amino acid
  Variant (45)..(45): xaa in position 45 is Leu, Val or Ile
  Variant (46)..(46): xaa in position 46 is any amino acid
  Variant (47)..(47): xaa in position 47 is Ile, Met, Leu or Val
XXXXXXDXXXXXXXXXXXXXXXXXXXXXXXXGDXXXXXXXXXXXXXX

SEQ ID NO: 108111 - protein, 84 aa, Artificial sequence
  Variant (1)..(1): xaa in position 1 is Phe, Tyr or Ile
  Variant (2)..(2): xaa in position 2 is Ala, Ser, Tyr, Val or Thr
  Variant (3)..(3): xaa in position 3 is Arg, Gly, Lys, Glu or Gln
  Variant (4)..(5): xaa in position 4 to 5 is any amino acid
  Variant (7)..(7): xaa in position 7 is any amino acid
  Variant (8)..(8): xaa in position 8 is His, Gln, Asp, Asn or Thr
  Variant (10)..(11): xaa in position 10 to 11 is any amino acid
  Variant (12)..(12): xaa in position 12 is Ile, Val, Leu or Met
  Variant (13)..(13): xaa in position 13 is Val, Ile or Leu
  Variant (14)..(16): xaa in position 14 to 16 is any amino acid
  Variant (17)..(17): xaa in position 17 is Gln, Lys, Arg or His
  Variant (18)..(21): xaa in position 18 to 21 is any amino acid
  Variant (22)..(23): xaa in position 22 to 23 is any or no amino acid
  Variant (24)..(24): xaa in position 24 is Val, Cys, Ser or Thr
  Variant (25)..(25): xaa in position 25 is Ala, Gly, Ser or Thr
  Variant (26)..(26): xaa in position 26 is Met, Val, Phe or Tyr
  Variant (27)..(27): xaa in position 27 is Thr, Leu or Met
  Variant (31)..(31): xaa in position 31 is Val or Ile
  Variant (34)..(34): xaa in position 34 is Ala, Ser or Val
  Variant (35)..(35): xaa in position 35 is Pro, Val, Ser or Ala
  Variant (36)..(36): xaa in position 36 is Ala or Ser
  Variant (37)..(37): xaa in position 37 is Leu, Ile or Met
  Variant (38)..(38): xaa in position 38 is Lys or Arg
  Variant (39)..(39): xaa in position 39 is any amino acid
  Variant (40)..(40): xaa in position 40 is Ala or Ser
  Variant (41)..(41): xaa in position 41 is Asp, Asn, His or Glu
  Variant (42)..(42): xaa in position 42 is Ile, Val, Thr, Ala, Met or Cys
  Variant (43)..(43): xaa in position 43 is Gly or Ala
  Variant (44)..(44): xaa in position 44 is Ile, Val or Cys
  Variant (45)..(45): xaa in position 45 is Ala, Ser, Gly or Cys
  Variant (46)..(46): xaa in position 46 is Met or Val
  Variant (47)..(48): xaa in position 47 to 48 is any amino acid
  Variant (49)..(49): xaa in position 49 is any or no amino acid
  Variant (50)..(50): xaa in position 50 is Gly, Ala or Ser
  Variant (51)..(51): xaa in position 51 is Thr, Ser, Val or Ala
  Variant (52)..(52): xaa in position 52 is Asp, Glu or Ala
  Variant (53)..(53): xaa in position 53 is Val, Ala or Ile
  Variant (54)..(54): xaa in position 54 is Ala, Ser, Thr or Cys
  Variant (55)..(55): xaa in position 55 is Lys, Arg or Gln
  Variant (56)..(56): xaa in position 56 is any amino acid
  Variant (57)..(57): xaa in position 57 is Ala, Ser, Val or Thr
  Variant (58)..(58): xaa in position 58 is Ala or Ser
  Variant (59)..(59): xaa in position 59 is Asp, Ser, Glu, Ala or Lys
  Variant (60)..(60): xaa in position 60 is Ile, Met, Leu or Val
  Variant (61)..(61): xaa in position 61 is Val or Ile
  Variant (62)..(62): xaa in position 62 is Leu, Phe or Ile
  Variant (63)..(64): xaa in position 63 to 64 is any amino acid
  Variant (65)..(65): xaa in position 65 is Asp, Pro, Lys, Asn or Ser
  Variant (66)..(66): xaa in position 66 is any amino acid
  Variant (67)..(67): xaa in position 67 is Phe or Leu
  Variant (68)..(68): xaa in position 68 is any amino acid
  Variant (69)..(69): xaa in position 69 is Val, Thr, Ser, Ala or Ile
  Variant (70)..(70): xaa in position 70 is Ile, Leu or Val
  Variant (71)..(72): xaa in position 71 to 72 is any amino acid
  Variant (73)..(73): xaa in position 73 is Ala or Gly
  Variant (74)..(74): xaa in position 74 is Val, Ile, Leu or Met
  Variant (75)..(76): xaa in position 75 to 76 is any amino acid
  Variant (77)..(77): xaa in position 77 is Gly, Ser or Ala
  Variant (78)..(78): xaa in position 78 is Arg or Lys
  Variant (79)..(79): xaa in position 79 is any amino acid
  Variant (80)..(80): xaa in position 80 is Ile, Val or Thr
  Variant (81)..(82): xaa in position 81 to 82 is any amino acid
  Variant (83)..(83): xaa in position 83 is Asn or Arg
  Variant (84)..(84): xaa in position 84 is Ile, Met, Leu, Thr or Ala
XXXXXPXXKXXXXXXXXXXXXXXXXXXGDGXNDXXXXXXXXXXXXXXXXXXXXXXXXXXXXXXXXXXXXXXXXXXXXXXXXXXX

SEQ ID NO: 108112 - DNA, 2253 bp, Escherichia coli K12
  CDS (1)..(2253): transl_table=11
gtgctgatttacgcatggaaagcgggacgtaacacctggtggtttgcagccacgttaacggtgctggggctatttgtcgttttaaatatcaccctgtttgccagcgactattttactggcgatggtattaacgacgcggttctctataccttaaccaacagcctgaccggtgctggcgtcagcaaatacattttgccgggtatcggcattgtgctggggctgacagcggtgttcggtgcgctgggctggatcctgcgccgtcgtcgccatcatccgcaccattttggttacagcctgctggcgctcttactggcgctgggttcggtggacgccagcccggcatttcgtcagataacggaactggtgaaatcccagtcacgcgacggcgacccggactttgcggcttattataaagagccgtcgaaaactatccctgacccgaaactcaacctggtttatatctacggcgaaagtctcgagcggacctattttgataacgaggctttcccggatctcacgcctgaactgggcgcgttgaaaaatgaaggcctggatttcagccacacgcagcagctgccgggaacagattacacgattgcgggcatggtggcttctcagtgcggcataccgctgtttgccccctttgaaggcaacgcctccgcctctgtctccagcttcttcccgcagaacatctgtctgggagatatcctgaaaaactcgggttatcagaactatttcgtgcagggcgcgaatctgcgttttgccggtaaagatgtgttcctgaagtcgcatggcttcgaccacttatacggctcagaagagctgaaaagcgtggtagccgacccgcactatcgcaacgactggggattctacgacgataccgttctcgatgaagcgtggaaaaagtttgaagagctttcccgctcaggtcagcgattctcactgtttaccctgacagtcgatacccatcacccggatggttttatctctcgtacctgtaaccgcaaaaaatatgattttgacggtaaaccgaatcagtcattcagcgcggtaagttgcagccaggagaacatcgcgacgtttatcaacaaaatcaaagcgtcaccgtggtttaaagataccgtcatcgtcgtctcttctgaccatttagcgatgaacaacacggcgtggaaatacctcaataagcaggatcgcaataacctgttttttgtcattcgtggcgacaagccgcagcaagagacgctggcagtgaagcgtaacacgatggataacggcgcgacggtgctggacattctcggtggcgataactatctcggacttggtcgtagcagtttatccgggcagtcgatgtcggaaatcttcctcaatatcaaagagaaaacattggcgtggaagccagatatcatccgcctgtggaaattccctaaagagatgaaagagttcaccatcgaccagcagaaaaacatgattgccttctcgggtagccatttccgtttgccgctgctgttgcgggtttcagacaaacgcgtggaaccgctgccggaaagcgaatactcagcaccgctgcgtttccagctggccgatttcgctccacgcgacaatttcgtctgggttgaccgttgctacaagatggcacaactctgggctccggaactggcactttccaccgactggtgtgtctcgcaagggcagcttggcggtcagcaaattgttcagcatgttgacaaaacaacatggcagggcaaaacggcatttaaagatacggtcatcgacatggcgcgttacaaaggcaatgtcgatacgctgaagattgttgataacgatattcgctacaaagccgacagtttcatctttaacgtcgccggtgcgccagaagaggtgaaacagtttagcgggatttcccgtccggagtcgtggggccgctggtccaacgcgcagctgggcgatgaagtaaaaatcgagtacaagcatccgctgccgaagaaatttgacctggtgattaccgccaaagcatacggcaataacgccagccgtcctattccggtacgcgtaggcaatgaagaacaaactcttgtgctgggcaatgaagtgaccaccaccacactgcatttcgataacccaaccgatgccgacacactggtaattgtgccgccggaacctgtctcaaccaacgaagggaatatcctcggacactcgccgcgtaagctcgggatcggcatggtggaaattaaagtggtagaacgtgaagggtaa

SEQ ID NO: 108113 - protein, 750 aa, Escherichia coli K12
MLIYAWKAGRNTWWFAATLTVLGLFVVLNITLFASDYFTGDGINDAVLYTLTNSLTGAGVSKYILPGIGIVLGLTAVFGALGWILRRRRHHPHHFGYSLLALLLALGSVDASPAFRQITELVKSQSRDGDPDFAAYYKEPSKTIPDPKLNLVYIYGESLERTYFDNEAFPDLTPELGALKNEGLDFSHTQQLPGTDYTIAGMVASQCGIPLFAPFEGNASASVSSFFPQNICLGDILKNSGYQNYFVQGANLRFAGKDVFLKSHGFDHLYGSEELKSVVADPHYRNDWGFYDDTVLDEAWKKFEELSRSGQRFSLFTLTVDTHHPDGFISRTCNRKKYDFDGKPNQSFSAVSCSQENIATFINKIKASPWFKDTVIVVSSDHLAMNNTAWKYLNKQDRNNLFFVIRGDKPQQETLAVKRNTMDNGATVLDILGGDNYLGLGRSSLSGQSMSEIFLNIKEKTLAWKPDIIRLWKFPKEMKEFTIDQQKNMIAFSGSHFRLPLLLRVSDKRVEPLPESEYSAPLRFQLADFAPRDNFVWVDRCYKMAQLWAPELALSTDWCVSQGQLGGQQIVQHVDKTTWQGKTAFKDTVIDMARYKGNVDTLKIVDNDIRYKADSFIFNVAGAPEEVKQFSGISRPESWGRWSNAQLGDEVKIEYKHPLPKKFDLVITAKAYGNNASRPIPVRVGNEEQTLVLGNEVTTTTLHFDNPTDADTLVIVPPEPVSTNEGNILGHSPRKLGIGMVEIKVVEREG

SEQ ID NO: 108114 - DNA, 2253 bp, Salmonella typhimurium LT2
  CDS (1)..(2253): transl_table=11
gtgctgatatatgcctggaaggcgggccgtaacacctggtggtttgccgccactctcacggtgctgggactttttgtcattctgaatattaccctgtatgccagcgactattttaccggcgacgggatcaacgacgcagtgctttatacgctcacgaatagtctgacgggagcgggagtcggcaaatatattctgccgggaatcggcattgccctggcgttagtggcggtattcggcgcgctgggatgggtactacgccgccgccgtcaccatcctcatcatgtcggttacagcctgctggcgttactgctggcgttaggttcggtcgacgccagcccggcgtttcgccagattaccgaactggtaaaatcacaaatgcgcgatggcgatccggattttgccgtttattataaagaaccagcaaaaaccattcctaatccgaagctcaatctggtctatatctacggcgagagcctggaacggacctattttgataatgacgcgttccccaatctcacgccagagttgggcgcgctgaaaaatgaggggctggatttcagccataccatgcaactgccgggaacggattacaccatcgccgggatggtggcttcccagtgcggtattccgctgtttgcgccgtttgagggcaatgcgtccgcgtcggtttctagcttcttcccgcagaatatctgcctcggcgatattctgaaaaactccggctaccagaactatttcgtgcagggcgctaacctgcgttttgccgggaaagacgtgttcctgaaatcacacggatttgatcatctgtacggcgctgaagagctaaaaacggtggtggcggacccgtcttatcgtaacgactggggcttctacgacgatacggtgcttgatgaggcatggaagaaatttgaagcgctttcccgctcaggccagcgtttttcgctgtttacgctgaccgtagatactcaccacccggacgggtttatctcacgcacctgcaaccgcaaacgctacgattacgacggcaagcccaaccagtcctttagcgccgtaagttgcagccaggaaaacatcgccgagtttatcaacaaaatcaaagcgtcgccgtggtttaaagataccgttatcgtcgtctcttccgaccatctggcgatgaacaatacggcctggaaatacctgaataagcaagatcgcaacaatctgtttttcattctgcgcggcgataaaccacagcaggagactctggcggtcaaacgcaacacgatggacaacggcgcaacggtgctggatattctcggcggcgataattttatcggtctgggacgtagcagcctttccgggcagtcgctgtcggaagtgttcctgaatgtaaaagagaaagtgctggcgatgaagccggatatcattcgcctgtggaatttcccgaaagagataaaagattttaccgtcgatcgggacaaaaacatgatcgcgttttccgggagccacttccgcctgccgttactactgcgcgtatcggataagcgcgtcgagccgttaccggaaagtgaatactccgctccgctacggttccagttggccgacttcgccccgcgcgataatttcgtttggatcgatcgctgctacaaaatggcgcagctatgggcgccggcgctggcgctctctaccgactggtgcgtctcgcaggggcagcttggcgggcagcaaaccgtacagcatgttgataaagcgcagtggcagggtaagacggcgtttaaagacacgatgatcgatatggagcgctacaaaggcaacgtcgataccttaaagattgtcgataacgatattcgttataaagccgatagctttatctttaacgtggcgggcgccccggaggaggtgaagcagtttagcggcatttcccggccggagtcctgggggcgctggtcaaatgcgcagttgggcgatgaggttaaaatcgaatataaagcgccgctgccgaaaaagtttgatctggtgatcaccgccaaagccttcggcgacaacgcgaatcgaccgattccggtacgcgtaggcaacgaagaacagacgctggtgctgggtcacgatgtgtccactatcacgctgcatttcaacaacccgacggacgcgaataccttagtcattgcgccgcccgctcccgtctccaccaacgaaggtaatattttgggccattcgccgcgcaaattggggattggcatggtggagatcaaagtggtgaatgttgaaagttaa

SEQ ID NO: 108115 - protein, 750 aa, Salmonella typhimurium LT2
MLIYAWKAGRNTWWFAATLTVLGLFVILNITLYASDYFTGDGINDAVLYTLTNSLTGAGVGKYILPGIGIALALVAVFGALGWVLRRRRHHPHHVGYSLLALLLALGSVDASPAFRQITELVKSQMRDGDPDFAVYYKEPAKTIPNPKLNLVYIYGESLERTYFDNDAFPNLTPELGALKNEGLDFSHTMQLPGTDYTIAGMVASQCGIPLFAPFEGNASASVSSFFPQNICLGDILKNSGYQNYFVQGANLRFAGKDVFLKSHGFDHLYGAEELKTVVADPSYRNDWGFYDDTVLDEAWKKFEALSRSGQRFSLFTLTVDTHHPDGFISRTCNRKRYDYDGKPNQSFSAVSCSQENIAEFINKIKASPWFKDTVIVVSSDHLAMNNTAWKYLNKQDRNNLFFILRGDKPQQETLAVKRNTMDNGATVLDILGGDNFIGLGRSSLSGQSLSEVFLNVKEKVLAMKPDIIRLWNFPKEIKDFTVDRDKNMIAFSGSHFRLPLLLRVSDKRVEPLPESEYSAPLRFQLADFAPRDNFVWIDRCYKMAQLWAPALALSTDWCVSQGQLGGQQTVQHVDKAQWQGKTAFKDTMIDMERYKGNVDTLKIVDNDIRYKADSFIFNVAGAPEEVKQFSGISRPESWGRWSNAQLGDEVKIEYKAPLPKKFDLVITAKAFGDNANRPIPVRVGNEEQTLVLGHDVSTITLHFNNPTDANTLVIAPPAPVSTNEGNILGHSPRKLGIGMVEIKVVNVES

SEQ ID NO: 108116 - DNA, 2253 bp, Salmonella enterica subsp. enterica serovar Paratyphi A str. ATCC
  CDS (1)..(2253): transl_table=11
gtgctgatatatgcctggaaggcgggccgtaacacctggtggtttgccgccattctcacggtgctgggactttttgtcattctgaatattaccctgtatgccagcgactattttaccggcgacgggatcaacgacgcagtgctttatacgctcacgaatagtctgacgggagcgggagtcggcaaatatattctgccgggaatcggtattgccctggcgttagtggcggtatttggcgcgctgggatgggtactacgccgccgccgtcaccatcctcatcatgtcggttacagcctgctggcgttactgctggcgttgggttcggtcgacgccagcccggcgtttcgccagattaccgaactggtaaaatcacaaatgcgcgatggcgatccggattttgccgtttattataaagaaccagcaaaaaccattcctaatccgaagctcaatctggtctatatctacggcgagagcctggaacggacctattttgataatgacgctttccccaatctcacgccagagttgggcgcgctgaaaaatgaggggctggatttcagccataccatgcaactgcctggaacggattacaccatcgctgggatggtggcttcccagtgtggtattccgctgtttgcgccgtttgagggcaatgcgtccgcgtcggtttccagcttcttcccgcagaatatctgcctcggcgatattctgaaaaactccggttaccagaactatttcgtgcagggcgctaacctgcgttttgccgggaaagacgtgttcctgaaatcacacggatttgatcatctgtatggcgctgaagagctaaaaacggtggtggcggccccgtcttatcgtaacgactggggcttctatgatgatacggtgcttgatgaggcatggaagaaatttgaagcgctttcccgctcaggccagcggttttcgctgtttacgctgaccgtagatactcaccacccggacgggtttatctcacgcacctgcaaccgcaaacgctacgattacgacggcaagcccaaccagtcctttagcgccgtaagttgcagccaggaaaacatcgctgagtttatcaacaaaatcaaagcgtcaccgtggtttaaagataccgttatcgtcgtctcttccgaccatctggcgatgaataatacggcctggaaatacctgaataagcaagatcgcaacaatctgtttttcattctgcgcggcgataaaccacagcaggagacgctggcggtcaaacgcaacacgatggacaacggcgcaacggtgctggatattctcggcggcgataattttatcggtctgggacgtagcagcctttccgggcagtcgctgtcggaagtgttcctgaatgtaaaagagaaagtgctggcgatgaagccggacatcattcgcctgtggaatttcccgaaagagataaaagattttaccgtcgatcgggacaaaaacacgatcgcgttttccggcagccacttccgcctgccattactactgcgcgtatcggataagcgtgttgaaccgttaccggaaagtgaatactccgctccgctgcggttccagttggccgacttcgccccgcgcgataatttcgtttggatcgatcgctgctacaagatggcgcagctatgggcgccggcgctggcgctctctaccgactggtgcgtctcgcaggggcagcttggcgggcagcaaaccgtacagcatgtcgataaagcgcagtggcagggtaagacggcgtttaaagacacgatgatcgatatggagcgctacaaaggcaacgtcgataccttaaagactgtcgataacgatattcgttataaagccgatagctttatctttaacgtggcgggcgcgccggaggaggtgaagcagtttagcggtatttcccggccggagtcctgggggcgctggtcaaatgcgcagttgggcgatgaggttaaaatcgaatataaagcgccgctgccgaaaaagtttgatctggtgatcaccgccaaagccttcggcgacaacgcgaatcggccgattccggtacgcgtaggcaacgaagaacagacgctggtgctgggtcacgatgtgtccactatcacgctgcatttcaacaacccgacggacgcgaataccttagtcattgcgccgcccgctcccgtctccaccaacgaaggtaatattttgggccattcgccgcgcaaattggggattggcatggtggaaatcaaagtggtgaatgttgagggttaa

SEQ ID NO: 108117 - protein, 750 aa, Salmonella enterica subsp. enterica serovar Paratyphi A str. ATCC
MLIYAWKAGRNTWWFAAILTVLGLFVILNITLYASDYFTGDGINDAVLYTLTNSLTGAGVGKYILPGIGIALALVAVFGALGWVLRRRRHHPHHVGYSLLALLLALGSVDASPAFRQITELVKSQMRDGDPDFAVYYKEPAKTIPNPKLNLVYIYGESLERTYFDNDAFPNLTPELGALKNEGLDFSHTMQLPGTDYTIAGMVASQCGIPLFAPFEGNASASVSSFFPQNICLGDILKNSGYQNYFVQGANLRFAGKDVFLKSHGFDHLYGAEELKTVVAAPSYRNDWGFYDDTVLDEAWKKFEALSRSGQRFSLFTLTVDTHHPDGFISRTCNRKRYDYDGKPNQSFSAVSCSQENIAEFINKIKASPWFKDTVIVVSSDHLAMNNTAWKYLNKQDRNNLFFILRGDKPQQETLAVKRNTMDNGATVLDILGGDNFIGLGRSSLSGQSLSEVFLNVKEKVLAMKPDIIRLWNFPKEIKDFTVDRDKNTIAFSGSHFRLPLLLRVSDKRVEPLPESEYSAPLRFQLADFAPRDNFVWIDRCYKMAQLWAPALALSTDWCVSQGQLGGQQTVQHVDKAQWQGKTAFKDTMIDMERYKGNVDTLKTVDNDIRYKADSFIFNVAGAPEEVKQFSGISRPESWGRWSNAQLGDEVKIEYKAPLPKKFDLVITAKAFGDNANRPIPVRVGNEEQTLVLGHDVSTITLHFNNPTDANTLVIAPPAPVSTNEGNILGHSPRKLGIGMVEIKVVNVEG

SEQ ID NO: 108118 - DNA, 2292 bp, Salmonella enterica subsp. enterica serovar Choleraesuis str
  CDS (1)..(2292): transl_table=11
ttgtccgagttgctctctgtcgctctgtttctcgcctctgtgctgatatatgcctggaaggcgggccgtaacacctggtggtttgccgccactctcacggtgctgggactttttgtcattctgaatattaccctgtatgccagcgactattttaccggcgacgggatcaacgacgcagtgctttatacgctcacgaatagtctgacgggagcgggagtcggcaaatatattctgccgggaatcggcattgccctggcgttagtggcggtattcggcgcgctgggatgggtactacgccgccgccgtcaccatcctcatcatgtcggttacagcctgctggcgttactgctggcgttgggttcggtcgacgccagcccggcgtttcgccagattaccgaactggtaaaatcacaaatgcgcgatggcgatccggattttgccgtttattataaagaaccagcaaaaaccattcctaatccgaagctcaatctggtctatatctacggcgagagcctggaacggacctattttgataatgacgctttccccaatctcacgccagagttgggcgcgctgaaaaatgaggggctggatttcagccataccatgcaactgccgggaacggattacaccatcgccgggatggtggcttcccagtgcggtattccgctgtttgcgccgtttgagggcaatgcctcagcgtcggtttccagcttcttcccgcagaatatttgcctcggcgatattctgaaaaactccggctaccagaactatttcgtgcagggagctaacctgcgttttgccgggaaagacgtgttcctgaaatcacacggatttgataatctgtacggcgctgaagagctaaaaacggtggtggcggacccatcttatcgtaacgactggggcttctacgacgatacggtgcttgatgaggcatggaagaaatttgaagcgctttcccgctcaggccagcgtttttcgctgtttacgctgacggtggatacccatcacccggacggttttatctcacgcacctgcaaccgcaaacgctacgattacgacggcaagcccaaccagtcctttagcgccgtaagttgcagccaggaaaacatcgccgagtttatcaacaaaatcaaagcgtcgccgtggtttaaagataccgttatcgtcgtctcttccgaccatctggcgatgaataatacggcctggaaatacctgaataagcaagatcgcaacaatctgtttttcattctgcgcggcgataaaccacagcaggagactctggcggtcaaacgcaacacgatggacaacggcgcaacggtgctggatattctcggcggcgataattttatcggtctgggacgtaacagcctttccgggcagtcgctgtcggaagtgttcctgaatgtaaaagagaaagtgctggcgatgaagccggatatcattcgcctgtggaatttcccgaaagagataaaagattttaccgtcgatcgggacaaaaacatgatcgcgttttccgggagccacttccgcctgccgttactactgcgcgtatcggataagcgcgtcgagccgttaccggaaagtgaatactccgctccgctacggttccagttggccgacttcgccccgcgcgataatttcgtttggatcgatcgctgctacaaaatggcgcagctatgggcgccggcgctggcgctctctaccgactggtgcgtctcgcaggggcagcttggcgggcagcaaaccgtacagcatgtcgataaagcgcagtggcagggtaagacggcgtttaaagacacgatgatcgatatggagcgctacaaaggcaacgtcgataccttaaagattgtcgataacgatattcgttataaagccgatagctttatctttaatgtcgcgggcgcgccggaggaggtgaagcagtttagcggcatttcccggccggagtcctgggggcgctggtcaaatgcgcagttgggcgatgaggttaaaatcgaatataaagcgccgctgccgaaaaagtttgatctggtgatcaccgccaaagccttcggcgataacgcagagcgcccgatcccggtacgcgtcggcaacgaagaacagacgctggtgctgggtcacgatgtgtccactatcacgctgcatttcaacaacccgacggatgcgaataccctagtcattgcgccgcccgctcccgtctccaccaacgaaggtaatattttgggccattcgccacgcaaattggggattggcatggtggagatcaaagtggtgaatgttgagggttaa

SEQ ID NO: 108119 - protein, 763 aa, Salmonella enterica subsp. enterica serovar Choleraesuis str
MSELLSVALFLASVLIYAWKAGRNTWWFAATLTVLGLFVILNITLYASDYFTGDGINDAVLYTLTNSLTGAGVGKYILPGIGIALALVAVFGALGWVLRRRRHHPHHVGYSLLALLLALGSVDASPAFRQITELVKSQMRDGDPDFAVYYKEPAKTIPNPKLNLVYIYGESLERTYFDNDAFPNLTPELGALKNEGLDFSHTMQLPGTDYTIAGMVASQCGIPLFAPFEGNASASVSSFFPQNICLGDILKNSGYQNYFVQGANLRFAGKDVFLKSHGFDNLYGAEELKTVVADPSYRNDWGFYDDTVLDEAWKKFEALSRSGQRFSLFTLTVDTHHPDGFISRTCNRKRYDYDGKPNQSFSAVSCSQENIAEFINKIKASPWFKDTVIVVSSDHLAMNNTAWKYLNKQDRNNLFFILRGDKPQQETLAVKRNTMDNGATVLDILGGDNFIGLGRNSLSGQSLSEVFLNVKEKVLAMKPDIIRLWNFPKEIKDFTVDRDKNMIAFSGSHFRLPLLLRVSDKRVEPLPESEYSAPLRFQLADFAPRDNFVWIDRCYKMAQLWAPALALSTDWCVSQGQLGGQQTVQHVDKAQWQGKTAFKDTMIDMERYKGNVDTLKIVDNDIRYKADSFIFNVAGAPEEVKQFSGISRPESWGRWSNAQLGDEVKIEYKAPLPKKFDLVITAKAFGDNAERPIPVRVGNEEQTLVLGHDVSTITLHFNNPTDANTLVIAPPAPVSTNEGNILGHSPRKLGIGMVEIKVVNVEG

SEQ ID NO: 108120 - DNA, 2292 bp, Salmonella typhi
  CDS (1)..(2292): transl_table=11
ttgtccgagttgctctctgtcgctctgtttctcgcctctgtgctgatatatgcctggaaggcgggccgtaacacttggtggtttgccgccactctcacggtgctgggactttttgtcattctgaatattaccctgtatgccagcgactattttaccggcgacgggatcaacgacgcagtgctttatacgctcacgaatagtctgacgggagcgggagtcggcaaatatattctgccgggaatcggcattgccctggcgttagtggcggtattcggcgcgctgggatgggtactacgccgccgccgtcaccatcctcatcatgtcggttacagcctgctggcgttactgctggcgttgggttcggtcgacgccagcccggcgtttcgccagattaccgaactggtaaaatcacaaatgcgcgatggcgatccggattttgccgtttattataaagaaccagcaaaaaccattcctcatccgaagctcaatctggtctatatctacggcgagagcctggaacggacctattttgataatgacgcgttccccaatctcacgccagagttgggcgcgctgaaaaatgaggggctggatttcagccataccatgcaactgccgggaacggattacaccatcgccgggatggtggcttcccagtgtggtattccgctgtttgcgccgtttgagggcaatgcgtccgcgtcggtttccagcttcttcccgcagaatatctgcctcggcgatattctgaaaaactccggctaccagaactatttcgtgcagggcgctaacctgcgttttgccgggaaagacgtgttcctgaaatcacacggatttgatcatctgtacggcgctgaagagctaaaaacggtggtggcggacccgtcttatcgtaacgactggggcttctacgacgatacggtgcttgatgaggcatggaagaaatttgaagcgctttcccgctcaggccagcgtttttcgctgtttacgctgaccgtagatactcaccacccggacgggtttatctcacgcacctgcaaccgtaaacgctacgattacgacggcaagcccaaccagtcctttagcaccgtaagttgcagccaggaaaacatcgccgagtttatcaacaaaatcaaagcgtcaccgtggtttaaagataccgttatcgtcgtctcttccgaccatctggcgatgaacaatacggcctggaaatacctgaataagcaagatcgcaacaatctgtttttcattctgcgcggcgataaaccgcagcaggagacgctggcggtcaaacgcaacacgatggacaacggcgcaacggtgctggatattctcggcggcgataattttatcggtctgggacgtagcagcctttccgggcagtcgctgtcggaagtgttcctgaatgtaaaagagaaagtgctggcgatgaagccggatatcattcgcctgtggaatttcccgaaagagataaaagattttaccgtcgatcgggacaaaaacatgatcgcgttttccgggagccacttccgcctgccgttactactgcgcgtatcggataagcgcgtcgagccgttaccggaaagtgaatactccgctccgctacggttccagttggccgacttcgccccgcgcgataatttcgtttggatcgatcgctgctacaaaatggcgcagctatgggcgccggcgctggcgctctctaccgactggtgcgtctcgcagggacagcttggcgggcagcaaaccgtacagcatgttgataaagcgcagtggcagggtaagacggcgtttaaagacacgatgatcgatatggagcgctacaaaggcaacgtcgataccttaaagattgtcgataacgatattcgttataaagccgatagctttatttttaatgtggcgggcgcgccggaggaggtgaagcagtttagcggcatttcccggccggagtcctgggggcgctggtcaaatgcgcagttgggcgatgaggttaaaatcgaatataaagcgccgctgccgaaaaagtttgatctggtgatcaccgccaaagccttcggcgacaacgcgaatcggccgattccggtacgcgtaggcaacgaagaacagacgctggtgctgggtcacgatgtgtccactatcacgctgcatttcaacaacccgacggacgcgaataccttagtcattgcgccgcccgctcccgtctccaccaacgaaggtaatattttgggccattcgccgcgcaaattggggattggcatggtggagatcaaagtggtgaatgttgagagttaa

SEQ ID NO: 108121 - protein, 763 aa, Salmonella typhi
MSELLSVALFLASVLIYAWKAGRNTWWFAATLTVLGLFVILNITLYASDYFTGDGINDAVLYTLTNSLTGAGVGKYILPGIGIALALVAVFGALGWVLRRRRHHPHHVGYSLLALLLALGSVDASPAFRQITELVKSQMRDGDPDFAVYYKEPAKTIPHPKLNLVYIYGESLERTYFDNDAFPNLTPELGALKNEGLDFSHTMQLPGTDYTIAGMVASQCGIPLFAPFEGNASASVSSFFPQNICLGDILKNSGYQNYFVQGANLRFAGKDVFLKSHGFDHLYGAEELKTVVADPSYRNDWGFYDDTVLDEAWKKFEALSRSGQRFSLFTLTVDTHHPDGFISRTCNRKRYDYDGKPNQSFSTVSCSQENIAEFINKIKASPWFKDTVIVVSSDHLAMNNTAWKYLNKQDRNNLFFILRGDKPQQETLAVKRNTMDNGATVLDILGGDNFIGLGRSSLSGQSLSEVFLNVKEKVLAMKPDIIRLWNFPKEIKDFTVDRDKNMIAFSGSHFRLPLLLRVSDKRVEPLPESEYSAPLRFQLADFAPRDNFVWIDRCYKMAQLWAPALALSTDWCVSQGQLGGQQTVQHVDKAQWQGKTAFKDTMIDMERYKGNVDTLKIVDNDIRYKADSFIFNVAGAPEEVKQFSGISRPESWGRWSNAQLGDEVKIEYKAPLPKKFDLVITAKAFGDNANRPIPVRVGNEEQTLVLGHDVSTITLHFNNPTDANTLVIAPPAPVSTNEGNILGHSPRKLGIGMVEIKVVNVES

SEQ ID NO: 108122 - DNA, 2292 bp, Salmonella typhimurium
  CDS (1)..(2292)
atgtccgagttgctctctgtcgctctgtttctcgcctctgtgctgatatatgcctggaaggcgggccgtaacacctggtggtttgccgccactctcacggtgctgggactttttgtcattctgaatattaccctgtatgccagcgactattttaccggcgacgggatcaacgacgcagtgctttatacgctcacgaatagtctgacgggagcgggagtcggcaaatatattctgccgggaatcggcattgccctggcgttagtggcggtattcggcgcgctgggatgggtactacgccgccgccgtcaccatcctcatcatgtcggttacagcctgctggcgttactgctggcgttaggttcggtcgacgccagcccggcgtttcgccagattaccgaactggtaaaatcacaaatgcgcgatggcgatccggattttgccgtttattataaagaaccagcaaaaaccattcctaatccgaagctcaatctggtctatatctacggcgagagcctggaacggacctattttgataatgacgcgttccccaatctcacgccagagttgggcgcgctgaaaaatgaggggctggatttcagccataccatgcaactgccgggaacggattacaccatcgccgggatggtggcttcccagtgcggtattccgctgtttgcgccgtttgagggcaatgcgtccgcgtcggtttctagcttcttcccgcagaatatctgcctcggcgatattctgaaaaactccggctaccagaactatttcgtgcagggcgctaacctgcgttttgccgggaaagacgtgttcctgaaatcacacggatttgatcatctgtacggcgctgaagagctaaaaacggtggtggcggacccgtcttatcgtaacgactggggcttctacgacgatacggtgcttgatgaggcatggaagaaatttgaagcgctttcccgctcaggccagcgtttttcgctgtttacgctgaccgtagatactcaccacccggacgggtttatctcacgcacctgcaaccgcaaacgctacgattacgacggcaagcccaaccagtcctttagcgccgtaagttgcagccaggaaaacatcgccgagtttatcaacaaaatcaaagcgtcgccgtggtttaaagataccgttatcgtcgtctcttccgaccatctggcgatgaacaatacggcctggaaatacctgaataagcaagatcgcaacaatctgtttttcattctgcgcggcgataaaccacagcaggagactctggcggtcaaacgcaacacgatggacaacggcgcaacggtgctggatattctcggcggcgataattttatcggtctgggacgtagcagcctttccgggcagtcgctgtcggaagtgttcctgaatgtaaaagagaaagtgctggcgatgaagccggatatcattcgcctgtggaatttcccgaaagagataaaagattttaccgtcgatcgggacaaaaacatgatcgcgttttccgggagccacttccgcctgccgttactactgcgcgtatcggataagcgcgtcgagccgttaccggaaagtgaatactccgctccgctacggttccagttggccgacttcgccccgcgcgataatttcgtttggatcgatcgctgctacaaaatggcgcagctatgggcgccggcgctggcgctctctaccgactggtgcgtctcgcaggggcagcttggcgggcagcaaaccgtacagcatgttgataaagcgcagtggcagggtaagacggcgtttaaagacacgatgatcgatatggagcgctacaaaggcaacgtcgataccttaaagattgtcgataacgatattcgttataaagccgatagctttatctttaacgtggcgggcgccccggaggaggtgaagcagtttagcggcatttcccggccggagtcctgggggcgctggtcaaatgcgcagttgggcgatgaggttaaaatcgaatataaagcgccgctgccgaaaaagtttgatctggtgatcaccgccaaagccttcggcgacaacgcgaatcgaccgattccggtacgcgtaggcaacgaagaacagacgctggtgctgggtcacgatgtgtccactatcacgctgcatttcaacaacccgacggacgcgaataccttagtcattgcgccgcccgctcccgtctccaccaacgaaggtaatattttgggccattcgccgcgcaaattggggattggcatggtggagatcaaagtggtgaatgttgaaagttaa

SEQ ID NO: 108123 - protein, 763 aa, Salmonella typhimurium
MSELLSVALFLASVLIYAWKAGRNTWWFAATLTVLGLFVILNITLYASDYFTGDGINDAVLYTLTNSLTGAGVGKYILPGIGIALALVAVFGALGWVLRRRRHHPHHVGYSLLALLLALGSVDASPAFRQITELVKSQMRDGDPDFAVYYKEPAKTIPNPKLNLVYIYGESLERTYFDNDAFPNLTPELGALKNEGLDFSHTMQLPGTDYTIAGMVASQCGIPLFAPFEGNASASVSSFFPQNICLGDILKNSGYQNYFVQGANLRFAGKDVFLKSHGFDHLYGAEELKTVVADPSYRNDWGFYDDTVLDEAWKKFEALSRSGQRFSLFTLTVDTHHPDGFISRTCNRKRYDYDGKPNQSFSAVSCSQENIAEFINKIKASPWFKDTVIVVSSDHLAMNNTAWKYLNKQDRNNLFFILRGDKPQQETLAVKRNTMDNGATVLDILGGDNFIGLGRSSLSGQSLSEVFLNVKEKVLAMKPDIIRLWNFPKEIKDFTVDRDKNMIAFSGSHFRLPLLLRVSDKRVEPLPESEYSAPLRFQLADFAPRDNFVWIDRCYKMAQLWAPALALSTDWCVSQGQLGGQQTVQHVDKAQWQGKTAFKDTMIDMERYKGNVDTLKIVDNDIRYKADSFIFNVAGAPEEVKQFSGISRPESWGRWSNAQLGDEVKIEYKAPLPKKFDLVITAKAFGDNANRPIPVRVGNEEQTLVLGHDVSTITLHFNNPTDANTLVIAPPAPVSTNEGNILGHSPRKLGIGMVEIKVVNVES

SEQ ID NO: 108124 - DNA, 24 bp, Artificial sequence
  primer
atgctgatttacgcatggaaagcg

SEQ ID NO: 108125 - DNA, 24 bp, Artificial sequence
  primer
ttacccttcacgttctaccacttt

SEQ ID NO: 108126 - protein, 749 aa, Artificial sequence
  Variant (146)..(146): xaa in position 146 is any amino acid
  Variant (677)..(677): xaa in position 677 is any amino acid
MLIYAWKAGRNTWWFAATLTVLGLFVILNITLYASDYFTGDGINDAVLYTLTNSLTGAGVGKYILPGIGIALALVAVFGALGWVLRRRRHHPHHVGYSLLALLLALGSVDASPAFRQITELVKSQMRDGDPDFAVYYKEPAKTIPXPKLNLVYIYGESLERTYFDNDAFPNLTPELGALKNEGLDFSHTMQLPGTDYTIAGMVASQCGIPLFAPFEGNASASVSSFFPQNICLGDILKNSGYQNYFVQGANLRFAGKDVFLKSHGFDHLYGAEELKTVVADPSYRNDWGFYDDTVLDEAWKKFEALSRSGQRFSLFTLTVDTHHPDGFISRTCNRKRYDYDGKPNQSFSAVSCSQENIAEFINKIKASPWFKDTVIVVSSDHLAMNNTAWKYLNKQDRNNLFFILRGDKPQQETLAVKRNTMDNGATVLDILGGDNFIGLGRSSLSGQSLSEVFLNVKEKVLAMKPDIIRLWNFPKEIKDFTVDRDKNMIAFSGSHFRLPLLLRVSDKRVEPLPESEYSAPLRFQLADFAPRDNFVWIDRCYKMAQLWAPALALSTDWCVSQGQLGGQQTVQHVDKAQWQGKTAFKDTMIDMERYKGNVDTLKIVDNDIRYKADSFIFNVAGAPEEVKQFSGISRPESWGRWSNAQLGDEVKIEYKAPLPKKFDLVITAKAFGDNAXRPIPVRVGNEEQTLVLGHDVSTITLHFNNPTDANTLVIAPPAPVSTNEGNILGHSPRKLGIGMVEIKVVNVE

SEQ ID NO: 108127 - DNA, 1260 bp, Saccharomyces cerevisiae
  CDS (156)..(995)
cctctttcgtactagtaactttttcaaaaaagttcacttcgctgcatgagcttggcgtaatgcgctttgagggtgataatgcattttatttccatatgaaatatgtctaaaatagaacaattcactaagaacaagaaggccaaactaagcagaatatggtagagttgacaattacgggtgatgatgatgatatattgagtatgttttttgatgaggagttcgttccccatgcattcgttgatatactcttatcaaatgccttaaacgaagatcagattcaaacgcaatcagtatcctcattgctattaaccaggttggatttttacacaaagaaccttacaaaagagttggaaagcaccatatggaatttggataaattatctcaaacgttaccaagaacttgggcatcttctaggtatcacaaagaagcagaacagaacgattcctcattgtattctactgaatccttaaaatcatcgaagcttgaatattacttagatacgttggcaagtgctgtaagagcattagaaacaggaatgcataatgtaactgagaaactaagcgatctagataacgaaaataatcgcaataccaatgtgaggcaacaactgcaaagtttaatgttgattaaggagagaattgaaaaagtggtatattacctggaacaagttaggaccgttacgaatatttcgacagttagagaaaataatacaaccagcacggggacagatctttcgataacagattttagaacatcattgaaagcattagaggatacaatcgatgaatctttaagctctgcgattgataacgaggctaaagatgaaacaaacaaggatttgattgggagaattgattcactttctgaactgaaatgtctgtttaaaggcctagataagttctttgctgagtatagcaacttttcggagagcataaaatcaaaagcacaaagttatttatcaaccaagaatattgacgatggtatgatatcataatcggtgataaaaacaaaaaatttgcaattaacaaaagaaatttatagcatgtttaaattcttatttctttttaccatttccagtccttttggtccacttgtaatgcataaaagggtaaaaaggaatttgtttaggaggacatgctatttcagatagtttctttttattgattatataatatagtgtacaattttgaaaatataactattacacacatcttttcatttggtcacttacatttgtataaacatatagagcgcgtcta

SEQ ID NO: 108128 - protein, 279 aa, Saccharomyces cerevisiae
MVELTITGDDDDILSMFFDEEFVPHAFVDILLSNALNEDQIQTQSVSSLLLTRLDFYTKNLTKELESTIWNLDKLSQTLPRTWASSRYHKEAEQNDSSLYSTESLKSSKLEYYLDTLASAVRALETGMHNVTEKLSDLDNENNRNTNVRQQLQSLMLIKERIEKVVYYLEQVRTVTNISTVRENNTTSTGTDLSITDFRTSLKALEDTIDESLSSAIDNEAKDETNKDLIGRIDSLSELKCLFKGLDKFFAEYSNFSESIKSKAQSYLSTKNIDDGMIS

SEQ ID NO: 108129 - DNA, 750 bp, Debaryomyces hansenii CBS767
  CDS (1)..(750)
atgacacaggttaacgacgaatccttatcgatgttttttgattcggattttaacccgtctaattacgttgatgctctatttcaatcaatatcaaataataagctgcaatcacagatttattcgaagaacaatctccaaagcttatcgaacaaatgctcaaatttagtaacacatcttgactaccataccagtgaattgtcaaatgatttgattagtcaaattgaaaccttacaaaattcttcaaagataatcacgcagggcttgaataacgatgaagtcttgaatgccctgaatgacatgaccagattacaatactttataaataccttgaacaattctatattattattacaaaccgatataaaacaagtcaatgaggagttgaacgtaaataatgaatcccaaccggaatcgattaatagcttaataaaattgaaaggtatcaagaataacctaaatcaagtgttggtcatttttgaaaggcttaactcaattaccatgaacaacccagattcaacaacagttgaatcatttcaaagctcacttaatacgttatacgaaactataagaaatcagttaactaatgaagagaatgaaatcaatcagcttctagtcacaaatatcaaagagctaatcaatttattaccattttttcaaaatttaacaaacttctatcctatttataaaaaatttaccaataaattaaatattgatttagatcactatttaagtacaaataagcatagctga

SEQ ID NO: 108130 - protein, 249 aa, Debaryomyces hansenii CBS767
MTQVNDESLSMFFDSDFNPSNYVDALFQSISNNKLQSQIYSKNNLQSLSNKCSNLVTHLDYHTSELSNDLISQIETLQNSSKIITQGLNNDEVLNALNDMTRLQYFINTLNNSILLLQTDIKQVNEELNVNNESQPESINSLIKLKGIKNNLNQVLVIFERLNSITMNNPDSTTVESFQSSLNTLYETIRNQLTNEENEINQLLVTNIKELINLLPFFQNLTNFYPIYKKFTNKLNIDLDHYLSTNKHS

SEQ ID NO: 108131 - DNA, 753 bp, Kluyveromyces lactis NRRL Y
  CDS (1)..(753)
atgagtagaaggatatctggtgctaatgaccctttgctagacatgtttttcgatgatgattttgtacctcaagcattcgtcgacatattgttatcatctttccagacaagccaattagaagaattgaagaccaattgctctagtctactttcaaaaatggactattacagtgggcatattacaaaagaacttgagtccactattcaggtgcttcagaagcctgctgaacttattatatacgcagcaaatgaggaacagcaaggaacaacaaaactagagtattatttggatactctagcgaatagtgtgaacttattagagacagacgttaaagctattgataaacaattagaagagctgaattctaaatatgaagacagtaatgaggtaactgaaaccttatcaaagcttacagcagctaaagagcatctggtaactgttaagagatcatttgatctattaaagaccataatggatatttcaatccaagatgatcaagaaaaactacagcatatttcgttagatgactttaaacttgcattattgacgttacaggagaccattatcattacattaaagaaacctcagaacgatgcaaccgatttgttgaagaagatagacgcatttatcgagttgaaaactgttttgaagggacttcaaaagttctatatcccatacacagaatttgcacaagctattcagaaggagaaggataattatctaaatagtaaggatacactagatgagttatga

SEQ ID NO: 108132 - protein, 250 aa, Kluyveromyces lactis NRRL Y
MSRRISGANDPLLDMFFDDDFVPQAFVDILLSSFQTSQLEELKTNCSSLLSKMDYYSGHITKELESTIQVLQKPAELIIYAANEEQQGTTKLEYYLDTLANSVNLLETDVKAIDKQLEELNSKYEDSNEVTETLSKLTAAKEHLVTVKRSFDLLKTIMDISIQDDQEKLQHISLDDFKLALLTLQETIIITLKKPQNDATDLLKKIDAFIELKTVLKGLQKFYIPYTEFAQAIQKEKDNYLNSKDTLDEL

SEQ ID NO: 108133 - DNA, 810 bp, Candida glabrata CBS138
  CDS (1)..(810)
atgagcggaactacagatatggcaagtcaggatgaagatgctgtgttgaaaatgtttttcgacgagcaatttgtgccgcaagcatttgtagatatcttgctttcgaaggctaacggtactggtctcaatgaggtaagggttgtgacgagtggcttacagtcaagacttgactactatacagaacacctaactaaggagttagaaggaactatatcttcattagagaagatatctgatacacttcctggtacatggaatacaagtgattcttatggagcagatggtaacataggatcgtctaagttagaatattacttagatacacttgccaatgcagtacgtagtcttgagtctgatatcaaaactctcaactcccaaatagatactgcagaaacagaatcagaagaacaaacacaaaaagcggctgtattgggtaggcttcgagacttcgagaaagctaaatcaaggctcaatgaagtgttactatacttcaatcaactggaggctatagctactatcactggcaagaagagcgaacaaaagattgccccaattacgataaaggacttcaaattgtcactcgatactttgcaggaaactattgtcaataccttggatgaatctgaaaagaaagagtctgccaatgagaaaaatgaggatatccttgaaaaaattgacatgttcatagagttggaaacagttctgaaagatattgacccattctaccaagaataccataagtttatagaatctattacaaagagagcaaacgagtatattaacacgaagaatattgagaatgatttatag

SEQ ID NO: 108134 - protein, 269 aa, Candida glabrata CBS138
MSGTTDMASQDEDAVLKMFFDEQFVPQAFVDILLSKANGTGLNEVRVVTSGLQSRLDYYTEHLTKELEGTISSLEKISDTLPGTWNTSDSYGADGNIGSSKLEYYLDTLANAVRSLESDIKTLNSQIDTAETESEEQTQKAAVLGRLRDFEKAKSRLNEVLLYFNQLEAIATITGKKSEQKIAPITIKDFKLSLDTLQETIVNTLDESEKKESANEKNEDILEKIDMFIELETVLKDIDPFYQEYHKFIESITKRANEYINTKNIENDL

SEQ ID NO: 108135 - DNA, 759 bp, Ashbya gossypii
  CDS (1)..(759)
atggatcgtcatgatgagattctacaaatgtttttcgatgaggaatttgtcccgcaggcatacctagatatattgctttcatccgttgatcggccattgaacgaactgcagcagatttccgcatctctactttatagattggaatactataccggagtcttgacgaaagatctggaagataccataagaaggttgcaaaagccagccgaattgttgaactattcagtcaccagcgatgatattgggaatatgaagaccacgaggttagagtattatatggatacactggccaattctgtacaatccctggaggtggatgttggaaaaatcaatacggaactcgcgcagttagacgccagctatgagactagcacgcaaagtgtggccaagatcacgcaactggagctggtaaagtcgcgactgcaagatgtgctgagtgtgttccagcagttacagataatcttgcgaatctcagttggagagaaggagggggcactccaaaatgtggatgtgaatgaatttaccgttgcattggatacactgagggacacaattattaagaaactggaagaatgcctggaatctgaaactgcgacagaaaagaacgatgaacttttgtcaagaatcgattcttttactgccttaaaggtggttttcaagggattcaacaagttttatccagtttacctgcagtttgcaaataagatacagaaggcaaaggagcattacttgtctcaaaaagtggatgaaaatatctga

SEQ ID NO: 108136 - protein, 252 aa, Ashbya gossypii
MDRHDEILQMFFDEEFVPQAYLDILLSSVDRPLNELQQISASLLYRLEYYTGVLTKDLEDTIRRLQKPAELLNYSVTSDDIGNMKTTRLEYYMDTLANSVQSLEVDVGKINTELAQLDASYETSTQSVAKITQLELVKSRLQDVLSVFQQLQIILRISVGEKEGALQNVDVNEFTVALDTLRDTIIKKLEECLESETATEKNDELLSRIDSFTALKVVFKGFNKFYPVYLQFANKIQKAKEHYLSQKVDENI

SEQ ID NO: 108137 - DNA, 24 bp, Artificial sequence
  primer
atggtagagttgacaattacgggt

SEQ ID NO: 108138 - DNA, 27 bp, Artificial sequence
  primer
ttatgatatcataccatcgtcaatatt

SEQ ID NO: 108139 - protein, 268 aa, Artificial sequence
  Variant (2)..(3): xaa in position 2 to 3 is any amino acid
  Variant (5)..(5): xaa in position 5 is any amino acid
  Variant (10)..(11): xaa in position 10 to 11 is any amino acid
  Variant (13)..(13): xaa in position 13 is any amino acid
  Variant (15)..(18): xaa in position 15 to 18 is any amino acid
  Variant (20)..(20): xaa in position 20 is any amino acid
  Variant (22)..(50): xaa in position 22 to 50 is any amino acid
  Variant (52)..(65): xaa in position 52 to 65 is any amino acid
  Variant (67)..(69): xaa in position 67 to 69 is any amino acid
  Variant (71)..(72): xaa in position 71 to 72 is any amino acid
  Variant (74)..(110): xaa in position 74 to 110 is any amino acid
  Variant (112)..(112): xaa in position 112 is any amino acid
  Variant (114)..(116): xaa in position 114 to 116 is any amino acid
  Variant (119)..(124): xaa in position 119 to 124 is any amino acid
  Variant (126)..(178): xaa in position 126 to 178 is any amino acid
  Variant (180)..(198): xaa in position 180 to 198 is any amino acid
  Variant (200)..(202): xaa in position 200 to 202 is any amino acid
  Variant (204)..(205): xaa in position 204 to 205 is any amino acid
  Variant (207)..(208): xaa in position 207 to 208 is any amino acid
  Variant (211)..(213): xaa in position 211 to 213 is any amino acid
  Variant (215)..(233): xaa in position 215 to 233 is any amino acid
  Variant (235)..(239): xaa in position 235 to 239 is any amino acid
  Variant (241)..(249): xaa in position 241 to 249 is any amino acid
  Variant (251)..(253): xaa in position 251 to 253 is any amino acid
  Variant (255)..(256): xaa in position 255 to 256 is any amino acid
  Variant (258)..(267): xaa in position 258 to 267 is any amino acid
DXXLXMFFDXXFXPXXXXDXLXXXXXXXXXXXXXXXXXXXXXXXXXXXXXLXXXXXXXXXXXXXXLXXXIXXLXXXXXXXXXXXXXXXXXXXXXXXXXXXXXXXXXXXXXLXYXXXTLXXXXXXLXXXXXXXXXXXXXXXXXXXXXXXXXXXXXXXXXXXXXXXXXXXXXXXXXXXXXIXXXXXXXXXXXXXXXXXXXFXXXLXXLXXTIXXXLXXXXXXXXXXXXXXXXXXXIXXXXXLXXXXXXXXXFXXXYXXFXXXXXXXXXXY

SEQ ID NO: 108140 - protein, 272 aa, Artificial sequence
  Variant (2)..(3): xaa in position 2 to 3 is any amino acid
  Variant (5)..(5): xaa in position 5 is any amino acid
  Variant (10)..(11): xaa in position 10 to 11 is any amino acid
  Variant (15)..(15): xaa in position 15 is any amino acid
  Variant (17)..(17): xaa in position 17 is any amino acid
  Variant (24)..(40): xaa in position 24 to 40 is any amino acid
  Variant (42)..(48): xaa in position 42 to 48 is any amino acid
  Variant (50)..(50): xaa in position 50 is any amino acid
  Variant (52)..(54): xaa in position 52 to 54 is any amino acid
  Variant (60)..(61): xaa in position 60 to 61 is any amino acid
  Variant (65)..(65): xaa in position 65 is any amino acid
  Variant (68)..(68): xaa in position 68 is any amino acid
  Variant (71)..(72): xaa in position 71 to 72 is any amino acid
  Variant (74)..(74): xaa in position 74 is any amino acid
  Variant (76)..(110): xaa in position 76 to 110 is any amino acid
  Variant (115)..(115): xaa in position 115 is any amino acid
  Variant (121)..(121): xaa in position 121 is any amino acid
  Variant (123)..(124): xaa in position 123 to 124 is any amino acid
  Variant (127)..(127): xaa in position 127 is any amino acid
  Variant (129)..(135): xaa in position 129 to 135 is any amino acid
  Variant (137)..(152): xaa in position 137 to 152 is any amino acid
  Variant (154)..(155): xaa in position 154 to 155 is any amino acid
  Variant (157)..(178): xaa in position 157 to 178 is any amino acid
  Variant (180)..(198): xaa in position 180 to 198 is any amino acid
  Variant (200)..(202): xaa in position 200 to 202 is any amino acid
  Variant (204)..(204): xaa in position 204 is any amino acid
  Variant (207)..(208): xaa in position 207 to 208 is any amino acid
  Variant (211)..(213): xaa in position 211 to 213 is any amino acid
  Variant (215)..(224): xaa in position 215 to 224 is any amino acid
  Variant (226)..(226): xaa in position 226 is any amino acid
  Variant (228)..(229): xaa in position 228 to 229 is any amino acid
  Variant (231)..(233): xaa in position 231 to 233 is any amino acid
  Variant (236)..(239): xaa in position 236 to 239 is any amino acid
  Variant (241)..(244): xaa in position 241 to 244 is any amino acid
  Variant (246)..(249): xaa in position 246 to 249 is any amino acid
  Variant (252)..(253): xaa in position 252 to 253 is any amino acid
  Variant (255)..(256): xaa in position 255 to 256 is any amino acid
  Variant (258)..(260): xaa in position 258 to 260 is any amino acid
  Variant (262)..(267): xaa in position 262 to 267 is any amino acid
  Variant (270)..(271): xaa in position 270 to 271 is any amino acid
DXXLXMFFDXXFVPXAXVDILLSXXXXXXXXXXXXXXXXXLXXXXXXXSXLXXXLDYYTXXLTKXLEXTIXXLXKXXXXXXXXXXXXXXXXXXXXXXXXXXXXXXXXXXXLEYYXDTLANXVXXLEXDXXXXXXXLXXXXXXXXXXXXXXXXLXXLXXXXXXXXXXXXXXXXXXXXXXIXXXXXXXXXXXXXXXXXXXFXXXLXTLXXTIXXXLXXXXXXXXXXEXNXXLXXXIDXXXXLXXXXKXXXXFYXXYXXFXXXIXXXXXXYLXXK

SEQ ID NO: 108141 - protein, 21 aa, Artificial sequence
  Variant (2)..(3): xaa in position 2 to 3 is any amino acid
  Variant (5)..(5): xaa in position 5 is any amino acid
  Variant (10)..(11): xaa in position 10 to 11 is any amino acid
  Variant (13)..(13): xaa in position 13 is any amino acid
  Variant (15)..(16): xaa in position 15 to 16 is any amino acid
  Variant (17)..(17): xaa in position 17 is Phe or Tyr
  Variant (18)..(18): xaa in position 18 is Val or Leu
  Variant (20)..(20): xaa in position 20 is any amino acid
DXXLXMFFDXXFXPXXXXDXL

SEQ ID NO: 108142 - protein, 32 aa, Artificial sequence
  Variant (1)..(1): xaa in position 1 is Ser or Ala
  Variant (2)..(2): xaa in position 2 is any amino acid
  Variant (4)..(6): xaa in position 4 to 6 is any amino acid
  Variant (7)..(7): xaa in position 7 is Leu or Met
  Variant (8)..(8): xaa in position 8 is Asp or Glu
  Variant (9)..(9): xaa in position 9 is Tyr or Phe
  Variant (10)..(10): xaa in position 10 is Tyr or Ser
  Variant (12)..(13): xaa in position 12 to 13 is any amino acid
  Variant (14)..(14): xaa in position 14 is Leu or Ile
  Variant (15)..(15): xaa in position 15 is Thr or Ser
  Variant (16)..(16): xaa in position 16 is any amino acid
  Variant (17)..(17): xaa in position 17 is Glu or Asp
  Variant (19)..(21): xaa in position 19 to 21 is any amino acid
  Variant (23)..(24): xaa in position 23 to 24 is any amino acid
  Variant (26)..(28): xaa in position 26 to 28 is any amino acid
  Variant (29)..(29): xaa in position 29 is Ser or Ala
  Variant (30)..(31): xaa in position 30 to 31 is any amino acid
  Variant (32)..(32): xaa in position 32 is Leu or Ile
XXLXXXXXXXTXXXXXXLXXXIXXLXXXXXXX

SEQ ID NO: 108143 - protein, 28 aa, Artificial sequence
  Variant (1)..(1): xaa in position 1 is Thr or Ser
  Variant (2)..(2): xaa in position 2 is Lys or Arg
  Variant (4)..(4): xaa in position 4 is any amino acid
  Variant (6)..(6): xaa in position 6 is Tyr or Phe
  Variant (7)..(7): xaa in position 7 is Leu, Ile or Met
  Variant (8)..(8): xaa in position 8 is any amino acid
  Variant (11)..(12): xaa in position 11 to 12 is any amino acid
  Variant (13)..(13): xaa in position 13 is Ser or Ala
  Variant (14)..(14): xaa in position 14 is Val or Ile
  Variant (15)..(16): xaa in position 15 to 16 is any amino acid
  Variant (18)..(20): xaa in position 18 to 20 is any amino acid
  Variant (21)..(21): xaa in position 21 is Ile, Met or Val
  Variant (22)..(23): xaa in position 22 to 23 is any amino acid
  Variant (24)..(24): xaa in position 24 is Ile, Val or Leu
  Variant (25)..(27): xaa in position 25 to 27 is any amino acid
  Variant (28)..(28): xaa in position 28 is Leu or Ile
XXLXYXXXTLXXXXXXLXXXXXXXXXXX

SEQ ID NO: 108144 - protein, 70 aa, Artificial sequence
  Variant (2)..(3): xaa in position 2 to 3 is any amino acid
  Variant (4)..(4): xaa in position 4 is Ser or Ala
  Variant (6)..(7): xaa in position 6 to 7 is any amino acid
  Variant (9)..(9): xaa in position 9 is any amino acid
  Variant (10)..(10): xaa in position 10 is Glu or Asp
  Variant (13)..(15): xaa in position 13 to 15 is any amino acid
  Variant (17)..(25): xaa in position 17 to 25 is any amino acid
  Variant (26)..(31): xaa in position 26 to 31 is any or no amino acid
  Variant (32)..(33): xaa in position 32 to 33 is Leu, Ile or Val
  Variant (34)..(35): xaa in position 34 to 35 is any amino acid
  Variant (37)..(41): xaa in position 37 to 41 is any amino acid
  Variant (43)..(51): xaa in position 43 to 51 is any amino acid
  Variant (53)..(53): xaa in position 53 is Tyr or Phe
  Variant (54)..(55): xaa in position 54 to 55 is any amino acid
  Variant (57)..(58): xaa in position 57 to 58 is any amino acid
  Variant (60)..(62): xaa in position 60 to 62 is any amino acid
  Variant (63)..(63): xaa in position 63 is Ile or Leu
  Variant (64)..(69): xaa in position 64 to 69 is any amino acid
FXXXLXXLXXTIXXXLXXXXXXXXXXXXXXXXXXXIXXXXXLXXXXXXXXXFXXXYXXFXXXXXXXXXXY

SEQ ID NO: 108145 - DNA, 1389 bp, Saccharomyces cerevisiae
  CDS (1)..(1389)
atgagtgacgaaaccatgcctgtagaatttttagttagtgataaaagactgttgaaaaccataaaagttaaactggaaaccaacggcctttttgttactcctatctattccgataatgataacaaagttataaaatcttctattgaggatctcaatcatccattggctgtcgaaattaacaatatagccggtgtgaaggcacgattccatgaaagtggtaacttggaacgtagtgaaggacatttgaaacaccaaagtaacagcattacggaatttacgaagagctttttaaaagatcatgggcttgctaatgacaagatatttttatctcatttattagatcatttacctctaaaatatacaatatatccaccagttgtattgttcaataattctacagtgagatcgtttaatcacccaatctggcaaaaagcattccaactgaaactcttcgatccaaatgagtattatcgtgagctgctatgtttcctttcgcccggcaaaccaagtaaaggcacgagtcttcatcctaacaatcgactactgactcatctggccataaataaccctatcacagaggcagatgtattgcgaagaccgttcaatatccaaccgctttatggcaaattgattgatgacagtattttggatgataacgataatacgttatgggaaaatcccagtcaagaacaactaaactcaagcatatggtgtaaggtcatacaaaatggtgtaacacaaatctggtcacccgtttttaccatgtttagtagagggaatatcaaggagaagaaaagagttttgactactttcccagatatttgcaataatgatgtggtcgatttatacgcaggaataggttacttcacttttagctacttaacaaagggcgctaggacactttttgcatttgaactaaacccttggagtgtagaagggttaaagcgcggcttaaaggcaaacggattcaataaatctgggaactgccacgttttccaagaatcaaatgaaatgtgcgttcaaaggcttactgaattcttatctcagaatcccggatttcggttacgtattaggcatattaatttaggtctcctgccttcaagcaaacaagggtggccattggccatcaaattaatttacttacaaggagcttctttggaaaaagtgacaatgcatatacatgaaaatgtacacatagatgcaattgaggatggaagtttcgaaaagaatgtcattgtagaactcgacgctattaatgagtcaattgcattaattagaaaccgtggcatcaaacttcagtttgtgagatctaagcttgaacgcataaaaacttttgcaccagatatttggcatgtatgcgttgatgtcgacgttatagtaagtacttaa

SEQ ID NO: 108146 - protein, 462 aa, Saccharomyces cerevisiae
MSDETMPVEFLVSDKRLLKTIKVKLETNGLFVTPIYSDNDNKVIKSSIEDLNHPLAVEINNIAGVKARFHESGNLERSEGHLKHQSNSITEFTKSFLKDHGLANDKIFLSHLLDHLPLKYTIYPPVVLFNNSTVRSFNHPIWQKAFQLKLFDPNEYYRELLCFLSPGKPSKGTSLHPNNRLLTHLAINNPITEADVLRRPFNIQPLYGKLIDDSILDDNDNTLWENPSQEQLNSSIWCKVIQNGVTQIWSPVFTMFSRGNIKEKKRVLTTFPDICNNDVVDLYAGIGYFTFSYLTKGARTLFAFELNPWSVEGLKRGLKANGFNKSGNCHVFQESNEMCVQRLTEFLSQNPGFRLRIRHINLGLLPSSKQGWPLAIKLIYLQGASLEKVTMHIHENVHIDAIEDGSFEKNVIVELDAINESIALIRNRGIKLQFVRSKLERIKTFAPDIWHVCVDVDVIVST

SEQ ID NO: 108147 - DNA, 1278 bp, Eremothecium gossypii
  CDS (1)..(1278)
atgtccggtgacgtagaacacctagaaacgcagagtatggcgcctgtagagttcatagtcgaccaggcacgtgtcatcaaagcgatcaagctggaattggaggcggcgggcgccttcaggggcattgagacgaacggcggaagcaagatcgtgcgctcatcgctggacgtaagtgcagatacggcggcgcgcatctgcaccacgtaccaggtgtcgagccgggaatacagcgcgggcgcaccgcgcgtgccacggacactggagggctttgcagagtcgtacctgcatgcgcaggggttttcagaggtagagacggcggcgctgctgcgggcgatgccgcagcggtacacgctgtacccgccgctagtgctcttcagccactcgggcgcgcgcagcttcgagcacgacccatggggcgccgcgtttgcgcgcatggacaaggacgcgttcttcgcggcgatgctggcatcggggtgcttccccacgggctacacgcacgtagccgccaaccgcccgatcgtggcgacagacgcgatgcgccggccgttcaacatcgcgccgctgtacggggagctgctggcgcagggggacgctgccggcgcgcagttatgggagcagccgacggcggcggacttcgcgcgcagcgtgtggtgctcagtagtgcagaacggcattcgccagacgtggtcgcccgtgttcaccatgttcagccgggggaacatcaaggagaagaagcgcatcctggacacgtatccggacgtggccggccgagacgtggtcgacctgtacgccgggatcgggtacttcacgctcagctacttggcgcgcggcgcgcgctcggtgtactgtttcgagctcaacccctggagcttcgagggcttgcgtcgagggctcgcggtcaacgcatacccgggctcgtgctacgcctacaacgagtccaacgagtcggcacccgcgcgcctcgcggggcgcgacctcgacgtgcgccacatcaacctgggcctgctgccctccagccggccgggctggggcatcgcgatgggcctcgcgctcgcgcacggctgtcgcccgatcaccaccctgcacatccacgagaatgccgccgcctccgagctccacgcgctcgcagatactgtcgcagacgagctgcgcgcgctcgccgccacctgcagcccaggcttgcatgtccggccgcgtcatctagagaagatcaagaccttcgcgccagatgtctggcacgtctgcctggacgtcgacgtatcccgttccgccgagtga

SEQ ID NO: 108148 - protein, 425 aa, Eremothecium gossypii
MSGDVEHLETQSMAPVEFIVDQARVIKAIKLELEAAGAFRGIETNGGSKIVRSSLDVSADTAARICTTYQVSSREYSAGAPRVPRTLEGFAESYLHAQGFSEVETAALLRAMPQRYTLYPPLVLFSHSGARSFEHDPWGAAFARMDKDAFFAAMLASGCFPTGYTHVAANRPIVATDAMRRPFNIAPLYGELLAQGDAAGAQLWEQPTAADFARSVWCSVVQNGIRQTWSPVFTMFSRGNIKEKKRILDTYPDVAGRDVVDLYAGIGYFTLSYLARGARSVYCFELNPWSFEGLRRGLAVNAYPGSCYAYNESNESAPARLAGRDLDVRHINLGLLPSSRPGWGIAMGLALAHGCRPITTLHIHENAAASELHALADTVADELRALAATCSPGLHVRPRHLEKIKTFAPDVWHVCLDVDVSRSAE

SEQ ID NO: 108149 - DNA, 1137 bp, Gibberella zeae PH-1
  CDS (1)..(1137)
atgccaaaaccaaaagtttctaaaggaaaccccatccacaatgcaatcagcgagtggttggattcaacttctactgaaaactcagagtcgaacttgacatggagagccgacctcttggccagcgcaccaaagcgcttcacagtctatgaacccatggctcttctgccgacaggaagcttcacatctcaatcctggacaacgcttttacaaaatgttggcaaagatgcatgtcaacaactttggtccggaattttggagcaaatttcaatgcagggaaaagatacattgactcatcttgccgtaaatgagggcattcctttgcacaaagcaggagaggatgctgatgaaaacgttcgaagaagcccaagtgggctgcgcactctctatggagatttcggtcctcaagataccccagctgaggaaccctctcagaatgatttcgacaagacactgtgggcttcgacgaaacagaatggaatattccagacctgggcgccaaggtggactatgttcagtcgaggtaatgtcaaagaaaaggcaagactgttggatataggaaacaagaccctcaaaggcacgtgggcagttgacctatatgctggcattgggtattttgtcttctcatatgctcgacttgggatgagggttctatgctgggagattaacccgtggagtgtggaagggctgaggcgcggtgctatggcaaaccgatggagcgtacgaatcgtccaaggggatgacctggccttgccaactgagaagattgtcgacggaggagagcaaatcattgtgtttctcgaaagcaacgagaaagccctggaaagaatacagtcactacaggtcagtgatattgcgcaagatgtgcgacacatcaactgcggctttcttcccacgagcgaaccaacatggcgagatacatgggatatttctgctccagcgggtgagacatggcttcatctccacgaaaatgtcggtgccaatgacacagaagcaaggcgtgaggatattcagcgccgattcgatgattggcggcagggaacagacagggcggccaagattgaacacatagagcaggtcaagacatttgcgccaggcgtatggcactgcgtctttgacgttcatgtttacaaaatctag

SEQ ID NO: 108150 - protein, 378 aa, Gibberella zeae PH-1
MPKPKVSKGNPIHNAISEWLDSTSTENSESNLTWRADLLASAPKRFTVYEPMALLPTGSFTSQSWTTLLQNVGKDACQQLWSGILEQISMQGKDTLTHLAVNEGIPLHKAGEDADENVRRSPSGLRTLYGDFGPQDTPAEEPSQNDFDKTLWASTKQNGIFQTWAPRWTMFSRGNVKEKARLLDIGNKTLKGTWAVDLYAGIGYFVFSYARLGMRVLCWEINPWSVEGLRRGAMANRWSVRIVQGDDLALPTEKIVDGGEQIIVFLESNEKALERIQSLQVSDIAQDVRHINCGFLPTSEPTWRDTWDISAPAGETWLHLHENVGANDTEARREDIQRRFDDWRQGTDRAAKIEHIEQVKTFAPGVWHCVFDVHVYKI

SEQ ID NO: 108151 - DNA, 1320 bp, Aspergillus nidulans FGSC A4
  CDS (1)..(1320)
atggcagactccacttcattcgatgaaaggcctgctgctactatgtccgccatgctgagcaaggacaaatcaaaacgtctgtcaaaacagaacatcaaccccctccagaaatgcataggagatttcataaacacgcatctctcgcaatctctattagcgcaacatgccgtaccactcgaggagctggtctcctcgctccccaaacgatacaccatatacgagcccatgctcctgcttccgctgaacgcctttacccaccctccggcctgggccaagctttatgaaggtttagatgacaaccagcgccagactctgtacgcctccatcgcgagcgccttctcgcgatatggggtaacacacgttgccatgaacgcaccaatcgtgcttacagacactcaaggacatgagaacaggatgcgcagccctatcgggctcatcacgctgcatggagatttcggaccagccacgtcgcgggatggcgaggatatccagccctcggaagatgattacaagcgcgcattctgggtccgtactgtccagaatcacgggatcgtacagatctgggctccgctgcataccatgttctctcggggaaatgtcactgagaaggcccggatactggggcatgggtctacgtttgaggggttagatgaggtatcgcttcatgggaagacagctggcgatgtcgccgtcatcgatatgtacgccgggatcgggtactttgttttctcgtatctgaaacgcggggtccagagggtttgggggtgggagatcaatgggtggtctgtggagggattgcgtaggggatgtgtggagaatggatggggttgtaaagttatcagggtgggaaatgatggccagctgagtgtgcctgttgacgagctggtcgggggcctttgtgatactgatcgggtggtgatttttcacggagataatgggtttgcagcggggattatgcgtcaggttagagatgctatggagggtcggcaagggtggaccaacatcagacatgtcaatttggggcttttgccatcttccagcgacgcttgggatggtgcctgcaggatcattgacggggacaaaggtggctggctccacgtgcacgagaatgtcgatgtgcaacagatcgaggtgaagagaggcgagattaccgccaccgtgcaaggtctctggactgagtctgcgtcccagattgcgaatacggagccccgtgctgaatgtcggcacgtcgaaaaagtcaagacttatgctccaggggtaatgcattgtgtttttgacctacacctctcccatcaagagatttgcggcaatgcgccatga

SEQ ID NO: 108152 - protein, 439 aa, Aspergillus nidulans FGSC A4
MADSTSFDERPAATMSAMLSKDKSKRLSKQNINPLQKCIGDFINTHLSQSLLAQHAVPLEELVSSLPKRYTIYEPMLLLPLNAFTHPPAWAKLYEGLDDNQRQTLYASIASAFSRYGVTHVAMNAPIVLTDTQGHENRMRSPIGLITLHGDFGPATSRDGEDIQPSEDDYKRAFWVRTVQNHGIVQIWAPLHTMFSRGNVTEKARILGHGSTFEGLDEVSLHGKTAGDVAVIDMYAGIGYFVFSYLKRGVQRVWGWEINGWSVEGLRRGCVENGWGCKVIRVGNDGQLSVPVDELVGGLCDTDRVVIFHGDNGFAAGIMRQVRDAMEGRQGWTNIRHVNLGLLPSSSDAWDGACRIIDGDKGGWLHVHENVDVQQIEVKRGEITATVQGLWTESASQIANTEPRAECRHVEKVKTYAPGVMHCVFDLHLSHQEICGNAP

SEQ ID NO: 108153 - DNA, 1248 bp, Candida glabrata CBS138
  CDS (1)..(1248)
atggtgttggagttagttgtacgagatttgaaactgctcaaaccaataaagactatattagaaaatgaaggcttgtttgttaagcctatatattctgaaggtgaagacaagatcattagaacacggatcagtgattcaaaccatcaattgctagagagtctcggtactggagttctgatacgtgaaatcgatggcccggttatacaatctcataccaagaatgacataacggagttcacaagacactttttcgagggaaaattggaaaatgcaactgtaattaaattacttgaggtattgcctgttaaatatacagtatttccaccattactattgttcaattactccaaacagagatcttttttgaatgaactttggcagcagacggtaccgtctgagcttatggatcaattctaccaggcgatgctatcagcgccattcctagccaacaagaaagtttcacatatagctacaaatatgcccataatagagtcagatgtaatgcggaggccctttaacatagtaccattgtatggttttaaaaatagtataccgaacgaggacaagatatgggactcacctagcgctcaggatttccaagatgcattgtggtgccaagtgaatcaaaatgggatagagcaagtgtgggctccccaatttaccatgttcagtagaggaaatataaaagagaagaaacgtatcttagatacttttactgacattgaaggaaatgatgtggtggacatgtactccggaataggctatttcactttaagttacctcactaggaatgcccgtactgtatttgcattcgaattaaacccatggagtgtggaaggtctcaaacgaggtctcaaggctaacaggatcgaccagaatagatgtcatatatttaatgaaagcaatgccaactgtttgacaagaataaaagagtatgcaagcatacacggaccaccacacataagacacattaacctgggactgctcccaagctcaagagatggctggccattggctgtacaactctacagataccaattacagttcagtacggacaggataacgatacatatccatgaaaacgtccacatagaccatatacgtgataatagcttcatcgcaaacacagtagcccaattacaggaaatcgactcggaactaacatacacaccaactcacttggagcagataaagacatttgctccagatgtttggcacatatgcctcgatgtagatatagaccactag

SEQ ID NO: 108154 - protein, 415 aa, Candida glabrata CBS138
MVLELVVRDLKLLKPIKTILENEGLFVKPIYSEGEDKIIRTRISDSNHQLLESLGTGVLIREIDGPVIQSHTKNDITEFTRHFFEGKLENATVIKLLEVLPVKYTVFPPLLLFNYSKQRSFLNELWQQTVPSELMDQFYQAMLSAPFLANKKVSHIATNMPIIESDVMRRPFNIVPLYGFKNSIPNEDKIWDSPSAQDFQDALWCQVNQNGIEQVWAPQFTMFSRGNIKEKKRILDTFTDIEGNDVVDMYSGIGYFTLSYLTRNARTVFAFELNPWSVEGLKRGLKANRIDQNRCHIFNESNANCLTRIKEYASIHGPPHIRHINLGLLPSSRDGWPLAVQLYRYQLQFSTDRITIHIHENVHIDHIRDNSFIANTVAQLQEIDSELTYTPTHLEQIKTFAPDVWHICLDVDIDH

SEQ ID NO: 108155 - DNA, 1248 bp, Debaryomyces hansenii CBS767
  CDS (1)..(1248)
atgatgactcggtgtatcgtggttggaatcgagaactcaactcatataaagccagtaaaggtgtttttggaagagttgggcttgttcaatcggaataaaaagataaatagatcggggaatttgcaccaattatatacgacatgcaagaaaatagaggaattggaaggcattcctagaaatgatgtagagataggttactatgagaaggaagagtctgataaaagtacgctagagggtgttgttagaggttttttgacgaacatggggtttggaggaaacgttgaaaaattattggaacacttacctaagaaatggtcggtgtatcctccaatgatcctattgaactcgggtacgtttgatagtgatgtatggagagggttctttgaagatggggggcttaaggacgaattttttggatacgtgctttcgagtggagtatttccggctgggttgacccatatcgcggtcaataagcctatcatagaacaagacataatgagaagaccttttaatatattgccggtttatggtgattttgggccagagcccacggaggagatgtttgactctcccagcgaacaggactttgagcaggctttttggtgttcagccgttcaaaacggaatatatcaaacatgggcacctcggtatacaatgttttcgagaggaaatatcaaagagaagaaaagggtattggagcagtgtaaagatgctaacaagaagtgtgtgttcgacttgtatgcgggaataggatactttactttatcgtatctcaaaaatggagcgacggtcttttgttgggaaatcaatccgtggtccatcaaaggcttgataaagagtgtctctaaaaacggttacagctacaagttaatcaggcgacaagaatcgcttgaccatgcttcttacaataagtacgacaaggacggcgtatcggtctatattttccacgagtctaacgagtatgccatggatagatacctgcaaattggaaaaaccttacctcttgcccatataaatctcggtcttttacccacctccactccatcgtggtctattaccaaggctttgacacgcaagtcgtcgaccagcaccgtaattcacgttcatgagaatgtgcacgtcgaagattttgcccaagtaggccaaaaggtagcggattactttgaaggaaatgtcgttgcaataaacaaggtcaagacatttgcccctgacatatggcatgtggtaatagacgtttcgctcgattaa

SEQ ID NO: 108156 - protein, 415 aa, Debaryomyces hansenii CBS767
MMTRCIVVGIENSTHIKPVKVFLEELGLFNRNKKINRSGNLHQLYTTCKKIEELEGIPRNDVEIGYYEKEESDKSTLEGVVRGFLTNMGFGGNVEKLLEHLPKKWSVYPPMILLNSGTFDSDVWRGFFEDGGLKDEFFGYVLSSGVFPAGLTHIAVNKPIIEQDIMRRPFNILPVYGDFGPEPTEEMFDSPSEQDFEQAFWCSAVQNGIYQTWAPRYTMFSRGNIKEKKRVLEQCKDANKKCVFDLYAGIGYFTLSYLKNGATVFCWEINPWSIKGLIKSVSKNGYSYKLIRRQESLDHASYNKYDKDGVSVYIFHESNEYAMDRYLQIGKTLPLAHINLGLLPTSTPSWSITKALTRKSSTSTVIHVHENVHVEDFAQVGQKVADYFEGNVVAINKVKTFAPDIWHVVIDVSLD

SEQ ID NO: 108157 - DNA, 1206 bp, Yarrowia lipolytica CLIB99
  CDS (1)..(1206)
atgcagctctttatatccccgtctaaacgcgatataaaagctgtcaaaacggaacttgagaagcgggagctgtttgacaaaaccactggagtgatatctcatgatggaagcatgtttgtggctaccactgtgacggaaggggggagagaaacaagtgacgggttcgttgaaatcactgatccgtcgataaacgtttcctcggagtgcaaatactttgtccgcgagagatctccagatcaaaaacacccctctataaccgacgacatgccaaagagatacacgatatacggctccatggctctcttcacagctggctcttttgctggctgggaaaaaaccaagatccagcgcgctttgacggaatggttgaaagataagcctggagtgacccatgtagctgtcaacagtccgatttctaagcaacaaaacgtgattcggcatcctggaatcacccggttagtcggagattggggtccgtatcctgctgatcaccctatgctgtacgaccatccgacttctgaagacttccacaacgcctactgggtcaccactactcagaatgatatcaaacagtgctgggctcctatgtacaccatgttcagtcggggcaacatcaaagagaaggctcgagtattgaactcgccgatattcaagtcctcttccaattctctggtggttgatttgtattgtggaatcggctacttctttctgtcgtacgcacaactcaagccgaggctcattctaggatgggacatcaatgcctggtccatcgaggggctgagaaggggagctcagctggccaagttgagtcttcaagtggtcaaggagggagaaaagccggactggagcaaggtgggacctccaggaactacacatgccattgtcttcaatgagtccaatgagaaggccgttgagagaattgaagagctaaggaggttcaatgagacaacgactatggaagctctacctctgacacacatcaacatgggtctgctaccagactgtaagcaggcatggggcactgcgacgtctctggcgcagtcaggggtcactacttatcatgttcatgagaacgtcgctatgaacgagattgaagagtttaccagggaaagggggaaggtgtttggaaagcatttgcatacggagatggtaaaaacgtttgctccaggagtaggacatattgtgtgggatttcataagtacttga

SEQ ID NO: 108158 - protein, 401 aa, Yarrowia lipolytica CLIB99
MQLFISPSKRDIKAVKTELEKRELFDKTTGVISHDGSMFVATTVTEGGRETSDGFVEITDPSINVSSECKYFVRERSPDQKHPSITDDMPKRYTIYGSMALFTAGSFAGWEKTKIQRALTEWLKDKPGVTHVAVNSPISKQQNVIRHPGITRLVGDWGPYPADHPMLYDHPTSEDFHNAYWVTTTQNDIKQCWAPMYTMFSRGNIKEKARVLNSPIFKSSSNSLVVDLYCGIGYFFLSYAQLKPRLILGWDINAWSIEGLRRGAQLAKLSLQVVKEGEKPDWSKVGPPGTTHAIVFNESNEKAVERIEELRRFNETTTMEALPLTHINMGLLPDCKQAWGTATSLAQSGVTTYHVHENVAMNEIEEFTRERGKVFGKHLHTEMVKTFAPGVGHIVWDFIST

SEQ ID NO: 108159 - DNA, 1260 bp, Candida albicans SC5314
  CDS (1)..(1260): transl_table=12
atggctataaaattactaatagacaaccctaaacaagtcaaaccaataaaactgtatttagaagatcataattggttgaataaatcttttaaaattcaaaaaaagaatgatatattccatattttcacaaacttgaatgaaatcccatcgcaattatcacagtataatcatgaaacttatgaacaagaagatgatggagatttaaacactaaaaataaaactaccacattaacattagcatcgataatcacagattattgccacgcaaacaatatagaaaacatagagatccctaaacgatggtctatttacccaccaatgatactattcaattccacaggctcaacatcggagtcaaacggacaccccacctcagatacaatattcaacccacaacaccaaaagttatgggaaaacgtattatctaatcagaaatcaatatttggaacttcagaaattactcatatagcgttgaataaacctataattgaatccgatataatgagacgtccccataatttaatccccattataggcgattttggacccgatatatcaatagacaataaaccaccttctcctacagaatcagattttaatcgagcattttggtgtcatgttatacaaaatggaatttatcaaacttgggcacctaaatataccatgttttctcgaggtaatattaaagaaaaaaaacgagttttggattggtttaaaaatcttgatcaaacgattgtttttgatttttattgtgggattggatatttttctttatcttatcttaaaaatggaggtaaattattatgttgggaattgaatccttggtcaattgaaggatttagaagaagtttagaaaaaatgaaaatcaattataaaatatatactagtggtgataaatttagtattaatgatttgaatcaatttgatgcatgtttatttttggaaagtaatgaacaaataactacaagggtgattgatcaagttaaagataatagtttaccaattagtcatattaatttagggttattacccagttctaaacaatcatggacattagcaaataatttaattgataaatcaaccatcaatactaatgtccatatacatgaaaatgttcatatcgatgattttgaaaaaattaaaactgatgttaaaaaagtttttacaaatgggaaagttttgcatttggagaaggtgaaaacttttgctcccgatatttggcatatagtaattgatatagaaaatattaaaagttgctaa

SEQ ID NO: 108160 - protein, 419 aa, Candida albicans SC5314
MAIKLLIDNPKQVKPIKSYLEDHNWLNKSFKIQKKNDIFHIFTNLNEIPSQLSQYNHETYEQEDDGDLNTKNKTTTLTLASIITDYCHANNIENIEIPKRWSIYPPMILFNSTGSTSESNGHPTSDTIFNPQHQKLWENVLSNQKSIFGTSEITHIALNKPIIESDIMRRPHNLIPIIGDFGPDISIDNKPPSPTESDFNRAFWCHVIQNGIYQTWAPKYTMFSRGNIKEKKRVLDWFKNLDQTIVFDFYCGIGYFSLSYLKNGGKLLCWELNPWSIEGFRRSLEKMKINYKIYTSGDKFSINDLNQFDACLFLESNEQITTRVIDQVKDNSLPISHINLGLLPSSKQSWTLANNLIDKSTINTNVHIHENVHIDDFEKIKTDVKKVFTNGKVLHLEKVKTFAPDIWHIVIDIENIKSC

SEQ ID NO: 108161 - DNA, 1347 bp, Aspergillus fumigatus Af293
  CDS (1)..(1347)
atgcattccgacgatccaacaggggatcacacaccagatgaacgtgtcaagaagcctacaacccacaagcgggaacctaaaagtcgaaacaagtgctcaaatcccctccgaaaaggcatacagaattttgtaacaagacatataccctcagacgacctcgccaaacatggtatgtctttggagagccttgaatcagcccttccgaaaaggttcacagtgtatgaacaactgctgctgctgcctgtgaacgcactcagcgatcctccagcctggggctcgctttatgcaagcctagacagccaaaagcgaaggcttctctttgagtcgattgctactgcattcgggcggatgggcgttacacgtattgccatgaatgcgcccatcgcgcctatgaacacgcagggaggagagaacaggatgcgcagccccacgggactgattcctctttatggagactttggcttggtgccattttgggacggcgagaatgcgcagccgacgcaggaagacttccagcgtgcgttctgggtgcagactatgcagaatcaggggattgtgcagatttgggccccgctgtatacgatgttttctcgggggaatatcacagagaaggcccggattctgggtcaaggatctgtctttgaagggcttgatgaaggcacccttggggaaaagatcgacagcatcagcgtggttgatctgtatgcggggattggatattttgtcttctcatatcttaaaagaggggtgaagagggtctggggatgggagatcaacggatggtcagtcgagggtttgagaagagggtgtacagagaatggatgggggtgcaaagtggttggaattgggaatgatggaacattgagtgaatcggtcccagatctggttgacagtcttcaagattcagacagggtggtcttgtttcatggagacaacaaattcgccgctcgcgttatgggcgaaatcaaagggcacatggagcgccgagatgcatggaatagaattcgacatgtcaacctaggccttcttccgtcttccaggggtgcttggagtgacgcttgcgcaatgatcgatctacagttgggaggttggatgcatgtgcatgaaaacgtggatgtgcaacatattgatgcgaagaagcaggaaatcatcactgagatcggcagattgagagcaatagccttcccaagtgctgttcagcagcctattgaatgccgtcatattgagaatgtcaagacatatgcaccaggcgtcatgcattgcgtcttcgacatcaagttgcctccgtccggagagacacctacgggactcgagctgagtcgggcatcgaagcagtctccatcctga

SEQ ID NO: 108162 - protein, 448 aa, Aspergillus fumigatus Af293
MHSDDPTGDHTPDERVKKPTTHKREPKSRNKCSNPLRKGIQNFVTRHIPSDDLAKHGMSLESLESALPKRFTVYEQLLLLPVNALSDPPAWGSLYASLDSQKRRLLFESIATAFGRMGVTRIAMNAPIAPMNTQGGENRMRSPTGLIPLYGDFGLVPFWDGENAQPTQEDFQRAFWVQTMQNQGIVQIWAPLYTMFSRGNITEKARILGQGSVFEGLDEGTLGEKIDSISVVDLYAGIGYFVFSYLKRGVKRVWGWEINGWSVEGLRRGCTENGWGCKVVGIGNDGTLSESVPDLVDSLQDSDRVVLFHGDNKFAARVMGEIKGHMERRDAWNRIRHVNLGLLPSSRGAWSDACAMIDLQLGGWMHVHENVDVQHIDAKKQEIITEIGRLRAIAFPSAVQQPIECRHIENVKTYAPGVMHCVFDIKLPPSGETPTGLELSRASKQSPS

SEQ ID NO: 108163 - DNA, 1257 bp, Schizosaccharomyces pombe
  CDS (1)..(1257)
atgatttcttttctagtacaaaagtctgaagcaaagtactggaaggatgttgttcaaaataaaaataagtttcttaaaaatattgggatcatttcgggacctaaattagttgacacctacagcaatcaatttgaagcagattttctcaaaaagtgcgttcttattccaacttcttataacaaagaagaccttcctaaagatatattagattgcccaagaatttatttaatcgaagaggaggtaaaatctgttcaaacagatgaaaaattgcagattaaagttcttcgctatgtatctcaaatccttcacacaactgtgagtgaagaacaatatcccgttccatctaggtttgtcatttatcctccgttagctctattatctttaaacagttttggcactaaagaatggcatcttttttttcagtcttatgcaaacgtcgatgtcaaagctggtttatttgatatttttgctagagaatggaacgtatcacatattgctattaatgaacctattcctgtgggggatgtaatgagaagaccattgtcattgaaaccgctatacggtgactttggagtgctaattgatggcaacccctctgaacaggattttcaaaaagcattttgggtaagttgtcgtcaaaacggtatttatcagacatgggctcctctttatacgatgttctctcgtggtaattcgattgaaaaggccagagtacttaattttagttacattaaagacgaaattattgcagatctttacgctggtatagggtactttacattttcttacgttaaagcgggagcttcaacagttttttgctgggaaattaatccatggagtgttgaagcgttaaggagagctgctttgaaaaatggctggtctatttatgtagttcgaaatggagaaaactatgaatttaaagtaggaactcatcgtattgtagtttttttggaaagcaacgtttatgcagctgaaaggttctccaaaatgaatatttctgctcgacatataaatttgggaatgctcccctctagtgaaaaatcctggtcaaccgctacttcaattttaaagcgagaatcacattcctttatacatgttcatgagaacgtaaaagatgaagatatcgaaacatactcttctgaagtgaattcatgtttttcaaaaatgttggctaaaaatacagtttgtgttacaaattgtgtcaaatcattttcaccacgagtgtcacatatcgtttacgatatagagacggtttag

SEQ ID NO: 108164 - protein, 418 aa, Schizosaccharomyces pombe
MISFLVQKSEAKYWKDVVQNKNKFLKNIGIISGPKLVDTYSNQFEADFLKKCVLIPTSYNKEDLPKDILDCPRIYLIEEEVKSVQTDEKLQIKVLRYVSQILHTTVSEEQYPVPSRFVIYPPLALLSLNSFGTKEWHLFFQSYANVDVKAGLFDIFAREWNVSHIAINEPIPVGDVMRRPLSLKPLYGDFGVLIDGNPSEQDFQKAFWVSCRQNGIYQTWAPLYTMFSRGNSIEKARVLNFSYIKDEIIADLYAGIGYFTFSYVKAGASTVFCWEINPWSVEALRRAALKNGWSIYVVRNGENYEFKVGTHRIVVFLESNVYAAERFSKMNISARHINLGMLPSSEKSWSTATSILKRESHSFIHVHENVKDEDIETYSSEVNSCFSKMLAKNTVCVTNCVKSFSPRVSHIVYDIETV

SEQ ID NO: 108165 - DNA, 24 bp, Artificial sequence
  primer
atgagtgacgaaaccatgcctgta

SEQ ID NO: 108166 - DNA, 26 bp, Artificial sequence
  primer
ttaagtacttactataacgtcgacat

SEQ ID NO: 108167 - protein, 492 aa, Artificial sequence
  Variant (2)..(24): xaa in position 2 to 24 is any amino acid
  Variant (25)..(43): xaa in position 25 to 43 is any or no amino acid
  Variant (45)..(65): xaa in position 45 to 65 is any amino acid
  Variant (66)..(96): xaa in position 66 to 96 is any or no amino acid
  Variant (98)..(100): xaa in position 98 to 100 is any amino acid
  Variant (103)..(103): xaa in position 103 is any amino acid
  Variant (109)..(109): xaa in position 109 is any amino acid
  Variant (112)..(112): xaa in position 112 is any amino acid
  Variant (114)..(123): xaa in position 114 to 123 is any amino acid
  Variant (124)..(126): xaa in position 124 to 126 is any or no amino acid
  Variant (128)..(137): xaa in position 128 to 137 is any amino acid
  Variant (138)..(142): xaa in position 138 to 142 is any or no amino acid
  Variant (144)..(145): xaa in position 144 to 145 is any or no amino acid
  Variant (147)..(149): xaa in position 147 to 149 is any amino acid
  Variant (150)..(167): xaa in position 150 to 167 is any or no amino acid
  Variant (175)..(175): xaa in position 175 is any amino acid
  Variant (178)..(182): xaa in position 178 to 182 is any amino acid
  Variant (183)..(190): xaa in position 183 to 190 is any or no amino acid
  Variant (193)..(193): xaa in position 193 is any amino acid
  Variant (195)..(196): xaa in position 195 to 196 is any amino acid
  Variant (198)..(199): xaa in position 198 to 199 is any amino acid
  Variant (203)..(211): xaa in position 203 to 211 is any amino acid
  Variant (212)..(220): xaa in position 212 to 220 is any or no amino acid
  Variant (223)..(224): xaa in position 223 to 224 is any amino acid
  Variant (227)..(228): xaa in position 227 to 228 is any amino acid
  Variant (230)..(230): xaa in position 230 is any amino acid
  Variant (232)..(235): xaa in position 232 to 235 is any amino acid
  Variant (238)..(238): xaa in position 238 is any or no amino acid
  Variant (241)..(241): xaa in position 241 is any amino acid
  Variant (243)..(243): xaa in position 243 is any amino acid
  Variant (247)..(247): xaa in position 247 is any amino acid
  Variant (257)..(257): xaa in position 257 is any amino acid
  Variant (260)..(260): xaa in position 260 is any amino acid
  Variant (264)..(272): xaa in position 264 to 272 is any amino acid
  Variant (273)..(286): xaa in position 273 to 286 is any or no amino acid
  Variant (288)..(288): xaa in position 288 is any amino acid
  Variant (298)..(299): xaa in position 298 to 299 is any amino acid
  Variant (303)..(304): xaa in position 303 to 304 is any amino acid
  Variant (306)..(307): xaa in position 306 to 307 is any amino acid
  Variant (308)..(308): xaa in position 308 is any or no amino acid
  Variant (310)..(311): xaa in position 310 to 311 is any amino acid
  Variant (316)..(316): xaa in position 316 is any amino acid
  Variant (326)..(328): xaa in position 326 to 328 is any amino acid
  Variant (330)..(336): xaa in position 330 to 336 is any amino acid
  Variant (337)..(362): xaa in position 337 to 362 is any or no amino acid
  Variant (365)..(365): xaa in position 365 is any amino acid
  Variant (369)..(373): xaa in position 369 to 373 is any amino acid
  Variant (376)..(381): xaa in position 376 to 381 is any amino acid
  Variant (382)..(391): xaa in position 382 to 391 is any or no amino acid
  Variant (393)..(393): xaa in position 393 is any amino acid
  Variant (404)..(406): xaa in position 404 to 406 is any amino acid
  Variant (408)..(409): xaa in position 408 to 409 is any amino acid
  Variant (411)..(412): xaa in position 411 to 412 is any amino acid
  Variant (414)..(420): xaa in position 414 to 420 is any amino acid
  Variant (421)..(426): xaa in position 421 to 426 is any or no amino acid
  Variant (434)..(455): xaa in position 434 to 455 is any amino acid
  Variant (456)..(475): xaa in position 456 to 475 is any or no amino acid
  Variant (477)..(477): xaa in position 477 is any amino acid
  Variant (484)..(484): xaa in position 484 is any amino acid
  Variant (486)..(486): xaa in position 486 is any amino acid
  Variant (488)..(490): xaa in position 488 to 490 is any amino acid
LXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXLXXXLPXRYTIYXPMXLXXXXXXXXXXXXXWXXXXXXXXXXXXXXXFXXIXXXXXXXXXXXXXXXXXXXXXVTHIAVNXPIXXXXXXXXXXXXXMRXPXXIXXLYGXXXXXXXXXXXXXXXXXXPSXXDFXXAXWXXXXQNXGIXQXWAPXYTMFSRGNIXEKXRVLXXXXXXXXXXXXXXXXXXXXXXXVXDLYAGIGYFXXSYLXXGXXXVXXWEINXWSVEGLRRGXXXNXXXXXXXXXXXXXXXXXXXXXXXXXXXXXXXXXVFXESNXXXXXRIXXXXXXXXXXXXXXXXIXHINLGLLPSSXXXWXXAXXLXXXXXXXXXXXXXIHVHENVXXXXXXXXXXXXXXXXXXXXXXXXXXXXXXXXXXXXXXXXXXEXVKTFAPXVXHXXXDV

SEQ ID NO: 108168 - protein, 12 aa, Artificial sequence
  Variant (2)..(2): xaa in position 2 is any amino acid
  Variant (3)..(3): xaa in position 3 is Lys or Arg
  Variant (4)..(4): xaa in position 4 is Phe, Trp or Tyr
  Variant (5)..(5): xaa in position 5 is Ser or Thr
  Variant (6)..(6): xaa in position 6 is Ile, Leu or Val
  Variant (8)..(8): xaa in position 8 is any amino acid
  Variant (9)..(9): xaa in position 9 is Pro, Gln or Ser
  Variant (10)..(10): xaa in position 10 is Leu, Met or Val
  Variant (11)..(11): xaa in position 11 is Ala, Ile, Leu or Val
PXXXXXYXXXXL

SEQ ID NO: 108169 - protein, 9 aa, Artificial sequence
  Variant (2)..(2): xaa in position 2 is His or Arg
  Variant (3)..(3): xaa in position 3 is Ile, Leu or Val
  Variant (5)..(5): xaa in position 5 is any amino acid
  Variant (7)..(7): xaa in position 7 is any amino acid
  Variant (8)..(8): xaa in position 8 is Gly or Pro
TXXAXNXXI

SEQ ID NO: 108170 - protein, 44 aa, Artificial sequence
  Variant (2)..(2): xaa in position 2 is Ser or Thr
  Variant (3)..(3): xaa in position 3 is Ala, Glu, Gln or Ser
  Variant (4)..(4): xaa in position 4 is Ala, Glu, Asn, Gln or Ser
  Variant (5)..(5): xaa in position 5 is Asp or Gln
  Variant (6)..(6): xaa in position 6 is Phe or Leu
  Variant (7)..(8): xaa in position 7 to 8 is any amino acid
  Variant (9)..(9): xaa in position 9 is Ala, Ser or Thr
  Variant (10)..(10): xaa in position 10 is any amino acid
  Variant (12)..(12): xaa in position 12 is Ala, Cys or Val
  Variant (13)..(13): xaa in position 13 is any amino acid
  Variant (14)..(14): xaa in position 14 is Ala, Cys, Thr or Val
  Variant (15)..(15): xaa in position 15 is any amino acid
  Variant (18)..(18): xaa in position 18 is Asp or Gly
  Variant (19)..(19): xaa in position 19 is Ile or Val
  Variant (20)..(20): xaa in position 20 is any amino acid
  Variant (22)..(22): xaa in position 22 is any amino acid
  Variant (24)..(24): xaa in position 24 is Ala or Ser
  Variant (26)..(26): xaa in position 26 is any amino acid
  Variant (27)..(27): xaa in position 27 is Phe, Trp or Tyr
  Variant (35)..(35): xaa in position 35 is any amino acid
  Variant (36)..(37): xaa in position 36 to 37 is any or no amino acid
  Variant (39)..(39): xaa in position 39 is any amino acid
  Variant (40)..(41): xaa in position 40 to 41 is any or no amino acid
  Variant (43)..(43): xaa in position 43 is Ile, Leu or Val
PXXXXXXXXXWXXXXQNXXXQXWXPXXTMFSRGNXXXKXXXRXL

SEQ ID NO: 108171 - protein, 33 aa, Artificial sequence
  Variant (6)..(6): xaa in position 6 is Ser, Thr or Val
  Variant (7)..(7): xaa in position 7 is Phe or Leu
  Variant (10)..(10): xaa in position 10 is Ala, Leu or Val
  Variant (11)..(12): xaa in position 11 to 12 is any amino acid
  Variant (14)..(19): xaa in position 14 to 19 is any amino acid
  Variant (20)..(20): xaa in position 20 is any or no amino acid
  Variant (22)..(22): xaa in position 22 is Ile or Leu
  Variant (24)..(24): xaa in position 24 is Gly or Pro
  Variant (27)..(27): xaa in position 27 is Phe, Ile or Val
  Variant (28)..(28): xaa in position 28 is Glu or Lys
  Variant (29)..(29): xaa in position 29 is Ala or Gly
  Variant (30)..(30): xaa in position 30 is Phe or Leu
  Variant (31)..(31): xaa in position 31 is any amino acid
  Variant (32)..(32): xaa in position 32 is Lys or Arg
  Variant (33)..(33): xaa in position 33 is Ala, Gly or Ser
GIGYFXXSYXXXGXXXXXXXEXNXWSXXXXXXX

SEQ ID NO: 108172 - protein, 20 aa, Artificial sequence
  Variant (2)..(2): xaa in position 2 is Ile or Val
  Variant (6)..(6): xaa in position 6 is Leu or Met
  Variant (9)..(9): xaa in position 9 is Ser or Thr
  Variant (11)..(12): xaa in position 11 to 12 is any amino acid
  Variant (13)..(13): xaa in position 13 is Ala, Gly or Ser
  Variant (15)..(15): xaa in position 15 is Asp, Gly, Pro, Ser or Thr
  Variant (16)..(16): xaa in position 16 is any amino acid
  Variant (17)..(17): xaa in position 17 is Ala or Thr
  Variant (18)..(19): xaa in position 18 to 19 is any amino acid
  Variant (20)..(20): xaa in position 20 is Ile, Leu or Met
HXNLGXLPXSXXXWXXXXXX

SEQ ID NO: 108173 - protein, 6 aa, Artificial sequence
  Variant (2)..(2): xaa in position 2 is Ile or Val
HXHENV

SEQ ID NO: 108174 - protein, 19 aa, Artificial sequence
  Variant (2)..(3): xaa in position 2 to 3 is any or no amino acid
  Variant (5)..(6): xaa in position 5 to 6 is any or no amino acid
  Variant (8)..(8): xaa in position 8 is Phe or Tyr
  Variant (11)..(11): xaa in position 11 is Asp or Gly
  Variant (12)..(12): xaa in position 12 is Ile or Val
  Variant (13)..(13): xaa in position 13 is any amino acid
  Variant (15)..(15): xaa in position 15 is any amino acid
  Variant (16)..(16): xaa in position 16 is Cys or Val
  Variant (17)..(17): xaa in position 17 is any amino acid
  Variant (19)..(19): xaa in position 19 is Phe, Ile, Leu or Val
EXXKXXTXAPXXXHXXXDX

SEQ ID NO: 108175 - DNA, 1188 bp, Helianthus annuus
  CDS (104)..(1063)
attcttccttcattattacgaatttcacttcaatcatcatcttatgcagcggaaaacgtgttcatctatctcaaacaagttcgtcaaactttgatcaatttcaatggcggaaccgaagaagataataattgacacggatcctggcatcgatgatgctatggcaatatttctggctttgaggtcacctgaagttaatgtgattgggcttacaactatttatggcaatgtttacaccactcttgccactagaaatgcattacatttgttggaggttgctggtagaacagatatccctgttgcagaaggatctcatgttagttatgtgaaagcaacgaagcttcgagttgcagactttgttcacggggtagacgggctcggaaaccagaacttcccgcagccgaagtcaaaaccaatagaaaagtcagcagcagaatatttggtggagcaagctcgtctttaccccggagaaatcactttggtcgcattgggtccccttaccaacatcgccttggccattgaactcgaccccgccttcaccaaaaacattggacagattgttcttcttggtggtgcgtttttagtaaacgggaatgtgaatccagctagcgaggctaatatttttggtgatccggaagctgcagatattgtgtttacttgcggtgctgatgtgttggctattgggctcaatgttactcatcaagttattcttacagatcatgatcgtgacatcttggcagaatcagatggaatatttgccaagtatttgagcaagatcctggaattttacttttcttatcatcgcgatgcatacaacatgaaaggtgtataccttcatgacccgacaacgattcttgcagctgtgaatccttcattaatgacatacacggaaggtgttgtcagagtccagacaactggtatcacaaggggcttatcgttgtttttcaacaaacagaaaaggtttaacgaagagactgaatggtgcaacaaaccgacagtgaaggtggcagttactgtggacgctcccgaggtagttaaattggttatggaacgtcttatgtattgataactaacatccccaactctctatttcaaagcctctgtttctcaagaggaaccctaaaggttcaaaaatgatatattttctgtatttgttttattaatcaattagcagcgaaaaaaaaaaaaaaa

SEQ ID NO: 108176 - protein, 319 aa, Helianthus annuus
MAEPKKIIIDTDPGIDDAMAIFLALRSPEVNVIGLTTIYGNVYTTLATRNALHLLEVAGRTDIPVAEGSHVSYVKATKLRVADFVHGVDGLGNQNFPQPKSKPIEKSAAEYLVEQARLYPGEITLVALGPLTNIALAIELDPAFTKNIGQIVLLGGAFLVNGNVNPASEANIFGDPEAADIVFTCGADVLAIGLNVTHQVILTDHDRDILAESDGIFAKYLSKILEFYFSYHRDAYNMKGVYLHDPTTILAAVNPSLMTYTEGVVRVQTTGITRGLSLFFNKQKRFNEETEWCNKPTVKVAVTVDAPEVVKLVMERLMY

SEQ ID NO: 108177 - DNA, 28 bp, Artificial sequence
  primer
atggcggaaccgaagaagataataattg

SEQ ID NO: 108178 - DNA, 24 bp, Artificial sequence
  primer
tcaatacataagacgttccataac

SEQ ID NO: 108179 - protein, 567 aa, Artificial sequence; identical to SEQ ID NO: 91412
  consensus sequence
  Variant (2)..(2): Xaa in position 2 is any amino acid
  Variant (4)..(4): Xaa in position 4 is any amino acid
  Variant (6)..(6): Xaa in position 6 is any amino acid
  Variant (8)..(22): Xaa in position 8 to 22 is any or no amino acid
  Variant (24)..(25): Xaa in position 24 to 25 is any amino acid
  Variant (27)..(44): Xaa in position 27 to 44 is any amino acid
  Variant (45)..(59): Xaa in position 45 to 59 is any or no amino acid
  Variant (62)..(69): Xaa in position 62 to 69 is any amino acid
  Variant (71)..(84): Xaa in position 71 to 84 is any amino acid
  Variant (85)..(109): Xaa in position 85 to 109 is any or no amino acid
  Variant (111)..(120): Xaa in position 111 to 120 is any amino acid
  Variant (121)..(161): Xaa in position 121 to 161 is any or no amino acid
  Variant (164)..(165): Xaa in position 164 to 165 is any amino acid
  Variant (167)..(195): Xaa in position 167 to 195 is any amino acid
  Variant (196)..(242): Xaa in position 196 to 242 is any or no amino acid
  Variant (244)..(245): Xaa in position 244 to 245 is any amino acid
  Variant (248)..(248): Xaa in position 248 is any amino acid
  Variant (250)..(255): Xaa in position 250 to 255 is any amino acid
  Variant (256)..(256): Xaa in position 256 is any or no amino acid
  Variant (258)..(268): Xaa in position 258 to 268 is any amino acid
  Variant (272)..(276): Xaa in position 272 to 276 is any amino acid
  Variant (277)..(293): Xaa in position 277 to 293 is any or no amino acid
  Variant (295)..(298): Xaa in position 295 to 298 is any amino acid
  Variant (301)..(301): Xaa in position 301 is any amino acid
  Variant (303)..(305): Xaa in position 303 to 305 is any amino acid
  Variant (308)..(308): Xaa in position 308 is any amino acid
  Variant (311)..(312): Xaa in position 311 to 312 is any amino acid
  Variant (314)..(363): Xaa in position 314 to 363 is any amino acid
  Variant (364)..(454): Xaa in position 364 to 454 is any or no amino acid
  Variant (456)..(474): Xaa in position 456 to 474 is any amino acid
  Variant (475)..(566): Xaa in position 475 to 566 is any or no amino acid

SEQ ID NO: 108180 - protein, 73 aa, Artificial sequence; identical to SEQ ID NO: 91413
  protein pattern
  Variant (1)..(1): Xaa in position 1 is Ile, Val, Leu, Met, Phe or Ala
  Variant (2)..(3): Xaa in position 2 to 3 is any amino acid
  Variant (4)..(4): Xaa in position 4 is Asp, Phe, Ser or Asn
  Variant (5)..(5): Xaa in position 5 is any amino acid
  Variant (6)..(6): Xaa in position 6 is Asp or Asn
  Variant (7)..(7): Xaa in position 7 is any amino acid
  Variant (8)..(8): Xaa in position 8 is Gly, Ala or Ser
  Variant (9)..(9): Xaa in position 9 is any amino acid
  Variant (10)..(10): Xaa in position 10 is Asp, Gly or Glu
  Variant (11)..(25): Xaa in position 11 to 25 is any or no amino acid
  Variant (26)..(26): Xaa in position 26 is Asp or Ser
  Variant (27)..(28): Xaa in position 27 to 28 is any amino acid
  Variant (29)..(29): Xaa in position 29 is Ala, Ser or Thr
  Variant (30)..(30): Xaa in position 30 is Ile, Leu, Met, Thr or Val
  Variant (31)..(35): Xaa in position 31 to 35 is any amino acid
  Variant (36)..(53): Xaa in position 36 to 53 is any or no amino acid
  Variant (54)..(54): Xaa in position 54 is Leu, Val, Ile, Glu or Pro
  Variant (55)..(56): Xaa in position 55 to 56 is any amino acid
  Variant (57)..(57): Xaa in position 57 is Ile, Val, Leu or Met
  Variant (58)..(61): Xaa in position 58 to 61 is any amino acid
  Variant (62)..(62): Xaa in position 62 is any or no amino acid
  Variant (63)..(63): Xaa in position 63 is Gly, Asp or Ala
  Variant (64)..(64): Xaa in position 64 is Asn, Asp or Thr
  Variant (65)..(72): Xaa in position 65 to 72 is any amino acid
  Variant (73)..(73): Xaa in position 73 is Asn, Val, Ala, Arg or His

SEQ ID NO: 108181 - protein, 71 aa, Artificial sequence; identical to SEQ ID NO: 91414
  protein pattern
  Variant (1)..(1): Xaa in position 1 is Gly, Ala or Ser
  Variant (2)..(3): Xaa in position 2 to 3 is any amino acid
  Variant (4)..(4): Xaa in position 4 is Thr or Ser
  Variant (5)..(5): Xaa in position 5 is any amino acid
  Variant (6)..(6): Xaa in position 6 is Leu, Ile, Val, Ala, Met or Phe
  Variant (7)..(7): Xaa in position 7 is Ala, Ser or Gly
  Variant (8)..(24): Xaa in position 8 to 24 is any amino acid
  Variant (25)..(26): Xaa in position 25 to 26 is any or no amino acid
  Variant (27)..(27): Xaa in position 27 is Met, Leu or Val
  Variant (28)..(28): Xaa in position 28 is Gly, Ala or Ser
  Variant (30)..(37): Xaa in position 30 to 37 is any amino acid
  Variant (38)..(57): Xaa in position 38 to 57 is any or no amino acid
  Variant (58)..(58): Xaa in position 58 is Glu or Asp
  Variant (59)..(59): Xaa in position 59 is any amino acid
  Variant (61)..(63): Xaa in position 61 to 63 is any amino acid
  Variant (65)..(65): Xaa in position 65 is Pro, Ala or Val
  Variant (66)..(66): Xaa in position 66 is any amino acid
  Variant (67)..(67): Xaa in position 67 is Ala, Ser or Gly
  Variant (68)..(68): Xaa in position 68 is Ala, Val, Ser, Thr or Leu
  Variant (69)..(70): Xaa in position 69 to 70 is any amino acid
  Variant (71)..(71): Xaa in position 71 is Val, Leu, Ile, Met or Phe

SEQ ID NO: 108182 - DNA, 1176 bp, Glycine max
  CDS (74)..(883)
cacataagcaattaattaagcactctaaaacatatctttatttccttgtctacatatcttgaaaaactcaatcatggctagtgtttcttcggttttagctccatttagaaggcttgatgggaaggtggcgattatcactggtggtgcgagtggtctaggtgcagccactgcaagactcttctctaagcatggagcatatgtagtcatagctgatattcaagacgacttgggtctctctgttgccaaagagttagaatctgcttcctatgtccattgcgatgtgacaaaggaagaggacgttgaaaactgcgtgaacacaacggtttccaagtatggcaaattagatatcatgtttaacaatgcaggtgtatctgatgagatcaaaacaagcattcttgacaacaacaagtctgattttgagagagtgataagtgttaacttggttggtccttttctgggaacaaagcatgctgcaagggtcatgattcctgctaaaaagggatgcataatcaacacagctagtgttgctggatgcataggtggaggtgctacacatgcctacacaagttcaaagcacgcactaattggactgacaaaaaacactgcggtggagcttggacaacatggtattagggtaaattgtttgtcaccttatcttgttgtcacaccgttaagtaagaaatatttcaatattgatgaagacaaaattcgtgagatatattcaaacctaaaaggtgctcatcttgtgcctaacgatgtggccgaagctgctctttacttggcaggtgatgagtccaagtatgttagtggtcacaatcttgtgatagatggagggtacactgatgtaaatgcaggatttaccgtgtttgggcagtctcagtaaaaattgtagctgtgtcttcaaagttaaatcattattgttggtgtttgaagtgtctgtgtttcgatggccctgtagttcagaaacttgagctgttagcatgtgtgaagaaaaagaaggcaaattaatacagggtgatatgatacctgccttactgattatcgtggatgtgtgtgaagtgtctgtattcgtgctgttttggctttcgtgactctgtttcgattgctttgaagttcaaaaactttataggattatattaatatatatgcctcactcttagctaaaaaaaaaaaaaa

SEQ ID NO: 108183 - protein, 269 aa, Glycine max
MASVSSVLAPFRRLDGKVAIITGGASGLGAATARLFSKHGAYVVIADIQDDLGLSVAKELESASYVHCDVTKEEDVENCVNTTVSKYGKLDIMFNNAGVSDEIKTSILDNNKSDFERVISVNLVGPFLGTKHAARVMIPAKKGCIINTASVAGCIGGGATHAYTSSKHALIGLTKNTAVELGQHGIRVNCLSPYLVVTPLSKKYFNIDEDKIREIYSNLKGAHLVPNDVAEAALYLAGDESKYVSGHNLVIDGGYTDVNAGFTVFGQSQ

SEQ ID NO: 108184 - DNA, 1143 bp, Glycine max
  CDS (79)..(927)
ccattcctgagtttccattgccgcgacatctgaattcctccttgtcactcataatcaccaaatagaagccataaacaaatgaatgccatagcagcagaacaagtgctggagccatggcacaagctagacgacaaagtcgttttggtgacgggtgcttcctcggggctcgggcgagatttctgcatcgacctcgccaaagctggctgctgtgtcgtcgcggcagctcgtcgcctcgatcgcctcacttccctctgccacgaaatcaaccaccgatggccctcgaacgtcggaatccaccgcgcggtggcggtggagcttgatgtcgccgccgatggccccgccatcgacagggctgtgcagaaggcctgggacgcctttggccgcgttgattccttgattaacaacgctggtgtcagaggaagtgttaaatcacccttgaaattgtctgaagaggaatgggatcatgtcttcaagactaacctaactggttgttggttggtgtcaaaatatgtatgcaaacgcatgtgtgatatccagcttaagggatcaattattaatatttcttcagtttctggtttaaatcgggggcaattgcctggagctgctgcatatgcatcttcgaaggcaggggtaaacatgctgactaaggtcatggctatggaattggggatgcacaaaattagagtaaattccatatcccctggaattttcaaatctgaaataactgaaaatttattacaaaaagattggctgaatgatgtggtcaggaaaataatgcctttgagaagattaggtacttcagatccagcattaacatctctagctcgttatcttattcatgattcttctgagtacgtcacgggcaacaattttattgtcgattatggaggcaccttaccaggtgtaccaatttattcttctctgtaaattttggtacattatgcactaacgaaaagtaatactatgaattattccattacatatcttcaaattagacaatatggagttctgaagtctatgtatatggagaattattgtgaagtggctaccaccttgatcttaccatataatgctccagatgtccatgtataaatcatgtggtcgcgattggagttttgatatgttcataaaaaaaaaaaaaaa

SEQ ID NO: 108185 - protein, 282 aa, Glycine max
MNAIAAEQVLEPWHKLDDKVVLVTGASSGLGRDFCIDLAKAGCCVVAAARRLDRLTSLCHEINHRWPSNVGIHRAVAVELDVAADGPAIDRAVQKAWDAFGRVDSLINNAGVRGSVKSPLKLSEEEWDHVFKTNLTGCWLVSKYVCKRMCDIQLKGSIINISSVSGLNRGQLPGAAAYASSKAGVNMLTKVMAMELGMHKIRVNSISPGIFKSEITENLLQKDWLNDVVRKIMPLRRLGTSDPALTSLARYLIHDSSEYVTGNNFIVDYGGTLPGVPIYSSL

SEQ ID NO: 108186 - DNA, 849 bp, Brassica napus
  CDS (1)..(849)
atgagcaatcatcaaaccacggtgttgaaacaactagagccatggtgtgagctaaacggcaaagtggttcttctgaccggagcttcttctggtataggaagtgaggtctgtctcgatctgggcaaagctggctgtaagattatcgcagcagctcgtcgcgtccaccgtctcgaatctctctgctccgaaatcaacagcttaagctcaaccgggatccaattagccgcaccgctcgagctagacgtttcatcagacgcagccaccattcaaaaagctgtcaaacaagcttgggacatctacggaaagatagatgtgttgatcaacaacgctggaatcagaggcaatgtcaagacgagtttagatctgactgaagacgagtggaacacagtgttcagaaccaacttaaccggaccttggttagtatccaaatacgtctgcagtctaatgcgtgacgcaaaacgcggcggctcagtaataaacgtctcctccatcgccggtctccaccgaggtttgttacccggtggagtcgcctatgcttgttccaaaggtggtgttgacaccatgacgaggatgatggctattgagttaggtgtatacaacatcagagtgaactcgatcgcaccggggcttctcaagtcagagatcacgcaaggtcttatgcaaaaagagtggctcaagaacgtgaccgagaggactatcccgttaaaggtgcaacagaccgtggatccggggcttacctcgctcgttcgctatctcagtcatgactcttctcaatatgtctccggcaacacatacatacttgactccggagctacaatacctggcctgcctattttttcttctctttga

SEQ ID NO: 108187 - protein, 282 aa, Brassica napus
MSNHQTTVLKQLEPWCELNGKVVLLTGASSGIGSEVCLDLGKAGCKIIAAARRVHRLESLCSEINSLSSTGIQLAAPLELDVSSDAATIQKAVKQAWDIYGKIDVLINNAGIRGNVKTSLDLTEDEWNTVFRTNLTGPWLVSKYVCSLMRDAKRGGSVINVSSIAGLHRGLLPGGVAYACSKGGVDTMTRMMAIELGVYNIRVNSIAPGLLKSEITQGLMQKEWLKNVTERTIPLKVQQTVDPGLTSLVRYLSHDSSQYVSGNTYILDSGATIPGLPIFSSL

SEQ ID NO: 108188 - DNA, 858 bp, Brassica napus
  CDS (1)..(858)
atgagcagcaatcatcagactgtgatgaagcaactagagccatggtgcgagctcaaagacaaagtggttctcctaacaggagcttcatccggcatcggaagagagatctgcctcgatctagccaaatccggctgcaagatcatcgcagcagctcgtcgtctcgaccgtctccaatccctctgctccgagatcaacgccttattctccccaacaaaaaccaaacaagccgcacctctcgagctagacgtctcctcagactcatccaccatccgaaacgcagtcaaacaagcttgggacatcttcggaaacatcgacgtcttgatcaacaacgcaggcatcagaggcaacgtcaagtcgagtctggacctatccgaagaagaatgggaaagagtcttcagaacaaacctaaccggaccttggctagtatcaaaacacgtctgcgttctgatgcgcgacgccaaacgccgcggcggaggatcggtgataaacgtttcctccatcgcggggcttcagcgcgggaagctacccggcgcgttggcgtacgcgtgttcgaaaggaggtcttgatattatgacgaagatgatggcggttgagctgggtgagtatggtataagagtgaactcgatagctccggggctgtttaagtcggagatcacggaaggtctggtgaggaaagagtggatgaagaatgtgaggaagaggattgttccgttgaaggtgcagcagactgtggacccggggcttacctcgctggttaggtatctgattccccactcttccaggtatgtctctcgcaatgtttacattgttgacgcgggtgctacattgtctggtctaacgattttttcttcactttga

SEQ ID NO: 108189 - protein, 285 aa, Brassica napus
MSSNHQTVMKQLEPWCELKDKVVLLTGASSGIGREICLDLAKSGCKIIAAARRLDRLQSLCSEINALFSPTKTKQAAPLELDVSSDSSTIRNAVKQAWDIFGNIDVLINNAGIRGNVKSSLDLSEEEWERVFRTNLTGPWLVSKHVCVLMRDAKRRGGGSVINVSSIAGLQRGKLPGALAYACSKGGLDIMTKMMAVELGEYGIRVNSIAPGLFKSEITEGLVRKEWMKNVRKRIVPLKVQQTVDPGLTSLVRYLIPHSSRYVSRNVYIVDAGATLSGLTIFSSL

SEQ ID NO: 108190 - DNA, 843 bp, Zea mays
  CDS (1)..(843)
atgtcgtcggcggggccaccgccgccgctgccgccgtggagcaggctggaggggcaggtggtgctggtgacgggcgcttcctccggcatcggacgcgacttctgcctcgacctggcgcgcgccggctgccgcgtcgtcgccgccgcccgccgcgccgatcgtctccgctcgctctgcgacgagatcaacccctccgctgcctcccgagccccccgcgcggtggctgtggaggtcgacgtcgccgccggtggttcggccctggaggcggcggtgcagaaggcctgggacgcctttggccgtatcgacgccttggtcaacaacgccggcatacgaggtgcagtgcattctccattagattggcccgaggatgagtgggacagaatcatcaagacgaaccttaccggatcatggctcgtggccaaacatgtctgtcgacgcatgcgtgatgccaagctgaagggttcagtggttaacatcacctctattgctggccttaaccgtgggcatctgcctggctccacgggatacgcatcctcaaaggctgctgtgcattatgccaccaagattatggctttggaattgggcgcggatcgcatcagagtgaactcgattgcacctggactcttcaaatcagagataactgctcctctgtttcaaaagaggtggttgagcaccgttgcttcaaagatagtgccgcttaaggagcatggcgctactgatcctgcattgacgtcgctggtccgttttctgatccatgaagcatcgtcgtatgtgactggcaacatcttcattgtagactcaggtgccaccatacctggtgttccgatattctcatccctgtaa

SEQ ID NO: 108191 - protein, 280 aa, Zea mays
MSSAGPPPPLPPWSRLEGQVVLVTGASSGIGRDFCLDLARAGCRVVAAARRADRLRSLCDEINPSAASRAPRAVAVEVDVAAGGSALEAAVQKAWDAFGRIDALVNNAGIRGAVHSPLDWPEDEWDRIIKTNLTGSWLVAKHVCRRMRDAKLKGSVVNITSIAGLNRGHLPGSTGYASSKAAVHYATKIMALELGADRIRVNSIAPGLFKSEITAPLFQKRWLSTVASKIVPLKEHGATDPALTSLVRFLIHEASSYVTGNIFIVDSGATIPGVPIFSSL

SEQ ID NO: 108192 - DNA, 25 bp, Artificial sequence
  primer
atggctagtgtttcttcggttttag

SEQ ID NO: 108193 - DNA, 21 bp, Artificial sequence
  primer
ttactgagactgcccaaacac

SEQ ID NO: 108194 - protein, 266 aa, Artificial sequence; identical to SEQ ID NO: 7434
  consensus sequence
  Variant (4)..(8): Xaa in position 4 to 8 is any amino acid
  Variant (12)..(17): Xaa in position 12 to 17 is any amino acid
  Variant (19)..(21): Xaa in position 19 to 21 is any amino acid
  Variant (23)..(87): Xaa in position 23 to 87 is any amino acid
  Variant (89)..(94): Xaa in position 89 to 94 is any amino acid
  Variant (103)..(103): Xaa in position 103 is any amino acid
  Variant (105)..(109): Xaa in position 105 to 109 is any amino acid
  Variant (111)..(114): Xaa in position 111 to 114 is any amino acid
  Variant (116)..(117): Xaa in position 116 to 117 is any amino acid
  Variant (119)..(121): Xaa in position 119 to 121 is any amino acid
  Variant (124)..(126): Xaa in position 124 to 126 is any amino acid
  Variant (128)..(136): Xaa in position 128 to 136 is any amino acid
  Variant (138)..(144): Xaa in position 138 to 144 is any amino acid
  Variant (146)..(146): Xaa in position 146 is any amino acid
  Variant (148)..(148): Xaa in position 148 is any amino acid
  Variant (150)..(151): Xaa in position 150 to 151 is any amino acid
  Variant (153)..(154): Xaa in position 153 to 154 is any amino acid
  Variant (156)..(159): Xaa in position 156 to 159 is any amino acid
  Variant (161)..(162): Xaa in position 161 to 162 is any amino acid
  Variant (165)..(165): Xaa in position 165 is any amino acid
  Variant (168)..(168): Xaa in position 168 is any amino acid
  Variant (170)..(170): Xaa in position 170 is any amino acid
  Variant (174)..(175): Xaa in position 174 to 175 is any amino acid
  Variant (177)..(181): Xaa in position 177 to 181 is any amino acid
  Variant (183)..(183): Xaa in position 183 is any amino acid
  Variant (185)..(193): Xaa in position 185 to 193 is any amino acid
  Variant (196)..(198): Xaa in position 196 to 198 is any amino acid
  Variant (201)..(201): Xaa in position 201 is any amino acid
  Variant (203)..(203): Xaa in position 203 is any amino acid
  Variant (205)..(205): Xaa in position 205 is any amino acid
  Variant (207)..(229): Xaa in position 207 to 229 is any amino acid
  Variant (231)..(232): Xaa in position 231 to 232 is any amino acid
  Variant (234)..(234): Xaa in position 234 is any amino acid
  Variant (236)..(240): Xaa in position 236 to 240 is any amino acid
  Variant (242)..(246): Xaa in position 242 to 246 is any amino acid
  Variant (248)..(254): Xaa in position 248 to 254 is any amino acid
  Variant (256)..(256): Xaa in position 256 is any amino acid
  Variant (259)..(264): Xaa in position 259 to 264 is any amino acid

SEQ ID NO: 108195 - protein, 11 aa, Artificial sequence
  protein pattern
  Variant (1)..(1): Xaa in position 1 is Val or Ile
  Variant (2)..(2): Xaa in position 2 is Thr or Ser
  Variant (4)..(4): Xaa in position 4 is Ala, Ser or Gly
  Variant (5)..(6): Xaa in position 5 to 6 is any amino acid
  Variant (7)..(8): Xaa in position 7 to 8 is any or no amino acid
  Variant (9)..(9): Xaa in position 9 is Gly, Ala or Ser
  Variant (10)..(10): Xaa in position 10 is Ile, Leu or Val
XXGXXXXXXXG

SEQ ID NO: 108196 - protein, 7 aa, Artificial sequence
  protein pattern
  Variant (1)..(1): Xaa in position 1 is Leu, Val or Ile
  Variant (2)..(2): Xaa in position 2 is Val, Ile or Leu
  Variant (3)..(4): Xaa in position 3 to 4 is any amino acid
  Variant (7)..(7): Xaa in position 7 is Ile, Val or Leu
XXXXAGX

SEQ ID NO: 108197 - protein, 25 aa, Artificial sequence
  protein pattern
  Variant (2)..(3): Xaa in position 2 to 3 is any amino acid
  Variant (4)..(4): Xaa in position 4 is Gly or Asn
  Variant (5)..(5): Xaa in position 5 is Gln or Glu
  Variant (6)..(7): Xaa in position 6 to 7 is any amino acid
  Variant (9)..(9): Xaa in position 9 is any amino acid
  Variant (10)..(11): Xaa in position 10 to 11 is Ala, Ser or Thr
  Variant (13)..(13): Xaa in position 13 is any amino acid
  Variant (14)..(14): Xaa in position 14 is Gly or Ala
  Variant (15)..(16): Xaa in position 15 to 16 is any amino acid
  Variant (17)..(17): Xaa in position 17 is Gly, Ala or Ser
  Variant (18)..(22): Xaa in position 18 to 22 is any amino acid
  Variant (23)..(23): Xaa in position 23 is Ala or Ser
  Variant (24)..(24): Xaa in position 24 is any amino acid
GXXXXXXYXXXKXXXXXXXXXXXXE

SEQ ID NO: 108198 - protein, 13 aa, Artificial sequence
  protein pattern
  Variant (1)..(1): Xaa in position 1 is Ile or Val
  Variant (2)..(2): Xaa in position 2 is any amino acid
  Variant (3)..(3): Xaa in position 3 is Val, Phe, Ala or Cys
  Variant (5)..(5): Xaa in position 5 is any amino acid
  Variant (6)..(6): Xaa in position 6 is Val or Ile
  Variant (7)..(7): Xaa in position 7 is any amino acid
  Variant (10)..(12): Xaa in position 10 to 12 is any amino acid
  Variant (13)..(13): Xaa in position 13 is Thr or Ser
XXXNXXXPGXXXX

SEQ ID NO: 108199 - DNA, 1806 bp, Linum usitatissimum
  CDS (156)..(1439)
ttaaccccgagttcctttattgcattttgatcgacaaaccctcttcccctccaccgccgcgcctccaacacagtcgccgtactcattcatccgcagatctcaggtaaccacctctctcctccgccggcgtcggcccgacttgttcttcactgaccatgggagaaacaagggacaacgattacgaggaggagcttctcgattacgaggaagaggaggagaaagcccccgactctatcactgccaaagtcaacggcgaagcccctaagaagggatatgttgggatacacagttcgggattcagagacttccttttgaagccagagctacttcgggctattgtagattctgggtttgagcatccttctgaagttcaacacgagtgtattccccaagccatcttgggaatggatgttatctgccaagctaagtctgggatgggaaagactgctgtctttgttctgtctactctccagcaaattgagccaactcctgggcaagttattgcccttgttctatgtcacacaagagaacttgcttaccagatctgccacgagttcgagagattcagtacctacttgccggataccaaggttgctgtattttatggtggtgtcaacatcaaaactcacagggatcttctgaaaaatgaatgccctcacgttgttgttggaacacctggtagaatactggcattggcgcgagacaaggaactttctctgaaaaatgttagacatttcattcttgatgaatgtgacaagatgcttgaatcccttgacatgcggagagatgtgcaggagatattcaagatgacccctcatgacaagcaagtcatgatgttttctgcaacactaagtaaagaaatccgcccagtatgcaagaagttcatgcaagatccgatggaaatttatgttgacgatgaggccaagctgacacttcatggacttgtccagcactacatcaaattgaccgagctggagaaaaaccggaagctgaacgaccttcttgatgcgctggacttcaatcaagttgttatctttgtcaagagtgtgagccgtgcagctgagctgaacaagttgctaatcgagtgtaatttcccttcaatatgcattcactctggaatgtcccaggaggaaaggctgacacgctacaagggtttcaaagagggtcataaaaggattcttgttgctactgatctggttggaaggggaatagacatagagcgggtcaacattgttattaactatgacatgcctgattcagctgacacatatcttcacagggttggtcgtgctggtaggtttggcacaaaggggcttgcgattacatttgtatcatcagcttccgactcagatgttcttaatcaggttcaggagaggtttgaggtggacataaaagaactgccggagcaaattgatacatctacatacatgccctcctaactgggaagtacgaaaaggaagattacagagcaatgctgctgaatcggctctgggttctggagtatgggaggttgtgatttactgttacttgcaggccagtgtttggcttcttttgttcatggtgttagtcagagaagagtagaactgggcagaaaggttaaacgatgaagtaatgtttttgctttgccttatgcaagcagcagtgtaaacgatgaagtaatgttttgttggtcgtacagattagccagtcccaagttttcagcctacgaggaggatcagtatgtgagtttaagtttagatgacgtgtctactgttcttctgcatccatgcctattaaaattttacatgtgacaaaaaaaaaaaaaaa

SEQ ID NO: 108200 - protein, 427 aa, Linum usitatissimum
MGETRDNDYEEELLDYEEEEEKAPDSITAKVNGEAPKKGYVGIHSSGFRDFLLKPELLRAIVDSGFEHPSEVQHECIPQAILGMDVICQAKSGMGKTAVFVLSTLQQIEPTPGQVIALVLCHTRELAYQICHEFERFSTYLPDTKVAVFYGGVNIKTHRDLLKNECPHVVVGTPGRILALARDKELSLKNVRHFILDECDKMLESLDMRRDVQEIFKMTPHDKQVMMFSATLSKEIRPVCKKFMQDPMEIYVDDEAKLTLHGLVQHYIKLTELEKNRKLNDLLDALDFNQVVIFVKSVSRAAELNKLLIECNFPSICIHSGMSQEERLTRYKGFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 108201 - DNA, 1687 bp, Hordeum vulgare
  CDS (165)..(1409)
gaattcccgggtcgacagcgaaggctcctcccatcccctccccccaccgcctccaccgacgcatcgatcgaatccgggacacgatctcggattcgctcggccaatcgacgcgcaccagccccccggatcgtcgttcgtactcccccaccgcgagcgcttcagccatggcaggaatggcaccagagggttcccagtttgatgctaagcactatgacagtaagatgactgagttactgaaccaaggtgacactgaggagtttttcacctcatatgatgaggtgcatgaaagttttgatgacatgggcctccaagagaaccttcttagaggcatctatgcttatggttttgagaagccatcagccattcagcaaagaggaattgttcccttctgcaagggtcttgatgtgattcaacaagctcagtctggtacaggaaaaactgccaccttctgttctggaatcttgcagcagcttgactatggattggttgagtgccaggcattggtccttgctccgacccgtgagcttgcacagcagattgagaaggtcatgcgtgctcttggtgactacttaggcgtcaaggtgcatgcatgtgttggtggaacttctgtccgtgaggatcagaggattcttgccagtggtgtgcatgttgttgtcggcacacctggtcgtgtgttcgatatgttgcgcaggcaatccctccgcccagataacatcaagatgtttgtgttggatgaagctgatgagatgctatcacgtggtttcaaggatcagatctatgatatcttccagcttcttccatcaaagattcaggttggggtgttctctgctaccatgcctcctgaggctcttgagataacccgcaagttcatgaacaagcccgtgaggattcttgtcaagagagatgagcttacccttgagggtatcaagcaattctatgtcaatgttgagaaggaagagtggaagctggacacactctgtgacctgtacgagaccttggcaattacccagagtgtcatctttgtgaacacccgccgcaaggtggactggctcaccgacaagatgaggggaagggaccacactgtctctgcaacacacggagacatggaccagaacactagggacatcatcatgagggagttcagatctggctcttctcgtgtgctcatcaccaccgacctgctggcccgtggtattgatgtgcagcaagtctcccttgtcatcaactacgacctgccgacccagcctgagaactacctccatcgcattggtcgtagtggtcggttcgggaggaagggagttgccatcaacttcgtcacccgtgaagatgagaggatgctgttcgacatccagaagttctacaacgtggtcattgaggagctcccggccaatgtcgccgaccttctctagattattatcataggaatgcagtaaggtgctcgataaagttcgtttttgttgaatatctcccaactctcagttttggagtggtaaggtctggttctgtttgaatcgcggttaaggatcgagtttttttctttttcttgttatgcaatgtccggaaatttttgtagtgcgtaggctgtgccaactcccgggctagctgggatagagtgacactgatggagtttttacttctcgttgtgaagctattttattgcccctctgtttttaaaaaaaaaaaaaaa

SEQ ID NO: 108202 - protein, 414 aa, Hordeum vulgare
MAGMAPEGSQFDAKHYDSKMTELLNQGDTEEFFTSYDEVHESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVEKEEWKLDTLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTREDERMLFDIQKFYNVVIEELPANVADLL

SEQ ID NO: 108203 - DNA, 1239 bp, Brassica napus
  CDS (1)..(1239)
atggcaggatccgcaccagaaggcactcagtttgatgctcgtcagttcgaccagaagttgaacgaagttcttgagggacaggatgagttcttcacctcttacgatgaatcccacgacagctttgacgccatgggtctccaagagaatctcctcaggggtatctacgcttacggtttcgagaagccttctgctatccagcaaagaggaatcgttcccttttgcaaaggcctcgacgtgatccagcaggcccagtccggtaccggcaaaaccgccactttctgctccggcgtcctccagcagctagactactccctcgtccagtgccaagccctcgtcctcgccccgaccagagagctcgcccagcagatcgagaaggtcatgagagccctcggcgactacctcggcgtcaaggtccacgcctgcgtcggcgggaccagcgtccgcgaggaccagcgcatcctccaggccggcgtccacgtcgtcgtcggcaccccggggcgcgtgttcgacatgctgaagcgccagtccctccgcgccgacaacatcaagatgttcgtcctggacgaggccgacgagatgctctcccgcgggttcaaggaccagatctacgacatcttccagctcctcccgccgaagatccaggtgggagtcttctcggcgaccatgccgccggaggctctcgagatcacgaggaagttcatgagcaagccggtgaggatcctggtgaagcgcgacgagctgaccttggaaggtatcaagcagttttacgtcaacgttgagaaggaagactggaagctcgagacgctctgcgacctctacgagacgctggccatcactcagagcgtcatcttcgtgaacactaggcggaaggttgactggctcactgataaaatgagggggcgtgaccacacggtctcggcgactcacggagacatggaccagaacactagagacattatcatgagagagttcaggtctggctcttcgcgtgtgctgatcaccactgatctcttggctcgtggtatcgatgttcagcaggtgtctttggtgatcaactacgatctgccgactcagcctgagaactaccttcaccgtattggaagaagtgggaggtttgggaggaaaggtgtggcgatcaactttgtgaccaaggatgatgagaggatgctgtttgatattcagaagttttacaacgtggttgttgaggagctgccttccaacgttgctgatctgctgtga

SEQ ID NO: 108204 - protein, 412 aa, Brassica napus
MAGSAPEGTQFDARQFDQKLNEVLEGQDEFFTSYDESHDSFDAMGLQENLLRGIYAYGFEKPSAIQQRGIVPFCKGLDVIQQAQSGTGKTATFCSGVLQQLDYSLVQCQALVLAPTRELAQQIEKVMRALGDYLGVKVHACVGGTSVREDQRILQAGVHVVVGTPGRVFDMLKRQSLRADNIKMFVLDEADEMLSRGFKDQIYDIFQLLPPKIQVGVFSATMPPEALEITRKFMSKPVRILVKRDELTLEGIKQFYVNVEKEDWKLETLCDLYETLAITQSVIFVNTRRKVDWLTDKMRGRDHTVSATHGDMDQNTRDIIMREFRSGSSRVLITTDLLARGIDVQQVSLVINYDLPTQPENYLHRIGRSGRFGRKGVAINFVTKDDERMLFDIQKFYNVVVEELPSNVADLL

SEQ ID NO: 108205 - DNA, 1227 bp, Brassica napus
  CDS (1)..(1227)
atggcggaagcgaatcctggccgtggaggtggaagaagaagcggcggaccaatggacgacgacaaattggtcttcgagacgacggaagggatcgagcccatcacgaatttcaacgacatggggatcaaggaggacgttctccgcggcgtctacgagtacggtttcgagaagccctccgcgattcagcagagagcggtcatgccgattctccaaggccgagatgtgatcgctcaggctcagtccggtaccggaaagacctcaatgattgctctctccgtctgccaaatcgttgacacttcgtctagagaagttcaggcgttgatattgtcgccaacgagggagctggcttcacagacggagaagactattcaagctattgggttgcacgctaatattcaggcgcatgcgtgtattggtgggaagagcgttggagaggatatcaggaagctggagaatggtgtccatgttgtgtctgggacgcctgggcgtgtttgtgatatgattaagaggaggagtctgcgtaccagagctattaagcttttgattcttgatgaatctgatgagatgctgagcagagggttcaaggaccaaatatatgatgtttacagatatcttccacctgatcttcaggtttgcttggtttctgcaactcttcctcacgagattttggagatgacatcaaagtttatgacggaaccagtgaagatacttgtgaagcgtgatgagttgactcttgaaggcattaaacaatttttcgttgctgttgagaaagaggaatggaaatttgatacactctgtgatctttatgacacgcttactatcactcaagctgttatcttctgcaacactaaacgaaaggtggattggctaagtgagaaaatgaggactaacaacttcacagtctcatcaatgcacggtgacatgcctcagaaggaaagagacgaaatcatgaatcagttccggtcaggcgacagtcgtgttttgatcacgacagatgtatgggcacgtgggattgacgtgcaacaagtttctctcgtcatcaattatgatctccccaacaaccgtgagctctacatccatcgtattggacgatctggtcgtttcggccgtaagggtgttgcgatcaactttgttaaaagcgacgacatcaagatcctccgggacattgagcagtactacagtactcagattgacgagatgccaatgaatgtagctgatcttatctaa

SEQ ID NO: 108206 - protein, 408 aa, Brassica napus
MAEANPGRGGGRRSGGPMDDDKLVFETTEGIEPITNFNDMGIKEDVLRGVYEYGFEKPSAIQQRAVMPILQGRDVIAQAQSGTGKTSMIALSVCQIVDTSSREVQALILSPTRELASQTEKTIQAIGLHANIQAHACIGGKSVGEDIRKLENGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDWLSEKMRTNNFTVSSMHGDMPQKERDEIMNQFRSGDSRVLITTDVWARGIDVQQVSLVINYDLPNNRELYIHRIGRSGRFGRKGVAINFVKSDDIKILRDIEQYYSTQIDEMPMNVADLI

SEQ ID NO: 108207 - DNA, 1233 bp, Brassica napus
  CDS (1)..(1233)
atggcaggatcggcaacacagtttgatgatgcgcgtcagtttgatcaggcactcagtgaaatcctggagggacacgatgagttcttcacctcctatgatgaggtttatgagagttttgatggcatgggtttgcaagagaaccttcttaggggtatctatgcttatggttttgaaaagccttctgctattcagcaaagaggaatcgtacccttttgcaagggtcttgatgtgatccagcaggcacagtctggtactggaaaaaccgcaactttctgttctggtgtcttgcagcagcttgacgtcacccttgtccagtgccaagctctggtcttggctcccaccagggagcttgctcagcagattgagaaggtcatgcgtgctctcggagactacattggcgtcaaggttcatgcctgtgttggtggtaccagtgttcttgacgataagcgtatcctccaagctggtgtccatgttgttgttggaactccaggtcgtgtctttgacatgctccaaagacagtctcttcgctctgactgcatcaagatgtttgtccttgatgaagctgatgagatgctctcccgtggtttcaaggatcagatctatgacatattccagcttctcccaccaaagattcaggtcggagtgttctcagctacaatgccaccagaagctctcgagatcacaaggaagttcatgagcaaaccagtgagaatcctggtgaagcgtgacgagctaacgctcgaaggtatcaagcagttctacgtgaacgtggagaaagaagagtggaagctcgaaactctctgtgacctctacgagaccttagccatcactcagagcgtcatcttcgtcaacactcgccgcaaggtggactggctcacagacaaaatgagaagccgtgaccacacggtctcagccactcacggagacatggaccaaaacacgagagacatcatcatgagagagttcaggtctggttcttctcgtgttctcatcacaaccgatctcttggctcgtggtatcgatgtgcagcaagtgtctctggtcatcaactttgacctcccaactcagccggagaattaccttcaccgtatcggaagaagtggaaggtttgggaggaaaggtgcggcgattaactttgtgactcgtgatgatgagagaatgcttgctgatattcagaaattctacaatgttgttgttgaggagcttccatcaaacctagccgatctgctttga

SEQ ID NO: 108208 - protein, 410 aa, Brassica napus
MAGSATQFDDARQFDQALSEILEGHDEFFTSYDEVYESFDGMGLQENLLRGIYAYGFEKPSAIQQRGIVPFCKGLDVIQQAQSGTGKTATFCSGVLQQLDVTLVQCQALVLAPTRELAQQIEKVMRALGDYIGVKVHACVGGTSVLDDKRILQAGVHVVVGTPGRVFDMLQRQSLRSDCIKMFVLDEADEMLSRGFKDQIYDIFQLLPPKIQVGVFSATMPPEALEITRKFMSKPVRILVKRDELTLEGIKQFYVNVEKEEWKLETLCDLYETLAITQSVIFVNTRRKVDWLTDKMRSRDHTVSATHGDMDQNTRDIIMREFRSGSSRVLITTDLLARGIDVQQVSLVINFDLPTQPENYLHRIGRSGRFGRKGAAINFVTRDDERMLADIQKFYNVVVEELPSNLADLL

SEQ ID NO: 108209 - DNA, 1227 bp, Brassica napus
  CDS (1)..(1227)
atggcggaagcgaatcctggccgtggaggtggaagaagaggcggcggaccaatggacgacgacaaattggtcttcgagacgacggaagggatcgagcccatcacgaatttcaacgatatggggatcaaggaggacgttctccgcggcgtctacgagtacggtttcgagaagccctccgcgattcagcagagagcggtcatgccgattctccaaggtcgagatgtgatcgctcaggctcagtccggtaccggaaagacctccatgattgctctctccgtctgccaaatcgttgacacttcgtctagagaagttcaggcgttgatattgtccccgacgagagagctggcttcgcagacggagaagactattcaagctattgggttgcacgctaatattcaggcgcatgcgtgtattggtgggaagagcgttggagaggatatcaggaagctggagaatggtgtccatgttgtgtctgggacgcctgggcgtgtatgtgatatgattaagaggaggagtctgcgtaccagagctattaagcttttgattcttgatgaatctgatgagatgctgagcagggggtttaaggaccagatatatgatgtttacagatatcttccgcctgatcttcaggtttgtttggtttctgcaactcttcctcacgagattttggagatgacatcaaagtttatgacggagccagtgaagatacttgtgaagcgtgatgagttgactcttgaaggcattaaacaatttttcgttgctgttgagaaagaggagtggaaatttgatacgctctgtgatctttatgacactcttactatcactcaagctgttatcttctgcaacactaaacgaaaggtggattggctaagtgagaaaatgaggactaacaacttcacagtctcatcaatgcatggtgacatgcctcagaaggagagagacgagatcatgaatcagtttcggtcaggggacagtcgtgttttgatcacgacagatgtatgggcacgtgggattgatgtgcagcaagtttctcttgtgatcaattatgatctccccaacaaccgtgagctctacatccatcgtattggacgatctggtcgtttcggccgtaagggtgttgcgatcaactttgttaaaagcgacgacatcaagatcctccgggacattgagcagtactacagtactcagattgacgagatgccaatgaatgtagctgatcttatctaa

SEQ ID NO: 108210 - protein, 408 aa, Brassica napus
MAEANPGRGGGRRGGGPMDDDKLVFETTEGIEPITNFNDMGIKEDVLRGVYEYGFEKPSAIQQRAVMPILQGRDVIAQAQSGTGKTSMIALSVCQIVDTSSREVQALILSPTRELASQTEKTIQAIGLHANIQAHACIGGKSVGEDIRKLENGVHVVSGTPGRVCDMIKRRSLRTRAIKLLILDESDEMLSRGFKDQIYDVYRYLPPDLQVCLVSATLPHEILEMTSKFMTEPVKILVKRDELTLEGIKQFFVAVEKEEWKFDTLCDLYDTLTITQAVIFCNTKRKVDWLSEKMRTNNFTVSSMHGDMPQKERDEIMNQFRSGDSRVLITTDVWARGIDVQQVSLVINYDLPNNRELYIHRIGRSGRFGRKGVAINFVKSDDIKILRDIEQYYSTQIDEMPMNVADLI

SEQ ID NO: 108211 - DNA, 1245 bp, Zea mays
  CDS (1)..(1245)
atggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttctgagaggcatttatgcatatggttttgagaaaccatctgcaattcagcagagaggaattgttcccttctgcaaggggcttgatgtcattcagcaagcacaatctggtacaggaaagacagcaaccttctgttctgggatcttgcagcagcttgactatggtctggttgaatgccaggccctggtccttgctcccacccgtgagcttgcacagcaaatcgagaaagtcatgcgcgcgcttggtgactaccttggtgttaaggtccatgcatgtgtgggaggaacatccgtccgtgaggaccaaaggattctcgccagtggtgtgcatgttgttgttggtacacctggtcgtgtgtttgacatgctgcgtagacagtccctccgccctgataacatcaagatgtttgttcttgatgaagctgatgaaatgctttctcgtggtttcaaggatcagatttatgacatcttccagcttctgccatccaagattcaggttggagtcttctctgctaccatgccacctgaggcccttgagattacccgcaagttcatgaacaaaccagtgagaattcttgtgaagagagatgagctgacccttgagggtatcaagcagttctatgtgaatgtggacaaggaagactggaagctggacacactgtgtgacctgtatgagaccctggccattacccagagtgtcatctttgtcaacacccgccgcaaggtggactggctcactgacaagatgaggagcagggaccacaccgtttctgccactcatggtgacatggaccagaacactagagacatcatcatgagggagttccggtctggctcctcccgtgtgctcatcaccaccgacctgcttgctcgtggtattgatgttcagcaggtgtccctggtcatcaactatgatctccccacccagccagagaattacctgcatcgcattggtcgtagtggtcgtttcggtaggaagggtgttgccatcaactttgtgacccgcgacgacgagcggatgctgttcgacatccagaagttctacaacgtgttgattgaggagctgcctgccaacgtcgctgaccttctgtga

SEQ ID NO: 108212 - protein, 414 aa, Zea mays
MAGMAPEGSQFDAKHYDSKMQELLSTGETEEFFTSYDEVFESFDDMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNVDKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQKFYNVLIEELPANVADLL

SEQ ID NO: 108213 - DNA, 1224 bp, Zea mays
  CDS (1)..(1224)
atggcggcgcccaccacctcccgccgcggccccggcggcgcgcgcaacatggacgacgagaacctcaccttcgagacctccccgggggtcgaggtcgtcagcagcttcgaccagatgggcatcaaggacgacctcctccgcggcatctacggctacggtttcgagaagccctccgccatccagcagcgcgccgtgctccccatcatcaacggccgcgacgtcatcgcgcaggcccagtccggcaccggcaagacgtccatgatctccctcaccgtctgccagatcgtcgacaccgccgtgcgcgaggtgcaggctttgattctctcgcctactagggagcttgcttcccaaacagagagagttatgctggctattggggaccacctcaacgtccaagtacatgcttgcattggtggaaaaagtatcggtgaggatatcaggaggctcgagaatggggtgcatgttgtctcgggaactccaggcagagtctgtgatatgatcaagaggaggaccttgcgaacaagagccatcaagcttctagttctggatgaagctgatgagatgttgagtagaggctttaaggatcagatttatgatgtctacagatatctcccgccagaacttcaggtggttttgatctctgcaactcttcctcatgagatcttggagatgactagtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttga

SEQ ID NO: 108214 - protein, 407 aa, Zea mays
MAAPTTSRRGPGGARNMDDENLTFETSPGVEVVSSFDQMGIKDDLLRGIYGYGFEKPSAIQQRAVLPIINGRDVIAQAQSGTGKTSMISLTVCQIVDTAVREVQALILSPTRELASQTERVMLAIGDHLNVQVHACIGGKSIGEDIRRLENGVHVVSGTPGRVCDMIKRRTLRTRAIKLLVLDEADEMLSRGFKDQIYDVYRYLPPELQVVLISATLPHEILEMTSKFMTEPVRILVKRDELTLEGIKQFFVAVEKEEWKFDTLCDLYDTLTITQAVIFCNTKRKVDWLTEKMRTNNFTVSAMHGDMPQQERDAIMGEFRSGATRVLITTDVWARGLDVQQVSLVINYDLPNNRELYIHRIGRSGRFGRKGVAINFVRKDDIRILRDIEQYYSTQIDEMPMNVADLI

SEQ ID NO: 108215 - DNA, 1500 bp, Zea mays
  CDS (1)..(1500)
atgcaccagcctagagctcgctacccacccggctatggctccggcggtggaggcggagccggacgtggcggtggaggcggaaatggaggaggtggcggaaaccacaactactacggccgaaacccgcagcaacaccactaccaccagcagcagcagtcgcagcactctcataggaactcttcgtaccagcaacagtggctgcggcgagaccaggcccccgccgttgcgggggcagcgtccggaaacgctgtggccaagacggcgtctcagcttgacgccgtaggctcgagctcccaagactggaaggctcaactaaatataccagctccagatacacgctacaggacagaggatgtcactgcaacaaaaggcaatgagtttgaagattatttcttgaaacgtgaactgcttatgggaatctacgaaaagggatttgaaagaccatctcctattcaagaagaaagcattcctattgcgctgactggaagtgatattcttgcaagggcaaaaaatggcactggaaagactgctgccttttgcattccggcacttgaaaaaattgatcctgaaaataatgcaattcaagttgttatactagtaccaacaagggaactggctctgcaaacttcacaagtgtgtaaagagcttgggaaatacctaaacattgaagttatggttagcactggaggaaccagcttgaaggatgacatcatgcgtttataccaacctgttcatctactcgttgggactcctggccgaatacttgatcttaccaggaagggcatttgtgtgctgaaagattgttcaatgcttgtcatggatgaggcagacaagctattagctccagagttccagccttctgtggaggcacttattcatttccttccacctagtcggcagctgttgatgttttcagcaacctttcctgtaactgtcaaggaattcaaagagaaatatctgcctagaccttatgtgattaatctaatggacgaactgaccctgaaaggaatcacacaatattatgcttttgttgaagaaaggcagaaagttcattgcctgaatacacttttctcaaagcttcaaattaatcaatccattatattctgcaactctgttaatagagttgagctgctggctaaaaaaataactgaactcggttattcatgcttctacattcatgctaagatgttgcaagaccacagaaatcgagtatttcatgattttcgtaatggtgcttgcagaaaccttgtgtgcacagatctgtttaccagaggaattgatatccaggctgttaatgtggtcattaattttgacttccctaagacatctgagacatacttacacagggttggccgttctgggagatatggacaccttggtttggcagtgaacttgatcacttatgaagaccgtttcaacttatataggattgagcaagaacttggaacggaaattaagacaatacccccacagattgacctgtccatatactgccaatga

SEQ ID NO: 108216 - protein, 499 aa, Zea mays
MHQPRARYPPGYGSGGGGGAGRGGGGGNGGGGGNHNYYGRNPQQHHYHQQQQSQHSHRNSSYQQQWLRRDQAPAVAGAASGNAVAKTASQLDAVGSSSQDWKAQLNIPAPDTRYRTEDVTATKGNEFEDYFLKRELLMGIYEKGFERPSPIQEESIPIALTGSDILARAKNGTGKTAAFCIPALEKIDPENNAIQVVILVPTRELALQTSQVCKELGKYLNIEVMVSTGGTSLKDDIMRLYQPVHLLVGTPGRILDLTRKGICVLKDCSMLVMDEADKLLAPEFQPSVEALIHFLPPSRQLLMFSATFPVTVKEFKEKYLPRPYVINLMDELTLKGITQYYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKTSETYLHRVGRSGRYGHLGLAVNLITYEDRFNLYRIEQELGTEIKTIPPQIDLSIYCQ

SEQ ID NO: 108217 - DNA, 1578 bp, Zea mays
  CDS (1)..(1578)
atggatccacgcgccaggtatccttcgggcatgggcaacggccgcggtgggaacctcaactactacggccgcggcccaccgccgcaacagccgcatcagcaccacaaccaccagcagacgtcgggggcgcaccaccaccagcagacgtcgggggcgcaccaccaccagcagtacgcgcagaggcagcaccagcaccagcaccacggccacaatcgccatcagcaacagcagcagcaccacatttaccagcagcaacagcagcagtggctgcggcggagccagattgcccgcgagacctcgggcgcagccgtgaccagcgagccgaagtccctggcgccatccacggccgccgatggcgtcgattcgagttcacaagattggaaggcccaattgaagctgccgcctccagatacacgctacaggacagaggatgttacagctaccaagggaaatgagtttgaagactattttctcaagcgtgaactcctaatgggtatatacgagaagggatttgaaagaccgtctcctatccaagaggaaagcattcctattgctttaactggtagtgacattcttgcaagagcgaagaacggaactggcaagactgctgcattttgtattcctgcactggaaaagattgatcaagaaaaaaatgctattcaagttgttatattggttcccacaagggaattggctctgcaaacatcacaagtttgcaaggagcttggtaagcatttgaagatccaggttatggtcaccactggtggaaccagtttgaaggatgatattgttcgtctgtaccaacctgtgcacttactcgttggaacacctgggcgtattttggatcttacaaagaaaggtgtttgcattttgaacgactgttcaatgcttattatggatgaggcagacaagcttctctctcctgagtttcaaccttccatagaacagttgattcgctacctccctgctagtcgacagattttgatgttttcagcgacattccctgtgactgttaaggagtttaaggacaaatatctgcctaaaccttatgtgattaaccttatggacgaacttacactgaagggaattacacagttctatgcttttgtggaagaaagacagaaagttcactgtctcaacactctcttttccaagcttcaaatcaaccagtcaataatattttgtaactctgtaaatcgtgttgaactattggcgaaaaagatcacagagcttggctattcttgcttctatattcatgcaaagatgctacaggaccaccgtaatagagttttccatgatttccgtaatggagcatgcaggaaccttgtttgcactgatctttttacaaggggaatagatattcaagctgtgaatgttgttatcaattttgatttccccaagaactctgaaacatatctccacagggttggtagatctgggagatttggtcaccttggtctggccgttaatttgatcacctatgaggatcggtttaacttgtataggattgaacaagagcttgggactgaaataaaatcaattcctcctcagatagaccaggctatatactgccaataa

SEQ ID NO: 108218 - protein, 525 aa, Zea mays
MDPRARYPSGMGNGRGGNLNYYGRGPPPQQPHQHHNHQQTSGAHHHQQTSGAHHHQQYAQRQHQHQHHGHNRHQQQQQHHIYQQQQQQWLRRSQIARETSGAAVTSEPKSLAPSTAADGVDSSSQDWKAQLKLPPPDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIVRLYQPVHLLVGTPGRILDLTKKGVCILNDCSMLIMDEADKLLSPEFQPSIEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKSIPPQIDQAIYCQ

SEQ ID NO: 108219 - DNA, 2301 bp, Zea mays
  CDS (1)..(2301)
atgtcgaagcggccgaagctcgagggtttcagcatcccgcggcccacctcctacaacttcgagcgctcgcagtccgtgcagcggctctaccgtccgaccgatgacccagacctcgacgacatcgccttctccgacgacgccccctcagatgcccaagccagcaccgcggtagaaggaaaggccgagaatgaggaggagatggacccgctcgacgccttcatggccgagatccaggaggagatccgtgcgccgcccccgccgcccaagcccgaggcgcttcgccgcacggattccgacgatgacgaggatgaccccgtcgagagcttcctgcgggccaagaaggacgctggcctcacgctggccgccgacgtcatgcgcgctggttacgactccgatgaggaggtctacgccgctgccaaggccgtcgacgccggcatgatggaatacgactctgatgacaaccccatagtcatcgacaagaagaaaatagagcccataccagcactcgatcactcgaccattgagtatgacgccttcacaaaagatttctacgaggagaagccatcgatttcaggtatgagtgaccaagaggtaacagattatatgaaaagtttgtcaattcgtgtttctggttttgatgtgccgaggccaataaaaaactttgaggattgtgggtttcatgtacctctaatgaatgctattgccaaacaagcttatgaaaaaccaactacaattcagtgccaggctttacctattgtactttcagggagagatatcattggtattgcaaaaactggctctggtaaaactgcagcttttgtgctccctatgattgttcatattatggatcagcctgagcttgagaaagaagaaggtccaataggagtcatttgtgctccaacaagagaattggcacatcagatatatctcgaagctaagaagtttgcaaagccttacaaccttcgagttgctgctatatatggtggtgtttccaaatttgaccagtttaaagaactgaaagcaggttgtgaaatagtcattgcaactccagggagattaatagacttgctgaagatgaaggcattgaagatgttcagggcaacttatctggttcttgatgaagctgatcgaatgttcgatcttggatttgagccacaaatacgatccattgttggtcaaattagaccagatcgacaaactttacttttttctgcaacaatgccatacaaagtagagcgtttggcaagagaaatattaactgatcctattagagttacagttggtcaagttggcggtgctaatgaagacattaaacaagttgttaatgtactcccttctgatgttgagaaaatgccttggcttttggagaaattgcctggaatgattgatgatggagatgttcttgtattcgcatctaaaaaggctagagtggacgagatagagaaagagttgaatcagagaggattcagaattgctgcgcttcatggcgacaaggatcaagcttctcgtatggagaccctgcagaagttcaaatctgggacatttcatgttctggttgcaactgatgttgctgcacgaggtcttgacatcaaatcgattaaaacagttgtcaactttgatattgcaaaagagatggatatgcatattcaccgaattggaagaactggtcgtgctggcgataaagatggcactgcatatactctgattacacagaaggaggcacattttgctggtgaactggttcacagtttgattgctgctggccaggatgtacccaatgaactcatggatctggctatgaaggatggaagattcagagcaaaacgagactccaggaaaggtgggaagaaaggtggcaaaggaaaaggtggtgttggcggtgctgggcgcgggcgcggtgtgcgtggagttgattttggcctcggcataggttacaatgccgaatctggttcacaagtgcctgctgcaagatctgctgctgtaaattctctgaagacagggatgttgcaacgatttaagagcagctttgtctctggatcttcaaatacaccaagcagcagtgcaccttcctttgtaagaccagcactccgtggctttgtgtctggcggcaccattggaggagacacacggcctgcacaggcagcccccactttcatccctgcatcccggcctgcacagcctgcccccgcggtccctgcatcccagcctgcaggaaataacaacgaaaatgggaacccgaatccagaaagttcacgggatcagttcagggagagaaaacgaccatcaggttgggatcgctag

SEQ ID NO: 108220 - protein, 766 aa, Zea mays
MSKRPKLEGFSIPRPTSYNFERSQSVQRLYRPTDDPDLDDIAFSDDAPSDAQASTAVEGKAENEEEMDPLDAFMAEIQEEIRAPPPPPKPEALRRTDSDDDEDDPVESFLRAKKDAGLTLAADVMRAGYDSDEEVYAAAKAVDAGMMEYDSDDNPIVIDKKKIEPIPALDHSTIEYDAFTKDFYEEKPSISGMSDQEVTDYMKSLSIRVSGFDVPRPIKNFEDCGFHVPLMNAIAKQAYEKPTTIQCQALPIVLSGRDIIGIAKTGSGKTAAFVLPMIVHIMDQPELEKEEGPIGVICAPTRELAHQIYLEAKKFAKPYNLRVAAIYGGVSKFDQFKELKAGCEIVIATPGRLIDLLKMKALKMFRATYLVLDEADRMFDLGFEPQIRSIVGQIRPDRQTLLFSATMPYKVERLAREILTDPIRVTVGQVGGANEDIKQVVNVLPSDVEKMPWLLEKLPGMIDDGDVLVFASKKARVDEIEKELNQRGFRIAALHGDKDQASRMETLQKFKSGTFHVLVATDVAARGLDIKSIKTVVNFDIAKEMDMHIHRIGRTGRAGDKDGTAYTLITQKEAHFAGELVHSLIAAGQDVPNELMDLAMKDGRFRAKRDSRKGGKKGGKGKGGVGGAGRGRGVRGVDFGLGIGYNAESGSQVPAARSAAVNSLKTGMLQRFKSSFVSGSSNTPSSSAPSFVRPALRGFVSGGTIGGDTRPAQAAPTFIPASRPAQPAPAVPASQPAGNNNENGNPNPESSRDQFRERKRPSGWDR

SEQ ID NO: 108221 - DNA, 1422 bp, Zea mays
  CDS (1)..(1422)
atgaacccgtatgatctccgcttcgctgacccctcatcctaccacgacaggcgcagcgacttgaccgtggctcctacgttcgctccgccggctcccgtggctgcggcgaacctgaacccttacgccgccgcctacccgctgcctgtgcccgttcccgtgcccgcggcccccgcgggcggcgactaccagcgctacgggcagggaggcagaggccgtggtggcggtggcagaggcggtggaggagggtacggaggtggcggcagaggaggaggtcgcgggagggacgggcttgactcgctcgccctccctaagccggactttcggagcctgataccgttcgagaaaaacttctacgtggagtgtccctccgtccaggcaatgtcggaggcggatgtggcgcagtaccgccgcctccgggatatcaccatcgagggccgggatgtgcccaagccggttagatacttccaggaagccaacttcccagattactgcatgcaagctattgccaaatctggatttgtggagccaacacctattcaatctcaaggttggcctatggctttgaagggtagggacctgattggtatcgctcaaacaggctcagggaaaacattatcttatctgttacctgggttggttcatgttggtgcccagcctcggctagaacaaggcgatggcccaattgtattaattctcgctcccacgagagaactggctgttcaaatacaggaagaatctacaaaatttggatcatattcaagaactagaagcacatgtgtctatggtggtgcacctaagggtccacaaatacgggaccttagaagaggagttgaaattgtcattgcaactcctggccggttgattgatatgctggaagctggtcacacaaacctacgtagagtgacataccttgtgttggatgaggcggaccggatgctagatatggggtttgagccccaaattcggaaaatagtagcacagatccgcccagacaggcaaaccttgtactggagtgccacatggcctagagaagttgaagccttagcaagacagtttctacaaaatccttacaaggtaatcataggctcacctgaacttaaagctaatcattccatacaacaaattgttgaagttatttcagatcatgagaagtatccaagactcagtaagctcttgtctgatctaatggatgggagccgtatcttgatattcttccaaacaaaaaaggattgcgataagatcacccggcagcttagaatggatgggtggccagcattatctatacatggtgataaagctcaagctgaacgggactatgttcttgcagagtttaagagcggcaagagccccataatggctgccacagatgtggcagcacgtggtcttggtatgatgatttatttgaatattaggattaggtag

SEQ ID NO: 108222 - protein, 473 aa, Zea mays
MNPYDLRFADPSSYHDRRSDLTVAPTFAPPAPVAAANLNPYAAAYPLPVPVPVPAAPAGGDYQRYGQGGRGRGGGGRGGGGGYGGGGRGGGRGRDGLDSLALPKPDFRSLIPFEKNFYVECPSVQAMSEADVAQYRRLRDITIEGRDVPKPVRYFQEANFPDYCMQAIAKSGFVEPTPIQSQGWPMALKGRDLIGIAQTGSGKTLSYLLPGLVHVGAQPRLEQGDGPIVLILAPTRELAVQIQEESTKFGSYSRTRSTCVYGGAPKGPQIRDLRRGVEIVIATPGRLIDMLEAGHTNLRRVTYLVLDEADRMLDMGFEPQIRKIVAQIRPDRQTLYWSATWPREVEALARQFLQNPYKVIIGSPELKANHSIQQIVEVISDHEKYPRLSKLLSDLMDGSRILIFFQTKKDCDKITRQLRMDGWPALSIHGDKAQAERDYVLAEFKSGKSPIMAATDVAARGLGMMIYLNIRIR

SEQ ID NO: 108223 - DNA, 1500 bp, Zea mays
  CDS (1)..(1500)
atgcaccagcctagagctcgctacccacccggctatggctccggcggtggaggcggagccggacgtggcggtggaggcggaaatggaggaggtggcggaaaccacaactactacggccgaaacccgcagcaacaccactaccaccagcagcagcagtcgcagcactctcataggaactcttcgtaccagcaacagtggctgcggcgagaccaggcccccgccgttgcgggggcagcgtccggaaacgctgtggccaagacggcgtctcagcttgacgccgtaggctcgagctcccaagactggaaggctcaactaaatataccagctccagatacacgctacaggacagaggatgtcactgcaacaaaaggcaatgagtttgaagattatttcttgaaacgtgaactgcttatgggaatctacgaaaagggatttgaaagaccatctcctattcaagaagaaagcattcctattgcgctgactggaagtgatattcttgcaagggcaaaaaatggcactggaaagactgctgccttttgcattccggcacttgaaaaaattgatcctgaaaaaaatgctattcaagttgttatactagtaccaacaagggaactggctctgcaaacttcacaagtctgtaaagagctcgggaaatacctaaacattcaagttatggttagcactggaggaactagcttgaaggatgacatcatgcgtttataccaacctgttcatttacttgttgggactcctggccgaatacttgatcttaccaggaagggcatttgtgtgttgaaagactgttcaatgcttgtcatggatgaggcagacaagctattagctccagagttccagccttctgtggaggcacttattcatttccttccacctagtcggcagctgttgatgttttcagcaacctttcctgtaactgtcaaggaattcaaagataaatatctgcctagaccttatgtgattaatctaatggatgaactgaccctgaaaggaatcacacaatattatgcttttgttgaagaaaggcaaaaagttcattgcctgaatacacttttctcaaagcttcaaattaatcaatccattatattctgcaactctgttaatagagttgagctgctggctaaaaaaataactgaactcggttattcatgcttctacattcatgctaagatgttgcaagaccacagaaaccgagtgtttcatgattttcgtaatggtgcttgcagaaaccttgtgtgcacagatctgtttaccagaggaattgatatccaggctgttaatgtggtcattaattttgacttccctaagacatctgagacatacttacacagggttggccgttctgggagatatggacaccttggtttggcagtgaacttgatcacttatgaagaccgtttcaacttatataggattgagcaagaacttggaacggaaattaagacaatacccccacagattgacctgtccatatactgccaatga

SEQ ID NO: 108224 - protein, 499 aa, Zea mays; identical to SEQ ID NO: 68298

SEQ ID NO: 108225 - DNA, 1506 bp, Zea mays
  CDS (1)..(1506)
atgcgcgtggcggagcggaagcgcgcgaggcgacgcggcaacaggaggaggaggccaaggctaaggcgaccgcggcagccgaagcggtggcggcggctcgacgcggcgtcctcttcctcctccatcaccgagccggcggtggaggagcaggccaagcagatcgaggcgctctccctcgccccgtcggtggacgacgccgcaggcgaagagggcccgcccctcctcgatgactccgacgactcgcaaatccaagccgtgatttcgggtggcacggtgtacgagtcggccaccacgttcgaggatctgaagctgtcgcccgagctgcttaaggggctgcacgacgagatggggttcagccgcccgagcaagatccaggcgatcaccctgcccatgatcctcacgccgccctacaaggacctcgtcgcgcaggcgcacaacggctctggcaagaccacctgtttcgtcctcggcatgctcagccgcgtcgacccgcaacgcaagataccccaggctatctgcatttgccccaccagggagcttgcgcagcagaataaggcagttctcatgaggatgggcaagtttactggcattacatgcgcctgtgcaatcccgccagctcaaaaagactacatgccgatctcgaaaatggctccgattactgaccagatcgttatcggcacatctggtacgctcatcaaatggattacccataagaagctggccacaagggacatcaagatacttgtgtttgatgaggcagatcatatgcttgctgaggatggctttaggagtgattctgaaaggatgatgagggatatacaaagaagcgctggtggttgtcaggtgcttctcttttctgcgaccttcaatgatagggtgaaggattttgttacaaaggtcattagggatggaaatcagatatttgtgaagaaggaagagcttactttggaaaaagttaagcagtacaaagttcaggtacctgatgaatcggcaaaaatagaggttataagggacaagatatttgaatttggacagaaagttggccaggttatcatatttgttagaacaaagcaaagtactaagaatgttcacaatgctttgacgagggaggactatgtgtgctcctcaatccaaggatcccttgaccaatcagagagggaaaagataatacaggaattcaaagatggctacaccaaggttcttatatcaactgatgttcttgctcgaggttttgaccaagcacaggttaacctcgtcatcaactacgacatgccaatcaaatttggtacaagagatgaacctgattatgaggtgtacttgcacagaattggcagagctgggcgctttggccggaaaggtgctgtgttcaacttgctgtgtggtcaaaccgataatgttgtgatgaagaagatcgaggactatttccagcacagtgtgcctgaggttcggaattggcaacgtgaagaagattttgaggctgctctcaaggatgcaggtttactttaa

SEQ ID NO: 108226 - protein, 501 aa, Zea mays
MRVAERKRARRRGNRRRRPRLRRPRQPKRWRRLDAASSSSSITEPAVEEQAKQIEALSLAPSVDDAAGEEGPPLLDDSDDSQIQAVISGGTVYESATTFEDLKLSPELLKGLHDEMGFSRPSKIQAITLPMILTPPYKDLVAQAHNGSGKTTCFVLGMLSRVDPQRKIPQAICICPTRELAQQNKAVLMRMGKFTGITCACAIPPAQKDYMPISKMAPITDQIVIGTSGTLIKWITHKKLATRDIKILVFDEADHMLAEDGFRSDSERMMRDIQRSAGGCQVLLFSATFNDRVKDFVTKVIRDGNQIFVKKEELTLEKVKQYKVQVPDESAKIEVIRDKIFEFGQKVGQVIIFVRTKQSTKNVHNALTREDYVCSSIQGSLDQSEREKIIQEFKDGYTKVLISTDVLARGFDQAQVNLVINYDMPIKFGTRDEPDYEVYLHRIGRAGRFGRKGAVFNLLCGQTDNVVMKKIEDYFQHSVPEVRNWQREEDFEAALKDAGLL

SEQ ID NO: 108227 - DNA, 1857 bp, Zea mays
  CDS (1)..(1857)
atgtccgccatcgcggcctcctcggccgccgccgccgcggcgtcgaactccgatgaggaagaaaactatgaggagtacatcccagtcgccaagcgccgggccatggaggccgagcgcctccgccagctccgcctctccaagtcggcgccggcctctgccgtctcatcactcccgatgccacctcccccgcctcttttgccagcgcagacctccgttcccgacgccgccgcgaagcccagccttctcgtcaaggccacgcagcttaagcgcgcggccccggaggtgaccgccacggagcagcgcatccagcaggagaaggaagtgattgaaaatctctcagacaacaaatcgctcaggtcagtccgcgagatcgccaagggcatcatctacacggaaccgatccagaccgggtggaagccgcccctccgcctccgccgcatgccgctcgccaaagccaacgagttccggcgcaagtggcacatcatcgtcgacggtgacgatataccgccgcctgcgcgtgatttccgggatctccgcctcccggagcccatgctccggaagctgcgcgagaggggtatcgtccagcccacgccgattcaggtgcaggggctgcccgttgtgctctctgggcgtgacatgataggcatcgctttcacggggtcggggaagactctggtgttcgtgctgccgcttatcatggtggcgctgcaggaggaatcattgatgccgatcgtgcctggcgagggcccgtttgggatgatcatatgcccgtcgcgggaactggccaagcagacatatgatgtgattgagcagtttctcattccacttaaggaggccggttatccggagataaggcatttgctttgtattgggggtgtggatatgaggacacagctcgatgtgttgaagaagggcgtgcacattgtggtggcaacgcctggtcggctcaaggatttgcttgccaagaagaagatgaaccttgacaactgcaggtacttaaccttagatgaagcggataggctggttgacctaggatttgaagatgacatcaaggaggttttcgaccatttcaaggatcaaaggcaaactcttctcttttctgctactatgcctcagaagattcaaaattttgcgaagaacgcccttgtgaaaccagttactgtcaatgtgggaagagctggagcagcaaatctagacgtcattcaagaagtcgaatatgtaaaggaagatgctagaattatatacctccttgaatgcctccaaaagactccacctcctgttctcattttctgtgaaaacaaggctgatgtcgactacatccatgagtaccttcttctaaagggagtggaggctgttgctatccatggaggaaaagatcaagaggagagacagaacgcaattgactccttcaagactggtaggaaggatgttctggtggctactgatgttgcatcgaagggtcttgattttcctgacattcagcatgtcattaactatgacatgcccgccgaaatagagaactatgtccaccgaatcggtcgaactggtcgatgtgggaagactggcatagcaactaccttcatcaacaagaaccaaactgagaccacgcttctcgatctcaagcacctgctgaaggaggcaaagcagaggattccaccggtgttggcggagctcaacgatccattggatgatgaggaaataattgccaaggagagtggtgtcaaaggttgtgcgtattgtggtgggcttggccatcgtgtcagtgactgtccgaagttggagcaccaaaagtccatggcaattgctggctcgagaaaagactactttggcggcgggggttaccgaggagaaatatga

SEQ ID NO: 108228 - protein, 618 aa, Zea mays
MSAIAASSAAAAAASNSDEEENYEEYIPVAKRRAMEAERLRQLRLSKSAPASAVSSLPMPPPPPLLPAQTSVPDAAAKPSLLVKATQLKRAAPEVTATEQRIQQEKEVIENLSDNKSLRSVREIAKGIIYTEPIQTGWKPPLRLRRMPLAKANEFRRKWHIIVDGDDIPPPARDFRDLRLPEPMLRKLRERGIVQPTPIQVQGLPVVLSGRDMIGIAFTGSGKTLVFVLPLIMVALQEESLMPIVPGEGPFGMIICPSRELAKQTYDVIEQFLIPLKEAGYPEIRHLLCIGGVDMRTQLDVLKKGVHIVVATPGRLKDLLAKKKMNLDNCRYLTLDEADRLVDLGFEDDIKEVFDHFKDQRQTLLFSATMPQKIQNFAKNALVKPVTVNVGRAGAANLDVIQEVEYVKEDARIIYLLECLQKTPPPVLIFCENKADVDYIHEYLLLKGVEAVAIHGGKDQEERQNAIDSFKTGRKDVLVATDVASKGLDFPDIQHVINYDMPAEIENYVHRIGRTGRCGKTGIATTFINKNQTETTLLDLKHLLKEAKQRIPPVLAELNDPLDDEEIIAKESGVKGCAYCGGLGHRVSDCPKLEHQKSMAIAGSRKDYFGGGGYRGEI

SEQ ID NO: 108229 - DNA, 1722 bp, Zea mays
  CDS (1)..(1722)
atgaggctaagtattgggcaagtccatcgaaatgttcttgcgctggcatcttctcggtcatgttttgttctgggagatcgtgtttcgttcaggatgctgtcccaaccacgggtagctggatttcatcagactgcttggcgtggtagtcaaattttggaagataacaggggaggaccattgactcttgctagcctagaagtgcaaagcagggttgaatatggaaaaaaggggaaaatggaacgaactggaggtccaaagccaagttcaagagcttcttccctctatgtgaaaccaaaggtttcttcaaatgtcaaaccagcaaagagtgccttgatgaagccagctgggataaagaagacactgaaggtagatgaggctctgttttcggccaagtcatttgaagaacttggtttgccacctttgcttgttgaccagttgaacaaggaaggtctgactgccccaactgaggtccaatccgcagcaattcctataatagcacaaaagcatgatgttgtgatccagtcatatactggctcagggaaaactcttgcttatcttcttccaattctttctgatataggccctctgaagaggactatggaacaagaccattctgagaaaagatcaggtatagaagcagtcatcgttgctccttcgagagaattaggaatgcagattgtgcgagaagtggagaagattttgggtcctaatgacaaaagactggtccagcaacttgttggcggagctaatcgttccaggcaggaagaagcattgaagaagaacaaaccaatcattgttgtcggaacacctggccgtatttctgaaatttctgcagcaggtaagctacacactcatggctgccgttttcttgtactggatgaagtcgaccagcttctgtcttttaattaccgtgaagatatgcatagaattttggagcatgttggaaggagacctggaggcacatctagggatattcttggcccacttgcgagacgatctgagcgtcagactatcctggtttctgcaacaataccattttcagttatacgagcagcaaggagttggggtcatgatccagttctcattagagctaaaagtgtagttccacttgattcaatcactgtgccaagacctgcgttatcccaaagtgacgctaaccccagttcgtcatcgcagtcagtgaaccaagctgctgttggcagcttgccgccatctttggaacactactattgtacggccaaggcgcagcacaaggttgacacattacggaggtgcatccatgctctggaagcacagacagtgattgcatttatgaacaacaccaagccactgaaggatgttgtgtttaagttggaggcccgtggtatcaaagccactgagctacatggagaccttggaaagcttgcaaggtcgacagttttgaaaaagttcaaggatggtgaattcagagttctcgttacgaatgagctgtctgccagaggactggacgtgccagaatgtgaccttgtggttaatctggaccttccaactgactccacacattatgctcacagagctggaagaactggacgtcttgggcggaaagggatcgtggtcacaatatgcgaagaaagcgagggatttgttgtaagaaaaatgcgcaagcagttagatgtggccatcaagccatgcgagttcactgaaggcgagcttgttgtccacaaggaggaagatgtggaataa

SEQ ID NO: 108230 - protein, 573 aa, Zea mays
MRLSIGQVHRNVLALASSRSCFVLGDRVSFRMLSQPRVAGFHQTAWRGSQILEDNRGGPLTLASLEVQSRVEYGKKGKMERTGGPKPSSRASSLYVKPKVSSNVKPAKSALMKPAGIKKTLKVDEALFSAKSFEELGLPPLLVDQLNKEGLTAPTEVQSAAIPIIAQKHDVVIQSYTGSGKTLAYLLPILSDIGPLKRTMEQDHSEKRSGIEAVIVAPSRELGMQIVREVEKILGPNDKRLVQQLVGGANRSRQEEALKKNKPIIVVGTPGRISEISAAGKLHTHGCRFLVLDEVDQLLSFNYREDMHRILEHVGRRPGGTSRDILGPLARRSERQTILVSATIPFSVIRAARSWGHDPVLIRAKSVVPLDSITVPRPALSQSDANPSSSSQSVNQAAVGSLPPSLEHYYCTAKAQHKVDTLRRCIHALEAQTVIAFMNNTKPLKDVVFKLEARGIKATELHGDLGKLARSTVLKKFKDGEFRVLVTNELSARGLDVPECDLVVNLDLPTDSTHYAHRAGRTGRLGRKGIVVTICEESEGFVVRKMRKQLDVAIKPCEFTEGELVVHKEEDVE

SEQ ID NO: 108231 - DNA, 1224 bp, Zea mays
  CDS (1)..(1224)
atggcggcgcccaccacctcccgccgcggccccggcggcgcgcgcaacatggacgacgagaacctcaccttcgagacctccccgggggtcgaggtcgtcagcagcttcgaccagatgggcatcaaggacgacctcctccgcggcatctacggctacggtttcgagaagccctccgccatccagcagcgcgccgtgctccccatcatcaacggccgcgacgtcatcgcgcaggcccagtccggtaccggcaagacgtccatgatctccctcaccgtctgccagatcgtcgacaccgccgtgcgcgaggtgcaggctttgattctctcgcctactagggagcttgcttcccaaacagagagagttatgctggctattggggaccacctcaacgtccaagtgcacgcttgcattggtggaaagagtattggtgaggacatcaggaggctcgagaatggggtgcatgtcgtctctggaactccaggcagagtctgtgatatgatcaagaggaggacactgcggaccagagccatcaagcttctagttctggatgaagctgatgagatgttgagtagaggctttaaggatcagatttacgatgtctacagatatctccctccagaacttcaggtggttttgatctctgcaactcttcctcatgagatcttggagatgactagtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttga

SEQ ID NO: 108232 - protein, 407 aa, Zea mays; identical to SEQ ID NO: 108214

SEQ ID NO: 108233 - DNA, 2127 bp, Zea mays
  CDS (1)..(2127)
atgtctcccgcccttgccgctggcgtggagcccatggccgtcgacgattccgcctccaagaaggccaagcgcaagcagctcaaggccgccgccgccgccgcggaggcagaggcggaggccgcttcggtcaagaagaaagagaagaaagagaagaagcgaaaggtgaaggagccgtcccctccgctcccatcggccgcgtcctctgatgaggaagagaaaagcagcaccagctccgaggagacagcacccgcggcgaaaaaagcgaagaaggagaagacgaagaagaatgttgatgtctcgtcttcagcctcagatgacgatggcgagatcacagccagcagcgatgaggaccccgcggacccgaacgcgctgacgaacttcaggatatcggagtcgctgaggcagagcctcaggtccaaggggatcaagtcactgttccccattcaggccaccactttcgatctcgtactcgatggcagcgacttggttggccgagcgcgcaccggtcagggaaaaactttggcttttgtcttgcccatattggagtctttggttaatggggcaaacaaggcatctagacggactgaacatggcaggaccccaagtgttctcgttctactaccaacaagagagctggccaatcaggtgcacgctgactttgagttttatggtgcaacatttgggctctctgcatgttgtgtgtatgggggatcaccttatcgtcctcaagaaatggcattgagaagaggtgtggatattgttgttggaactcctggtcgtgtcaaggatttcattgttaaaggaactctcaatttgaaatgcttgaaattccgtgtccttgatgaagctgatgagatgctaaacatgggttttgttgatgatgtcgagctcattcttggcaaggtagaagatgctaccaaagtacagacacttctgttcagtgccactctgccagattgggtgaataagctctctatgaggtttctgaaagttgacaggaaaacagttgatcttgtcggtaacgagaaactgaaggccagtgcatctgttaagcaccttgctcttccttgtaacaaggcagcaagggcacaacttattccagatattatccgatgttacagccatggaggccgaaccattatcttcactgagacgaaggattctgcatcagagctttctggtttgattcctggatcccgtgccttgcatggagatgttgtgcaagctcagcgtgaagtcattcttgctggatttcgtagcgggaagttccaggttttggttgctacaaatgtggcggctcgtggtctggatattaatgatgtgcagcttatcattcagtgtgaacctccccgggacgttgaagcttacatacaccggtcaggtcggacagggagagcaggtaatactggtgttgctgtcatgctttatgagcccagatataagcacagtgtcagcagactagaaagggagtctggggttaaatttgagcatatctctgcgccacaacccactgatgtagcacaatctgctggcagtgaagctgcagatgcaattgcgagtgtgtcagacagtgttattcctatcttcaggcagcaagcagagcagttgctaagctcttccagtctgtctgcagctgacttgcttgccaaagcacttgcaaaggcagttggttacacggacataaagaaaagatcattgttatcttccttggaggattacagtacactacatcttcaaactggcagaccgatgtggtcacctgggtttgcttttactatattgaaaaggttcatgccagaagataaacttgcagatgtaaagggtgccaccctcaccgctgatggaacaggagttgtatttgatgttcctgcagcagatgttgaagattacattcaagcttcggagagtgccgcacaggtgacaattgatgaagtcaagcaactgccacccttgcaagagaaggaccagtcgagaggcaactctgggggaggaagatttggccatggaggtggccggagattttctggtggtggtggcggcggcagagggttttctggccggggaggtggcggcagagggttttctggcagaggaggcggcggcagtagatttaacaggaggaattag

SEQ ID NO: 108234 - protein, 708 aa, Zea mays
MSPALAAGVEPMAVDDSASKKAKRKQLKAAAAAAEAEAEAASVKKKEKKEKKRKVKEPSPPLPSAASSDEEEKSSTSSEETAPAAKKAKKEKTKKNVDVSSSASDDDGEITASSDEDPADPNALTNFRISESLRQSLRSKGIKSLFPIQATTFDLVLDGSDLVGRARTGQGKTLAFVLPILESLVNGANKASRRTEHGRTPSVLVLLPTRELANQVHADFEFYGATFGLSACCVYGGSPYRPQEMALRRGVDIVVGTPGRVKDFIVKGTLNLKCLKFRVLDEADEMLNMGFVDDVELILGKVEDATKVQTLLFSATLPDWVNKLSMRFLKVDRKTVDLVGNEKLKASASVKHLALPCNKAARAQLIPDIIRCYSHGGRTIIFTETKDSASELSGLIPGSRALHGDVVQAQREVILAGFRSGKFQVLVATNVAARGLDINDVQLIIQCEPPRDVEAYIHRSGRTGRAGNTGVAVMLYEPRYKHSVSRLERESGVKFEHISAPQPTDVAQSAGSEAADAIASVSDSVIPIFRQQAEQLLSSSSLSAADLLAKALAKAVGYTDIKKRSLLSSLEDYSTLHLQTGRPMWSPGFAFTILKRFMPEDKLADVKGATLTADGTGVVFDVPAADVEDYIQASESAAQVTIDEVKQLPPLQEKDQSRGNSGGGRFGHGGGRRFSGGGGGGRGFSGRGGGGRGFSGRGGGGSRFNRRN

SEQ ID NO: 108235 - DNA, 1290 bp, Zea mays
  CDS (1)..(1290)
atgatgggagaggccaaggagaacgacgtttatgaggaggagctcctggactacgaggaggacgacgacaagacggtcgatggctccgctgctaagcccaccggagaggtcgcaaagaagggctacgtcgggatccacagttccggtttcagagacttcctgctcaagccagagctgctccgtgctatccaggattgtggttttgagcatccttccgaagtgcaacacgagtgtatccctcaagccattcttggaatggatgtcatctgtcaagctaaatctgggatggggaaaactgctgtttttgtcctttcatccctccaacaaattgaccctgttgcgggtcaggtagcagcacttgtactgtgccacacaagggaactggcttatcagatatgccacgaatttgagaggttcagcaaatatcttactgaagttaaagttgctgtcttctatggaggtgttcacatcaggaagcataaagatttgttgaagaatgaatgccctcatattgtggttggcacgcctggtaggatacttgctcttgccagggataaggatctctccttgaagaatgtgaggcacttcattcttgatgaatgtgacaaaatgctggaatcacttgacatgcggagagatgttcaggagatcttcaaaatgactcctcatgataagcaagtcatgatgttttcagcaacgctcagcaaggagatccgtcctgtatgcaagaaatttatgcaagatccgatggaaatatatgttgatgatgaggcaaagttgaccctccatggtcttgtacagcactatataaaacttagcgaggcagagaagaaccggaaactgaatgatctcttggacgctcttgatttcaaccaagttgtgatattcgtgaagagtgttagcagagctgccgaactgaataagttactttgtgaatgcaacttcccatcaatctgcattcattctggaatgactcaggaagaaaggctaacaagatataagaacttcaaggaaggccacaagagaattcttgtggctacagatttagttggcaggggcattgacattgagcgtgtcaacattgtgataaactatgacatgccagactcagctgatacttatttgcacagggttggaagggctggacgttttggcacgaagggacttgcaattacctttgtttcctctgcttcggattctgatgttcttaaccaggtgcaagaaaggtttgaggtagacataaaggaactgcctgagcaaattgacacctcgacctacatgccatcataa

SEQ ID NO: 108236 - protein, 429 aa, Zea mays
MMGEAKENDVYEEELLDYEEDDDKTVDGSAAKPTGEVAKKGYVGIHSSGFRDFLLKPELLRAIQDCGFEHPSEVQHECIPQAILGMDVICQAKSGMGKTAVFVLSSLQQIDPVAGQVAALVLCHTRELAYQICHEFERFSKYLTEVKVAVFYGGVHIRKHKDLLKNECPHIVVGTPGRILALARDKDLSLKNVRHFILDECDKMLESLDMRRDVQEIFKMTPHDKQVMMFSATLSKEIRPVCKKFMQDPMEIYVDDEAKLTLHGLVQHYIKLSEAEKNRKLNDLLDALDFNQVVIFVKSVSRAAELNKLLCECNFPSICIHSGMTQEERLTRYKNFKEGHKRILVATDLVGRGIDIERVNIVINYDMPDSADTYLHRVGRAGRFGTKGLAITFVSSASDSDVLNQVQERFEVDIKELPEQIDTSTYMPS

SEQ ID NO: 108237 - DNA, 1554 bp, Zea mays
  CDS (1)..(1554)
atggatccacgcgccaggtatccttcgggcatgggcaacggccgcggtgggacccctaactactacggccgcggcccaccgccgcaacagccgcatcagcaccaccaccagcagcagcagcagacatcgggggcgcatcaccaccagcagtacgcgcagaggcagcagcaacagcaccgccacagccacaaccaccagcagcaacagcagcagcaccagagtcagcagcagcagcagcagtggctgcggcggaatcagattgcccgcgaggccgcgggcgcagccgtgaccagcgagccgaaggccctggcgccatccacggccgccgacggcgtcaattcgagttcgcaagattggaagacccaattgaagcttccgcctcctgatacacgctacaggacagaggatgttacagccaccaagggaaatgagtttgaagactattttctcaagcgtgaactcctaatgggtatttacgaaaagggatttgaaagaccctctcctattcaagaggaaagcattcctattgctttaactggtagtgacattcttgcaagagcgaagaatggaactggcaagactgctgcattttgtattcctgcactggaaaagattgatcaagaaaaaaatgctattcaagttgttatattggttcccacaagggaattggctctacaaacatcacaagtttgtaaggagcttggtaaacatttgaagatccaagttatggtcaccactggtggaaccagcttgaaggatgatattgttcgtctgtaccaacctgtgcacttaattgttggaacacctggccgtattttggatcttacaaagaaaggtgtttgcattttgaaggactgttcaatgcttattatggatgaggcagacaagcttctctctcctgagtttcaaccttccatagaacagttgattcgctacctccctgctagtcgacagattttgatgttctcagcgacattccctgtgactgttaaggagttcaaggacaaatatcttcctaaaccttatgtgattaaccttatggatgaacttacactgaagggaattacgcagttctatgcttttgttgaagaacgacagaaagttcactgtctcaacaccctcttttccaagcttcaaatcaatcagtcaataatattctgtaactctgtaaatcgtgttgaactattggcgaagaagatcacagagcttggttattcttgcttctatattcatgcaaagatgctacaggaccaccgcaatagagttttccatgatttccgtaatggagcgtgcaggaatcttgtttgtactgatctttttacaaggggaatagatattcaagctgtgaatgttgttatcaattttgatttccccaagaactctgaaacatatctccacagggttggtagatctgggagatttggccaccttggtctggccgttaatttgatcacctatgaggatcgatttaacttgtataggattgaacaagagcttgggactgaaataaaaccaattcctcctcagatagaccaggctatatattgccaatga

SEQ ID NO: 108238 - protein, 517 aa, Zea mays
MDPRARYPSGMGNGRGGTPNYYGRGPPPQQPHQHHHQQQQQTSGAHHHQQYAQRQQQQHRHSHNHQQQQQQHQSQQQQQQWLRRNQIAREAAGAAVTSEPKALAPSTAADGVNSSSQDWKTQLKLPPPDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIVRLYQPVHLIVGTPGRILDLTKKGVCILKDCSMLIMDEADKLLSPEFQPSIEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKPIPPQIDQAIYCQ

SEQ ID NO: 108239 - DNA, 1926 bp, Zea mays
  CDS (1)..(1926)
atggcagcatccacggcggcggcggccgcgcggaagggagcgctgacggatcagaggttctcggagctttcccccgcgctatccccggaggtggtggaggcactggaccgcggcggcttccagcggtgcacgcccgtgcaggcggcggccatcccgcacctgctgtcgcacaaggacgtcgccgtcgacgccgccacaggctccgggaagacccttgccttcatcgtccccgtcgttgagatcctccgccgccgctcctccccgcccaagtcacacgaggtccttgctctgattatctctcccacgagagaattgtcctcgcaaatattcaatgtggcccagcccttcttcgcgaccctgaatggcgtgtcgtccatgctcctggtgggtgggctggatatcaaagcagagctcaagaaggtagaggaagagggcgcaaacatattggtgggcactcccgggaagctgtttgatataatgcacactgatgctctagagtacaagaatcttgagattttgatcctagatgaggctgataggctcttggatatgggattccagaaacatattaacttcatactttcaatgttgccaaagctgaggaggactgggcttttctcagctacccagacgaaagctgttgcggacctatccaaagcagggttgagaaatcctataagggttgaggttaagacagaggcaaagtccacaagcaaagatgctggacagcaagagcttggtccatccataacaccattagggcttcggttggagtatatgatatgtgaagcatcaaagaagtcatctcagcttgttgatttccttgtgcagaatagtgggaagaaaataatggtatattttgcaacatgtgcttgtgtagattattgggctgttgttcttccactaattaagtcgcttaaaggttctccaataattgcttaccatgggaagatgaaacagagccttcgagagaaagctttggcatcattttctgctctttcaagtggcgttctagtctgcactgatgttgcagcaaggggtcttgacataccaagtgttgatctgattgtgcagtatgatccacctcaagatcccaacgttttcatacatagagctggccgtacagcacgctatgatcaagaaggggatgctattgtttttctcttaccaaaggaggatacttatgttgagttcttgaagcttcgaggtgttcctctcacagaaagggaatgcctcgcaaacactgatgatgtcataccgcagattagaagtgctgcgctcgaagatcgtaatgtcatggagaaaggacttagagcgtttgtttcgtttgtccgagcatacaaggagcaccactgctcttacatttttaggtggaaagatctcgagattggaaaactagctatggagtatggtttactccagatcccatccatgccagaagtgaagcatcattctctttcactagagggatttatttctgttgatgatgttgatattacacaaatcaagtacaaggataaagctcgagaaaaacaacgcaagaaggcgctgaaaaggaaagcagaagaggaggctcaaaatccaaagccggagaggaagagacctccagagaagccggagaagccaaagcggaagaagacgggcaagcagcgtcagtcaatccaaactaaggaggacctggatgagctggcgcacgagtaccggcttctgaagaagctcaaacgtggagacatcgatgaagaggagtacgagaagctcactgggttcggagattctgatggcgaagcttccgatggggatgggagcaacttggacgaaaggaagaagggcaacaaggcgcagaaaaagcccaagcagagaggaaaatgcaaaagtgggtctaagaagttcgaagggaggagtaaattgaggagcaaaagaagatag

SEQ ID NO: 108240 - protein, 641 aa, Zea mays
MAASTAAAAARKGALTDQRFSELSPALSPEVVEALDRGGFQRCTPVQAAAIPHLLSHKDVAVDAATGSGKTLAFIVPVVEILRRRSSPPKSHEVLALIISPTRELSSQIFNVAQPFFATLNGVSSMLLVGGLDIKAELKKVEEEGANILVGTPGKLFDIMHTDALEYKNLEILILDEADRLLDMGFQKHINFILSMLPKLRRTGLFSATQTKAVADLSKAGLRNPIRVEVKTEAKSTSKDAGQQELGPSITPLGLRLEYMICEASKKSSQLVDFLVQNSGKKIMVYFATCACVDYWAVVLPLIKSLKGSPIIAYHGKMKQSLREKALASFSALSSGVLVCTDVAARGLDIPSVDLIVQYDPPQDPNVFIHRAGRTARYDQEGDAIVFLLPKEDTYVEFLKLRGVPLTERECLANTDDVIPQIRSAALEDRNVMEKGLRAFVSFVRAYKEHHCSYIFRWKDLEIGKLAMEYGLLQIPSMPEVKHHSLSLEGFISVDDVDITQIKYKDKAREKQRKKALKRKAEEEAQNPKPERKRPPEKPEKPKRKKTGKQRQSIQTKEDLDELAHEYRLLKKLKRGDIDEEEYEKLTGFGDSDGEASDGDGSNLDERKKGNKAQKKPKQRGKCKSGSKKFEGRSKLRSKRR

SEQ ID NO: 108241 - DNA, 1233 bp, Zea mays
  CDS (1)..(1233)
atggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagaggcatctatgcctatggttttgagaagccatcggctattcagcaaaggggaatagttcccttctgcaaggggcttgacgtgattcagcaagctcagtctggaactggaaaaacagctaccttctgttctggaatcttgcagcaacttgattatggattggttgaatgccaggcattggttcttgctccaacccgtgagcttgctcagcaaattgagaaggttatgcgtgctcttggggactatttgggtgtcaaagtgcatgcctgtgttggtggaacatctgttcgtgaggaccaaaggattcttgccagtggtgtgcatgttgttgtgggcacaccaggacgtgtgtttgatatgttgcgcaggcagtctctccgtcccgacaacatcaagatgtttgtgttggatgaggctgatgagatgctctcccgtggattcaaggatcagatctatgatatcttccagcttcttccatccaagattcaggtcggtgtcttctcagctaccatgccccctgaggcccttgagatcacgcgcaagttcatgaacaaacctgtgaggattctcgtcaagagagatgagctcacccttgagggtatcaagcaattctatgtcaatatcgacaaggaagattggaagctcgacactctgtgtgacctgtatgagaccctggcaatcacccagagtgtcatctttgtgaacacacgccgcaaggtggactggctcacggacaagatgaggagcagggaccacaccgtgtcagctacacacggtgatatggaccagaacaccagggacatcatcatgagggagttcaggtccgggtcctctcgtgtgctcatcaccaccgacctgctcgcccgtggtatcgacgtccagcaggtctcacttgtcatcaactacgacctgccgacccagccagagaactacctccaccgcatcggccgtagtggtcggtttggaaggaagggtgttgccatcaacttcgtcacccgcgacgacgagcgaatgctgtttgacatccagaggttctacaacgtgaccgttgaggagctgccggccaatgtcgccgaccttctctag

SEQ ID NO: 108242 - protein, 410 aa, Zea mays
MAGLAPEGSQFDDKQYDKKMQEILTEDFFTSYDDVCESFDSMGLQENLLRGIYAYGFEKPSAIQQRGIVPFCKGLDVIQQAQSGTGKTATFCSGILQQLDYGLVECQALVLAPTRELAQQIEKVMRALGDYLGVKVHACVGGTSVREDQRILASGVHVVVGTPGRVFDMLRRQSLRPDNIKMFVLDEADEMLSRGFKDQIYDIFQLLPSKIQVGVFSATMPPEALEITRKFMNKPVRILVKRDELTLEGIKQFYVNIDKEDWKLDTLCDLYETLAITQSVIFVNTRRKVDWLTDKMRSRDHTVSATHGDMDQNTRDIIMREFRSGSSRVLITTDLLARGIDVQQVSLVINYDLPTQPENYLHRIGRSGRFGRKGVAINFVTRDDERMLFDIQRFYNVTVEELPANVADLL

SEQ ID NO: 108243 - DNA, 1224 bp, Zea mays
  CDS (1)..(1224)
atggcggcgcccaccacctcccgccgcggccccggcggcgcgcgcaacatggacgacgagaacctaaccttcgagacctccccgggggtcgaggtcgtcagcagcttcgaccagatgggcatcaaggacgacctcctccgcggcatctacggctacggtttcgagaagccctccgccatccagcagcgcgccgtgctccccatcatcaacggccgcgacgtcatcgcgcaggcccagtccggtaccggcaagacgtccatgatctccctcaccgtctgccagatcgtcgacaccgccgtgcgcgaggtgcaggctttgattctctcgcctactagggagcttgcttcccaaacagagagagttatgctggctattggggaccacctcaacgtccaagtgcacgcttgcattggtggaaagagtattggtgaggacatcaggaggctcgagaatggggtgcatgtcgtctctggaactccaggcagagtctgtgatatgatcaagaggaggacactgcggaccagagccatcaagcttctagttctggatgaagctgatgagatgttgagtagaggctttaaggatcagatttacgatgtctacagatatctccctccagaacttcaggtggttttgatctctgcaactcttcctcatgagatcttggagatgactagtaagttcatgaccgaaccggttaggatccttgtgaagcgtgatgagctgaccctggagggcatcaaacaattctttgttgctgttgagaaagaggagtggaagtttgatacactttgtgatctttatgatacactcaccatcacccaagctgttattttctgcaatactaagagaaaggtggattggctcactgaaaaaatgcgtacaaataacttcaccgtatcagctatgcacggtgacatgccccaacaagaaagggatgccattatgggtgagttcaggtctggcgcaactcgtgtgctaataactacagatgtttgggctcgaggactggacgttcagcaggtttcacttgtcataaattatgatctcccaaataatcgtgagctttacatccatcgcattggtcgttctggtcgttttgggcgcaagggtgtggcgatcaatttcgtgcgcaaggatgacatccgtatactgagagatatagagcagtactacagcacacaaattgacgagatgccaatgaatgttgctgatcttatttga

SEQ ID NO: 108244 - protein, 407 aa, Zea mays; identical to SEQ ID NO: 108214

SEQ ID NO: 108245 - DNA, 1944 bp, Zea mays
  CDS (1)..(1944)
atgcgatcttcatgggctgactcagttgcgaacgccgaggaatcggcgcccgcgactgctgctgctaatggctctgttgcaactcatagcacctcgcgccctacgcgcagctcctacgtgcctccacatcttcgtggccgctcagctggtgctgctgttgaagctcaagcaggcttagtagcaccagcacaaggtggaccactgccattggctgctgcacaaccttctggtcagggtgctgctgttggtggccctcgctgggctggcattgtgaatggtggtggtggtggtggcagcattggtgctcctcgccagggccatggtggcggaggcgggggccgtggtgcttggaactcccgtcctggtggttgggaccgcagagaccgggagccagatccgtttgcgaaagccgaggctgaagaaattgatttcgacggccaggagaatactggcatcaattttgatgcctatgaagacatccctgttgagaccagtggccatgatgtgcctgcaccagtcaacacatttgcagagattgatttgggtgatgcattgaatgacaatatccggaggtgcaagtatgtgaaaccaacaccagtgcagcgttacgccatcccaatctccattgctgggcgggatctcatggcctgcgcacagactggatccggaaaaaccgccgcattctgttttccaatcatcagtgggatcttgaagtcaccaaagccacaccagaggtcacggagtacaaggaccgcttgccctctagctctgatcttatcacccactcgtgagctttcagtccaaatccatgaagaagcaaggaagtttgcataccagactggtgtcagagttgtggttgcatatggtggcgcaccaataactaaccagctgagggagttagagagaggtgtggaaatcctggtggcaactcctggtcgcttgatggatctgttggagagggctagagtctcacttcaaatgataaagtatttagctcttgatgaagctgatcggatgcttgatatgggttttgagccacagatacgtaaaattgttgagggcatggacatgcctcaacgtggtgagaggcagacaatgttgttcagtgcaacattcccaaaagagatacagaggatggccgcagatttccttgctgattacatctttcttgctgttgggagagttggttcaagcaccgatttgattgttcagagggtggagtttgtcctcgcttcagacaaacgaagctacctcatggatcttctgcatgcacaaaaggctaatggcacacatggaaagcacgctcttacattggtctttgtggagacaaagaggggggctgatgccttggaagacgggttttttagaaatggacatccatggactagcattcatggagacaggacacaacaggaaagggagcatgcccttaggtccttcaagagcggagcaactcccatccttgtggcgactgatgttgctgctcgtggtcttgacataccacatgttgcccatgtgattaattttgacctccctaatgatatagatgactatgttcatcggattggaaggactggacgtgctgggaaatctggtcttgcgactgcattcttcaacgagagcaacactacgcttgcaaggccgttgagtgatctcatgaaagaggccaaccaggaggttcctaagtggcttgagggatacgctgcccgatcagcctacggaggtggaggtggtagaaaccgcagacaaggtagcagtgccagatttggtggccgtgatttccggcgagataggggcagtggtggaggatatggtggtggttcctacggaggaggtggtggtggtggatatgggggatcatcaggatacggtggtgcctatggcggcggtggcagcagcggcggcggctatggtggtggtcagagtacgagttcttgggactga

SEQ ID NO: 108246 - protein, 647 aa, Zea mays
MRSSWADSVANAEESAPATAAANGSVATHSTSRPTRSSYVPPHLRGRSAGAAVEAQAGLVAPAQGGPLPLAAAQPSGQGAAVGGPRWAGIVNGGGGGGSIGAPRQGHGGGGGGRGAWNSRPGGWDRRDREPDPFAKAEAEEIDFDGQENTGINFDAYEDIPVETSGHDVPAPVNTFAEIDLGDALNDNIRRCKYVKPTPVQRYAIPISIAGRDLMACAQTGSGKTAAFCFPIISGILKSPKPHQRSRSTRTACPLALILSPTRELSVQIHEEARKFAYQTGVRVVVAYGGAPITNQLRELERGVEILVATPGRLMDLLERARVSLQMIKYLALDEADRMLDMGFEPQIRKIVEGMDMPQRGERQTMLFSATFPKEIQRMAADFLADYIFLAVGRVGSSTDLIVQRVEFVLASDKRSYLMDLLHAQKANGTHGKHALTLVFVETKRGADALEDGFFRNGHPWTSIHGDRTQQEREHALRSFKSGATPILVATDVAARGLDIPHVAHVINFDLPNDIDDYVHRIGRTGRAGKSGLATAFFNESNTTLARPLSDLMKEANQEVPKWLEGYAARSAYGGGGGRNRRQGSSARFGGRDFRRDRGSGGGYGGGSYGGGGGGGYGGSSGYGGAYGGGGSSGGGYGGGQSTSSWD

SEQ ID NO: 108247 - DNA, 1584 bp, Zea mays
  CDS (1)..(1584)
atggatccacgcgccaggtatccttcgggcatgggcaacggccgcggtgggaacctcaactactacggccgcggcccaccgccgcaacagccgcatcagcaccacaaccaccagcagacgtcgggggcgcaccaccaccagcagacgtcgggggcgcaccaccaccagcagtacgcgcagaggcagcaccagcaccagcaccagcaccacggccacaatcgccatcagcaacagcagcagcaccacatttaccagcagcaacagcagcagtggctgcggcggagccagattgcccgcgagacctcgggcgcagccgtgaccagcgagccgaagtccctggcgccatccacggccgccgatggcgtcgattcgagttcacaagattggaaggcccaattgaagctgccgcctccagatacacgctacaggacagaggatgttacagctaccaagggaaatgagtttgaagactattttctcaagcgtgaactcctaatgggtatatacgagaagggatttgaaagaccgtctcctatccaagaggaaagcattcctattgctttaactggtagtgacattcttgcaagagcgaagaacggaactggcaagactgctgcattttgtattcctgcactggaaaagattgatcaagaaaaaaatgctattcaagttgttatattggttcccacaagggaattggctctgcaaacatcacaagtttgcaaggagcttggtaagcatttgaagatccaggttatggtcaccactggtggaaccagtttgaaggatgatattgttcgtctgtaccaacctgtgcacttactcgttggaacacctgggcgtattttggatcttacaaagaaaggtgtttgcattttgaacgactgttcaatgcttattatggatgaggcagacaagcttctctctcctgagtttcaaccttccatagaacagttgattcgctacctccctgctagtcgacagattttgatgttttcagcgacattccctgtgactgttaaggagtttaaggacaaatatctgcctaaaccttatgtgattaaccttatggacgaacttacactgaagggaattacacagttctatgcttttgtggaagaaagacagaaagttcactgtctcaacactctcttttccaagcttcaaatcaaccagtcaataatattttgtaactctgtaaatcgtgttgaactattggcgaaaaagatcacagagcttggctattcttgcttctatattcatgcaaagatgctacaggaccaccgtaatagagttttccatgatttccgtaatggagcatgcaggaaccttgtttgcactgatctttttacaaggggaatagatattcaagctgtgaatgttgttatcaattttgatttccccaagaactctgaaacatatctccacagggttggtagatctgggagatttggtcaccttggtctggccgttaatttgatcacctatgaggatcggtttaacttgtataggattgaacaagagcttgggactgaaataaaatcaattcctcctcagatagaccaggctatatactgccaataa

SEQ ID NO: 108248 - protein, 527 aa, Zea mays
MDPRARYPSGMGNGRGGNLNYYGRGPPPQQPHQHHNHQQTSGAHHHQQTSGAHHHQQYAQRQHQHQHQHHGHNRHQQQQQHHIYQQQQQQWLRRSQIARETSGAAVTSEPKSLAPSTAADGVDSSSQDWKAQLKLPPPDTRYRTEDVTATKGNEFEDYFLKRELLMGIYEKGFERPSPIQEESIPIALTGSDILARAKNGTGKTAAFCIPALEKIDQEKNAIQVVILVPTRELALQTSQVCKELGKHLKIQVMVTTGGTSLKDDIVRLYQPVHLLVGTPGRILDLTKKGVCILNDCSMLIMDEADKLLSPEFQPSIEQLIRYLPASRQILMFSATFPVTVKEFKDKYLPKPYVINLMDELTLKGITQFYAFVEERQKVHCLNTLFSKLQINQSIIFCNSVNRVELLAKKITELGYSCFYIHAKMLQDHRNRVFHDFRNGACRNLVCTDLFTRGIDIQAVNVVINFDFPKNSETYLHRVGRSGRFGHLGLAVNLITYEDRFNLYRIEQELGTEIKSIPPQIDQAIYCQ

SEQ ID NO: 108249 - DNA, 21 bp, Artificial sequence
  primer
atgggagaaacaagggacaac

SEQ ID NO: 108250 - DNA, 23 bp, Artificial sequence
  primer
ttaggagggcatgtatgtagatg

SEQ ID NO: 108251 - protein, 414 aa, Artificial sequence; identical to SEQ ID NO: 39057
  consensus sequence
  Variant (2)..(7): Xaa in position 2 to 7 is any amino acid
  Variant (10)..(13): Xaa in position 10 to 13 is any amino acid
  Variant (15)..(18): Xaa in position 15 to 18 is any amino acid
  Variant (20)..(20): Xaa in position 20 is any amino acid
  Variant (21)..(21): Xaa in position 21 is any or no amino acid
  Variant (23)..(26): Xaa in position 23 to 26 is any amino acid
  Variant (28)..(28): Xaa in position 28 is any amino acid
  Variant (31)..(31): Xaa in position 31 is any amino acid
  Variant (36)..(36): Xaa in position 36 is any amino acid
  Variant (38)..(39): Xaa in position 38 to 39 is any amino acid
  Variant (41)..(53): Xaa in position 41 to 53 is any amino acid
  Variant (54)..(77): Xaa in position 54 to 77 is any or no amino acid
  Variant (79)..(81): Xaa in position 79 to 81 is any amino acid
  Variant (88)..(88): Xaa in position 88 is any amino acid
  Variant (90)..(107): Xaa in position 90 to 107 is any amino acid
  Variant (108)..(116): Xaa in position 108 to 116 is any or no amino acid
  Variant (119)..(123): Xaa in position 119 to 123 is any amino acid
  Variant (125)..(127): Xaa in position 125 to 127 is any amino acid
  Variant (129)..(136): Xaa in position 129 to 136 is any amino acid
  Variant (137)..(141): Xaa in position 137 to 141 is any or no amino acid
  Variant (146)..(147): Xaa in position 146 to 147 is any amino acid
  Variant (149)..(163): Xaa in position 149 to 163 is any amino acid
  Variant (164)..(168): Xaa in position 164 to 168 is any or no amino acid
  Variant (175)..(175): Xaa in position 175 is any amino acid
  Variant (178)..(179): Xaa in position 178 to 179 is any amino acid
  Variant (180)..(182): Xaa in position 180 to 182 is any or no amino acid
  Variant (185)..(195): Xaa in position 185 to 195 is any amino acid
  Variant (197)..(199): Xaa in position 197 to 199 is any amino acid
  Variant (200)..(224): Xaa in position 200 to 224 is any or no amino acid
  Variant (226)..(228): Xaa in position 226 to 228 is any amino acid
  Variant (233)..(247): Xaa in position 233 to 247 is any amino acid
  Variant (249)..(261): Xaa in position 249 to 261 is any amino acid
  Variant (262)..(274): Xaa in position 262 to 274 is any or no amino acid
  Variant (276)..(301): Xaa in position 276 to 301 is any amino acid
  Variant (302)..(316): Xaa in position 302 to 316 is any or no amino acid
  Variant (318)..(319): Xaa in position 318 to 319 is any amino acid
  Variant (321)..(330): Xaa in position 321 to 330 is any amino acid
  Variant (332)..(338): Xaa in position 332 to 338 is any amino acid
  Variant (339)..(342): Xaa in position 339 to 342 is any or no amino acid
  Variant (345)..(347): Xaa in position 345 to 347 is any amino acid
  Variant (349)..(350): Xaa in position 349 to 350 is any amino acid
  Variant (352)..(357): Xaa in position 352 to 357 is any amino acid
  Variant (359)..(364): Xaa in position 359 to 364 is any amino acid
  Variant (365)..(366): Xaa in position 365 to 366 is any or no amino acid
  Variant (368)..(368): Xaa in position 368 is any amino acid
  Variant (372)..(372): Xaa in position 372 is any amino acid
  Variant (377)..(377): Xaa in position 377 is any amino acid
  Variant (379)..(384): Xaa in position 379 to 384 is any amino acid
  Variant (386)..(386): Xaa in position 386 is any amino acid
  Variant (388)..(390): Xaa in position 388 to 390 is any amino acid
  Variant (392)..(394): Xaa in position 392 to 394 is any amino acid
  Variant (396)..(396): Xaa in position 396 is any amino acid
  Variant (398)..(398): Xaa in position 398 is any amino acid
  Variant (409)..(411): Xaa in position 409 to 411 is any amino acid
  Variant (413)..(413): Xaa in position 413 is any amino acid

SEQ ID NO: 108252 - protein, 94 aa, Artificial sequence; identical to SEQ ID NO: 39058
  protein pattern
  Variant (1)..(1): Xaa in position 1 is Leu, Val, Ile, Cys, Ala or Met
  Variant (2)..(5): Xaa in position 2 to 5 is any amino acid
  Variant (6)..(6): Xaa in position 6 is Tyr, Phe, Trp, Ile or Leu
  Variant (7)..(8): Xaa in position 7 to 8 is any amino acid
  Variant (9)..(9): Xaa in position 9 is Pro, Met, Ala, Leu, Cys or Thr
  Variant (10)..(10): Xaa in position 10 is Thr, Ser, Phe or Met
  Variant (11)..(11): Xaa in position 11 is any amino acid
  Variant (12)..(12): Xaa in position 12 is Ile or Val
  Variant (14)..(16): Xaa in position 14 to 16 is any amino acid
  Variant (17)..(17): Xaa in position 17 is Ile, Leu, Trp or Val
  Variant (18)..(20): Xaa in position 18 to 20 is any amino acid
  Variant (21)..(21): Xaa in position 21 is Leu, Ile, Met, Val, Cys or Phe
  Variant (22)..(24): Xaa in position 22 to 24 is any amino acid
  Variant (25)..(25): Xaa in position 25 is any or no amino acid
  Variant (26)..(26): Xaa in position 26 is Asp or Asn
  Variant (27)..(27): Xaa in position 27 is Val, Leu, Ile, Met, Ala, Cys, Thr or Phe
  Variant (28)..(28): Xaa in position 28 is Ile, Val, Leu, Met, Ala or Arg
  Variant (29)..(29): Xaa in position 29 is Gly, Ala, Val or Gln
  Variant (30)..(30): Xaa in position 30 is any amino acid
  Variant (31)..(31): Xaa in position 31 is Ala, Ser or Gly
  Variant (32)..(32): Xaa in position 32 is any amino acid
  Variant (33)..(33): Xaa in position 33 is Thr, Ser or Asn
  Variant (35)..(35): Xaa in position 35 is Thr or Ser
  Variant (39)..(39): Xaa in position 39 is any amino acid
  Variant (40)..(40): Xaa in position 40 is Ala, Ser, Gly or Thr
  Variant (41)..(41): Xaa in position 41 is Phe or Tyr
  Variant (42)..(42): Xaa in position 42 is any amino acid
  Variant (43)..(43): Xaa in position 43 is Leu, Ile, Ser, Val, Ala, Thr or Cys
  Variant (44)..(44): Xaa in position 44 is Pro, Gly, Ser, Ala or Thr
  Variant (45)..(45): Xaa in position 45 is any amino acid
  Variant (46)..(46): Xaa in position 46 is Leu, Ile, Phe, Cys, Val, Ala or Met
  Variant (47)..(56): Xaa in position 47 to 56 is any amino acid
  Variant (57)..(81): Xaa in position 57 to 81 is any or no amino acid
  Variant (82)..(82): Xaa in position 82 is Leu, Ile, Val, Met or Cys
  Variant (83)..(83): Xaa in position 83 is Val or Ile
  Variant (84)..(84): Xaa in position 84 is Leu, Ile, Val or Met
  Variant (85)..(85): Xaa in position 85 is Ala, Thr, Cys, Ser, Val, Leu or Glu
  Variant (91)..(91): Xaa in position 91 is Ala, Val, Cys, Ser or Thr
  Variant (92)..(92): Xaa in position 92 is any amino acid
  Variant (94)..(94): Xaa in position 94 is Val, Ile, Thr or Ser

SEQ ID NO: 108253 - protein, 116 aa, Artificial sequence; identical to SEQ ID NO: 39059
  protein pattern
  Variant (2)..(2): Xaa in position 2 is Gly or Lys
  Variant (3)..(7): Xaa in position 3 to 7 is any amino acid
  Variant (8)..(8): Xaa in position 8 is Gln, Asp, Trp or Glu
  Variant (9)..(11): Xaa in position 9 to 11 is any amino acid
  Variant (12)..(12): Xaa in position 12 is Leu, Ile, Val, Phe, Met or Arg
  Variant (13)..(15): Xaa in position 13 to 15 is any amino acid
  Variant (16)..(20): Xaa in position 16 to 20 is any or no amino acid
  Variant (21)..(21): Xaa in position 21 is His, Asp, Gln, Glu, Ala, Asn or Lys
  Variant (22)..(22): Xaa in position 22 is Ile, Val, Leu, Ala or Phe
  Variant (23)..(23): Xaa in position 23 is Val, Leu, Ile, Met or Ala
  Variant (24)..(24): Xaa in position 24 is Val, Ile or Ser
  Variant (25)..(25): Xaa in position 25 is Gly or Ala
  Variant (27)..(27): Xaa in position 27 is Pro or Thr
  Variant (30)..(30): Xaa in position 30 is Leu, Val, Ile, Ala, Phe, Met or Thr
  Variant (31)..(31): Xaa in position 31 is any amino acid
  Variant (32)..(32): Xaa in position 32 is Asp or Glu
  Variant (33)..(33): Xaa in position 33 is His, Leu, Met, Phe, Ile, Tyr or Cys
  Variant (34)..(42): Xaa in position 34 to 42 is any amino acid
  Variant (43)..(48): Xaa in position 43 to 48 is any or no amino acid
  Variant (49)..(49): Xaa in position 49 is Val, Ile, Leu, Cys, Thr, Pro or Met
  Variant (50)..(52): Xaa in position 50 to 52 is any amino acid
  Variant (53)..(53): Xaa in position 53 is Val, Ile, Ala or Thr
  Variant (54)..(54): Xaa in position 54 is Leu, Ile, Met, Phe or Val
  Variant (57)..(57): Xaa in position 57 is Ala, Ser or Gly
  Variant (59)..(59): Xaa in position 59 is Arg, Glu, Gln, Lys or His
  Variant (60)..(60): Xaa in position 60 is Met or Leu
  Variant (61)..(61): Xaa in position 61 is Leu, Phe, Met or Val
  Variant (62)..(63): Xaa in position 62 to 63 is any amino acid
  Variant (64)..(66): Xaa in position 64 to 66 is any or no amino acid
  Variant (67)..(67): Xaa in position 67 is Gly, Asp or Glu
  Variant (69)..(71): Xaa in position 69 to 71 is any amino acid
  Variant (72)..(72): Xaa in position 72 is Ile, Val, Leu or Met
  Variant (73)..(74): Xaa in position 73 to 74 is any amino acid
  Variant (75)..(75): Xaa in position 75 is Ile, Val, Leu or Met
  Variant (76)..(86): Xaa in position 76 to 86 is any amino acid
  Variant (87)..(111): Xaa in position 87 to 111 is any or no amino acid
  Variant (112)..(112): Xaa in position 112 is Leu, Met, Phe, Val, Cys or Tyr
  Variant (113)..(113): Xaa in position 113 is Phe, Leu, Trp, Val, Tyr or Cys
  Variant (114)..(114): Xaa in position 114 is Ser, Thr or Phe

SEQ ID NO: 108254 - protein, 99 aa, Artificial sequence; identical to SEQ ID NO: 39060
  protein pattern
  Variant (1)..(1): Xaa in position 1 is Ile, Leu, Val or Met
  Variant (2)..(2): Xaa in position 2 is Ile, Val, Ala, Leu or Met
  Variant (3)..(3): Xaa in position 3 is Phe or Val
  Variant (4)..(5): Xaa in position 4 to 5 is any amino acid
  Variant (6)..(6): Xaa in position 6 is Thr, Arg, Ser, Ala, Met or Tyr
  Variant (7)..(7): Xaa in position 7 is Lys, Arg, Gln, Val or Cys
  Variant (8)..(9): Xaa in position 8 to 9 is any amino acid
  Variant (10)..(10): Xaa in position 10 is Val, Ala, Thr, Cys, Ser or Ile
  Variant (11)..(12): Xaa in position 11 to 12 is any amino acid
  Variant (13)..(13): Xaa in position 13 is Leu, Val, Ile, Met or Arg
  Variant (14)..(16): Xaa in position 14 to 16 is any amino acid
  Variant (17)..(17): Xaa in position 17 is Leu, Met, Ile, Cys or Phe
  Variant (18)..(20): Xaa in position 18 to 20 is any amino acid
  Variant (21)..(24): Xaa in position 21 to 24 is any or no amino acid
  Variant (25)..(25): Xaa in position 25 is Ala, Val, Ser, Cys or Thr
  Variant (26)..(27): Xaa in position 26 to 27 is any amino acid
  Variant (28)..(28): Xaa in position 28 is Leu, Ile, Met, Tyr, Phe, Thr or Val
  Variant (29)..(29): Xaa in position 29 is His, Asn, Ser or Thr
  Variant (30)..(30): Xaa in position 30 is Gly, Ser or Ala
  Variant (31)..(33): Xaa in position 31 to 33 is any amino acid
  Variant (35)..(36): Xaa in position 35 to 36 is any amino acid
  Variant (38)..(40): Xaa in position 38 to 40 is any amino acid
  Variant (41)..(41): Xaa in position 41 is Leu, Met, Ile, Val or Phe
  Variant (42)..(43): Xaa in position 42 to 43 is any amino acid
  Variant (44)..(44): Xaa in position 44 is Phe, Leu, Ile or Met
  Variant (45)..(50): Xaa in position 45 to 50 is any amino acid
  Variant (51)..(52): Xaa in position 51 to 52 is any or no amino acid
  Variant (53)..(53): Xaa in position 53 is Leu, Val, Met, Cys or Ile
  Variant (54)..(54): Xaa in position 54 is Val, Ile or Thr
  Variant (55)..(55): Xaa in position 55 is Ala, Cys, Thr, Ser or Gly
  Variant (56)..(56): Xaa in position 56 is Thr or Ser
  Variant (57)..(57): Xaa in position 57 is Asp, Ser, Ala or Asn
  Variant (58)..(58): Xaa in position 58 is Val, Ile or Leu
  Variant (59)..(59): Xaa in position 59 is Ala, Trp, Leu, Val or Phe
  Variant (60)..(60): Xaa in position 60 is Ala, Ser, Gly or Thr
  Variant (63)..(63): Xaa in position 63 is Leu or Ile
  Variant (64)..(64): Xaa in position 64 is Asp or His
  Variant (65)..(65): Xaa in position 65 is Ile, Val or Leu
  Variant (66)..(67): Xaa in position 66 to 67 is any amino acid
  Variant (68)..(68): Xaa in position 68 is Val, Ile, Leu or Thr
  Variant (69)..(70): Xaa in position 69 to 70 is any amino acid
  Variant (71)..(71): Xaa in position 71 is Val or Ile
  Variant (72)..(72): Xaa in position 72 is Ile, Val, Phe, Tyr or Leu
  Variant (73)..(73): Xaa in position 73 is Asn, His or Ser
  Variant (74)..(74): Xaa in position 74 is Tyr, Phe, Val, His, Leu, Ala or Ile
  Variant (75)..(75): Xaa in position 75 is any amino acid
  Variant (76)..(76): Xaa in position 76 is Leu, Ile, Val, Met, Phe, Ala or Thr
  Variant (77)..(77): Xaa in position 77 is Pro, Ala, Thr or Ser
  Variant (78)..(82): Xaa in position 78 to 82 is any amino acid
  Variant (83)..(83): Xaa in position 83 is Tyr, His or Phe
  Variant (84)..(84): Xaa in position 84 is Val, Ile, Thr, Leu, Gln or Met
  Variant (87)..(87): Xaa in position 87 is Ile, Val, Ser, Thr or Ala
  Variant (90)..(90): Xaa in position 90 is Thr, Ser or Gly
  Variant (91)..(91): Xaa in position 91 is Gly or Ala
  Variant (93)..(93): Xaa in position 93 is any amino acid
  Variant (94)..(94): Xaa in position 94 is Gly, Asp, Asn, Ala or Glu
  Variant (95)..(96): Xaa in position 95 to 96 is any amino acid
  Variant (98)..(98): Xaa in position 98 is any amino acid
  Variant (99)..(99): Xaa in position 99 is Ala, Ser, Val or Thr

SEQ ID NO: 108255 - DNA, 858 bp, Brassica napus; identical to SEQ ID NO: 108188
  CDS (1)..(858)

SEQ ID NO: 108256 - protein, 285 aa, Brassica napus; identical to SEQ ID NO: 108189

SEQ ID NO: 108257 - DNA, 22 bp, Artificial sequence
  primer
atgagcagcaatcatcagactg

SEQ ID NO: 108258 - DNA, 24 bp, Artificial sequence
  primer
tcaaagtgaagaaaaaatcgttag

SEQ ID NO: 108259 - protein, 279 aa, Artificial sequence; identical to SEQ ID NO: 94467
  consensus sequence
  Variant (4)..(5): Xaa in position 4 to 5 is any amino acid
  Variant (7)..(7): Xaa in position 7 is any amino acid
  Variant (9)..(11): Xaa in position 9 to 11 is any amino acid
  Variant (13)..(26): Xaa in position 13 to 26 is any amino acid
  Variant (27)..(30): Xaa in position 27 to 30 is any or no amino acid
  Variant (32)..(35): Xaa in position 32 to 35 is any amino acid
  Variant (37)..(49): Xaa in position 37 to 49 is any amino acid
  Variant (50)..(63): Xaa in position 50 to 63 is any or no amino acid
  Variant (65)..(81): Xaa in position 65 to 81 is any amino acid
  Variant (82)..(86): Xaa in position 82 to 86 is any or no amino acid
  Variant (88)..(88): Xaa in position 88 is any amino acid
  Variant (90)..(90): Xaa in position 90 is any amino acid
  Variant (95)..(102): Xaa in position 95 to 102 is any amino acid
  Variant (103)..(117): Xaa in position 103 to 117 is any or no amino acid
  Variant (119)..(120): Xaa in position 119 to 120 is any amino acid
  Variant (122)..(143): Xaa in position 122 to 143 is any amino acid
  Variant (144)..(150): Xaa in position 144 to 150 is any or no amino acid
  Variant (152)..(153): Xaa in position 152 to 153 is any amino acid
  Variant (155)..(163): Xaa in position 155 to 163 is any amino acid
  Variant (164)..(170): Xaa in position 164 to 170 is any or no amino acid
  Variant (172)..(174): Xaa in position 172 to 174 is any amino acid
  Variant (176)..(184): Xaa in position 176 to 184 is any amino acid
  Variant (186)..(198): Xaa in position 186 to 198 is any amino acid
  Variant (199)..(202): Xaa in position 199 to 202 is any or no amino acid
  Variant (205)..(224): Xaa in position 205 to 224 is any amino acid
  Variant (225)..(278): Xaa in position 225 to 278 is any or no amino acid

SEQ ID NO: 108260 - protein, 122 aa, Artificial sequence; identical to SEQ ID NO: 94468
  protein pattern
  Variant (1)..(1): Xaa in position 1 is Ile, Val or Leu
  Variant (2)..(2): Xaa in position 2 is Thr, Met, Ser or Ala
  Variant (4)..(4): Xaa in position 4 is Ala, Gly or Ser
  Variant (5)..(5): Xaa in position 5 is Ser, Thr, Gly or Ala
  Variant (6)..(6): Xaa in position 6 is any amino acid
  Variant (7)..(7): Xaa in position 7 is Gly or Asn
  Variant (8)..(8): Xaa in position 8 is any amino acid
  Variant (10)..(21): Xaa in position 10 to 21 is any amino acid
  Variant (22)..(26): Xaa in position 22 to 26 is any or no amino acid
  Variant (27)..(27): Xaa in position 27 is Val, Leu, Ile, Phe or Met
  Variant (28)..(30): Xaa in position 28 to 30 is any amino acid
  Variant (31)..(31): Xaa in position 31 is Ala, Gly, Asp or Ser
  Variant (32)..(32): Xaa in position 32 is Arg, Thr or Gln
  Variant (33)..(36): Xaa in position 33 to 36 is any amino acid
  Variant (37)..(37): Xaa in position 37 is Leu, Ile, Val, Ala or Met
  Variant (38)..(39): Xaa in position 38 to 39 is any amino acid
  Variant (40)..(40): Xaa in position 40 is Leu, Ile, Val, Ala, Thr or Phe
  Variant (41)..(49): Xaa in position 41 to 49 is any amino acid
  Variant (50)..(64): Xaa in position 50 to 64 is any or no amino acid
  Variant (65)..(65): Xaa in position 65 is Asp, Asn, Glu or Ser
  Variant (66)..(66): Xaa in position 66 is Val, Leu, Ile or Met
  Variant (67)..(80): Xaa in position 67 to 80 is any amino acid
  Variant (81)..(86): Xaa in position 81 to 86 is any or no amino acid
  Variant (87)..(87): Xaa in position 87 is Ile, Val, Leu, Ala or Phe
  Variant (88)..(89): Xaa in position 88 to 89 is any amino acid
  Variant (90)..(90): Xaa in position 90 is Leu, Ile, Val, Cys, Met or Phe
  Variant (91)..(91): Xaa in position 91 is any amino acid
  Variant (92)..(92): Xaa in position 92 is Asn, Leu, Ala, Ser or Gly
  Variant (93)..(93): Xaa in position 93 is Asn, Cys, Ser or Val
  Variant (94)..(94): Xaa in position 94 is Ala or Gly
  Variant (96)..(103): Xaa in position 96 to 103 is any amino acid
  Variant (104)..(118): Xaa in position 104 to 118 is any or no amino acid
  Variant (119)..(119): Xaa in position 119 is Asn or Gly
  Variant (120)..(120): Xaa in position 120 is Val, Ile, Leu, Cys, Asn, Ser, Ala or Phe
  Variant (121)..(121): Xaa in position 121 is any amino acid
  Variant (122)..(122): Xaa in position 122 is Gly, Ala or Ser

SEQ ID NO: 108261 - protein, 59 aa, Artificial sequence; identical to SEQ ID NO: 94469
  protein pattern
  Variant (1)..(1): Xaa in position 1 is Ile, Val, Phe or Leu
  Variant (2)..(2): Xaa in position 2 is Ile, Val, Leu, Phe or Met
  Variant (3)..(5): Xaa in position 3 to 5 is any amino acid
  Variant (7)..(8): Xaa in position 7 to 8 is any amino acid
  Variant (9)..(9): Xaa in position 9 is Gly, Ala or Ser
  Variant (10)..(17): Xaa in position 10 to 17 is any amino acid
  Variant (18)..(25): Xaa in position 18 to 25 is any or no amino acid
  Variant (26)..(26): Xaa in position 26 is Tyr or Phe
  Variant (27)..(27): Xaa in position 27 is any amino acid
  Variant (28)..(28): Xaa in position 28 is Ala, Gly or Ser
  Variant (29)..(29): Xaa in position 29 is Thr, Ser, Ala or Val
  Variant (31)..(32): Xaa in position 31 to 32 is any amino acid
  Variant (33)..(33): Xaa in position 33 is Val, Ile, Leu, Thr, Glu, Gln or Met
  Variant (34)..(35): Xaa in position 34 to 35 is any amino acid
  Variant (36)..(36): Xaa in position 36 is Phe, Leu, Ile, Met or Val
  Variant (37)..(39): Xaa in position 37 to 39 is any amino acid
  Variant (40)..(40): Xaa in position 40 is Leu, Met, Val, Ile, Trp or Phe
  Variant (41)..(42): Xaa in position 41 to 42 is any amino acid
  Variant (43)..(43): Xaa in position 43 is Glu, Asp or Gln
  Variant (44)..(46): Xaa in position 44 to 46 is any amino acid
  Variant (47)..(50): Xaa in position 47 to 50 is any or no amino acid
  Variant (51)..(51): Xaa in position 51 is Ile, Val, Leu or Phe
  Variant (52)..(55): Xaa in position 52 to 55 is any amino acid
  Variant (56)..(56): Xaa in position 56 is Ile, Val or Leu
  Variant (57)..(57): Xaa in position 57 is any amino acid
  Variant (59)..(59): Xaa in position 59 is Gly, Ala or Ser

SEQ ID NO: 108262 - DNA, 849 bp, Brassica napus; identical to SEQ ID NO: 108186
  CDS (1)..(849)

SEQ ID NO: 108263 - protein, 282 aa, Brassica napus; identical to SEQ ID NO: 108187

SEQ ID NO: 108264 - DNA, 1143 bp, Glycine max; identical to SEQ ID NO: 108184
  CDS (79)..(927)

SEQ ID NO: 108265 - protein, 282 aa, Glycine max; identical to SEQ ID NO: 108185

SEQ ID NO: 108266 - DNA, 1176 bp, Glycine max; identical to SEQ ID NO: 108182
  CDS (74)..(883)

SEQ ID NO: 108267 - protein, 269 aa, Glycine max; identical to SEQ ID NO: 108183

SEQ ID NO: 108268 - DNA, 858 bp, Brassica napus; identical to SEQ ID NO: 108188
  CDS (1)..(858)

SEQ ID NO: 108269 - protein, 285 aa, Brassica napus; identical to SEQ ID NO: 108189

SEQ ID NO: 108270 - DNA, 843 bp, Zea mays; identical to SEQ ID NO: 108190
  CDS (1)..(843)

SEQ ID NO: 108271 - protein, 280 aa, Zea mays; identical to SEQ ID NO: 108191

SEQ ID NO: 108272 - DNA, 22 bp, Artificial sequence
  primer
atgagcaatcatcaaaccacgg

SEQ ID NO: 108273 - DNA, 24 bp, Artificial sequence
  primer
tcaaagagaagaaaaaataggcag

SEQ ID NO: 108274 - protein, 285 aa, Artificial sequence; identical to SEQ ID NO: 62167
  consensus sequence
  Variant (2)..(3): Xaa in position 2 to 3 is any amino acid
  Variant (6)..(8): Xaa in position 6 to 8 is any amino acid
  Variant (9)..(13): Xaa in position 9 to 13 is any or no amino acid
  Variant (17)..(19): Xaa in position 17 to 19 is any amino acid
  Variant (21)..(26): Xaa in position 21 to 26 is any amino acid
  Variant (29)..(65): Xaa in position 29 to 65 is any amino acid
  Variant (66)..(90): Xaa in position 66 to 90 is any or no amino acid
  Variant (92)..(92): Xaa in position 92 is any amino acid
  Variant (93)..(95): Xaa in position 93 to 95 is any or no amino acid
  Variant (97)..(97): Xaa in position 97 is any amino acid
  Variant (99)..(99): Xaa in position 99 is any amino acid
  Variant (104)..(124): Xaa in position 104 to 124 is any amino acid
  Variant (125)..(131): Xaa in position 125 to 131 is any or no amino acid
  Variant (134)..(146): Xaa in position 134 to 146 is any amino acid
  Variant (148)..(151): Xaa in position 148 to 151 is any amino acid
  Variant (152)..(157): Xaa in position 152 to 157 is any or no amino acid
  Variant (159)..(159): Xaa in position 159 is any amino acid
  Variant (161)..(161): Xaa in position 161 is any amino acid
  Variant (163)..(164): Xaa in position 163 to 164 is any amino acid
  Variant (166)..(176): Xaa in position 166 to 176 is any amino acid
  Variant (177)..(179): Xaa in position 177 to 179 is any or no amino acid
  Variant (181)..(183): Xaa in position 181 to 183 is any amino acid
  Variant (185)..(194): Xaa in position 185 to 194 is any amino acid
  Variant (196)..(196): Xaa in position 196 is any amino acid
  Variant (198)..(205): Xaa in position 198 to 205 is any amino acid
  Variant (207)..(209): Xaa in position 207 to 209 is any amino acid
  Variant (212)..(213): Xaa in position 212 to 213 is any amino acid
  Variant (214)..(214): Xaa in position 214 is any or no amino acid
  Variant (216)..(229): Xaa in position 216 to 229 is any amino acid
  Variant (230)..(248): Xaa in position 230 to 248 is any or no amino acid
  Variant (250)..(251): Xaa in position 250 to 251 is any amino acid
  Variant (253)..(253): Xaa in position 253 is any amino acid
  Variant (255)..(259): Xaa in position 255 to 259 is any amino acid
  Variant (261)..(265): Xaa in position 261 to 265 is any amino acid
  Variant (269)..(272): Xaa in position 269 to 272 is any amino acid
  Variant (273)..(275): Xaa in position 273 to 275 is any or no amino acid
  Variant (278)..(283): Xaa in position 278 to 283 is any amino acid

SEQ ID NO: 108275 - protein, 26 aa, Artificial sequence
  protein pattern
  Variant (1)..(1): Xaa in position 1 is Leu, Ile, Val, Phe or Met
  Variant (2)..(2): Xaa in position 2 is Val, Ile or Leu
  Variant (3)..(3): Xaa in position 3 is Thr or Ser
  Variant (4)..(4): Xaa in position 4 is Gly or Ala
  Variant (5)..(5): Xaa in position 5 is Ala, Gly or Ser
  Variant (6)..(6): Xaa in position 6 is Ser, Ala, Gly, Thr or Leu
  Variant (7)..(7): Xaa in position 7 is any amino acid
  Variant (8)..(9): Xaa in position 8 to 9 is any or no amino acid
  Variant (11)..(11): Xaa in position 11 is Ile, Leu or Met
  Variant (13)..(15): Xaa in position 13 to 15 is any amino acid
  Variant (16)..(16): Xaa in position 16 is Ala, Cys, Val or Gly
  Variant (17)..(18): Xaa in position 17 to 18 is any amino acid
  Variant (19)..(19): Xaa in position 19 is Leu, Phe, Tyr or Met
  Variant (20)..(22): Xaa in position 20 to 22 is any amino acid
  Variant (24)..(25): Xaa in position 24 to 25 is any amino acid
  Variant (26)..(26): Xaa in position 26 is Val, Ile or Leu
XXXXXXXXXGXGXXXXXXXXXXGXXX

SEQ ID NO: 108276 - protein, 9 aa, Artificial sequence
  protein pattern
  Variant (1)..(1): Xaa in position 1 is Ile, Val, Leu, Phe or Ala
  Variant (2)..(2): Xaa in position 2 is Asp, His, Ser or Asn
  Variant (3)..(3): Xaa in position 3 is Ile, Val or Phe
  Variant (4)..(4): Xaa in position 4 is Leu, Val, Met, Ala or Ile
  Variant (5)..(5): Xaa in position 5 is Val, Phe, Ile, Cys, His or Tyr
  Variant (6)..(6): Xaa in position 6 is Asn or Ala
  Variant (7)..(7): Xaa in position 7 is Asn, Cys or Val
XXXXXXXAG

SEQ ID NO: 108277 - protein, 58 aa, Artificial sequence; identical to SEQ ID NO: 62170
  protein pattern
  Variant (2)..(2): Xaa in position 2 is Arg, Ser, Ala, Lys, Val or Asn
  Variant (3)..(3): Xaa in position 3 is Ile or Val
  Variant (4)..(4): Xaa in position 4 is Ile, Val or Leu
  Variant (5)..(6): Xaa in position 5 to 6 is any amino acid
  Variant (7)..(7): Xaa in position 7 is Ser, Ala, Thr or Gly
  Variant (9)..(10): Xaa in position 9 to 10 is any amino acid
  Variant (11)..(11): Xaa in position 11 is Gly, Ser, Ala, Arg or Trp
  Variant (12)..(19): Xaa in position 12 to 19 is any amino acid
  Variant (20)..(22): Xaa in position 20 to 22 is any or no amino acid
  Variant (24)..(24): Xaa in position 24 is any amino acid
  Variant (25)..(25): Xaa in position 25 is Ala, Thr, Ser, Val or Leu
  Variant (26)..(26): Xaa in position 26 is Ala, Ser or Thr
  Variant (28)..(28): Xaa in position 28 is Ala, Gly, His, Phe or Ser
  Variant (29)..(29): Xaa in position 29 is Gly or Ala
  Variant (30)..(30): Xaa in position 30 is Val, Leu, Ile, Met or Gln
  Variant (31)..(32): Xaa in position 31 to 32 is any amino acid
  Variant (33)..(33): Xaa in position 33 is Leu, Phe, Met or Ile
  Variant (34)..(34): Xaa in position 34 is Thr, Ser, Ile or Ala
  Variant (35)..(35): Xaa in position 35 is Lys, Arg, Gln or Met
  Variant (36)..(37): Xaa in position 36 to 37 is any amino acid
  Variant (38)..(38): Xaa in position 38 is Ala, Gly or Ser
  Variant (39)..(39): Xaa in position 39 is any amino acid
  Variant (40)..(40): Xaa in position 40 is Glu, Asp or Ala
  Variant (41)..(41): Xaa in position 41 is any amino acid
  Variant (42)..(42): Xaa in position 42 is Ala, Gly, Val, Ile or Ser
  Variant (43)..(44): Xaa in position 43 to 44 is any amino acid
  Variant (45)..(45): Xaa in position 45 is Gly, Asn, Lys or Arg
  Variant (46)..(46): Xaa in position 46 is Ile or Val
  Variant (47)..(47): Xaa in position 47 is Thr, Arg, Asn or Cys
  Variant (48)..(48): Xaa in position 48 is Val, Cys, Ala or Ile
  Variant (50)..(50): Xaa in position 50 is Ala, Cys, Val, Ser, Thr or Gly
  Variant (51)..(51): Xaa in position 51 is Ile, Val or Leu
  Variant (52)..(52): Xaa in position 52 is any amino acid
  Variant (55)..(55): Xaa in position 55 is any amino acid
  Variant (56)..(56): Xaa in position 56 is Ile, Val, Thr or Met
  Variant (57)..(57): Xaa in position 57 is any amino acid
  Variant (58)..(58): Xaa in position 58 is Thr or Ser

SEQ ID NO: 108278 - protein, 37 aa, Artificial sequence; identical to SEQ ID NO: 62171
  protein pattern
  Variant (1)..(1): Xaa in position 1 is Pro, Lys, Gln or Trp
  Variant (2)..(5): Xaa in position 2 to 5 is any amino acid
  Variant (6)..(6): Xaa in position 6 is Gly, Ala, Ile or Val
  Variant (7)..(9): Xaa in position 7 to 9 is any amino acid
  Variant (10)..(10): Xaa in position 10 is Glu, Asp, Gln or His
  Variant (11)..(11): Xaa in position 11 is Ile, Val or Leu
  Variant (12)..(12): Xaa in position 12 is Ala, Gly or Ser
  Variant (13)..(16): Xaa in position 13 to 16 is any amino acid
  Variant (17)..(17): Xaa in position 17 is Phe, Tyr or Trp
  Variant (18)..(18): Xaa in position 18 is Leu or Phe
  Variant (19)..(19): Xaa in position 19 is Ala, Cys, Val, Gly or Leu
  Variant (20)..(20): Xaa in position 20 is any amino acid
  Variant (21)..(23): Xaa in position 21 to 23 is any or no amino acid
  Variant (24)..(24): Xaa in position 24 is Ala, Ser, Gln or Gly
  Variant (25)..(25): Xaa in position 25 is any amino acid
  Variant (26)..(26): Xaa in position 26 is Tyr, Phe, Trp, Gln, Gly or Asn
  Variant (27)..(27): Xaa in position 27 is Ile, Val, Met, Thr, Leu or Ala
  Variant (28)..(28): Xaa in position 28 is Thr, Asn, Ser or Arg
  Variant (29)..(29): Xaa in position 29 is Gly or Ala
  Variant (30)..(33): Xaa in position 30 to 33 is any amino acid
  Variant (34)..(34): Xaa in position 34 is Val, Ile, Leu, Ala or Met
  Variant (35)..(35): Xaa in position 35 is Asp, Asn, Ser, Thr or Cys
  Variant (36)..(36): Xaa in position 36 is Gly or Ala

SEQ ID NO: 108279 - DNA, 1687 bp, Hordeum vulgare; identical to SEQ ID NO: 108201
  CDS (165)..(1409)

SEQ ID NO: 108280 - protein, 414 aa, Hordeum vulgare; identical to SEQ ID NO: 108202

SEQ ID NO: 108281 - DNA, 1239 bp, Brassica napus; identical to SEQ ID NO: 108203
  CDS (1)..(1239)

SEQ ID NO: 108282 - protein, 412 aa, Brassica napus; identical to SEQ ID NO: 108204

SEQ ID NO: 108283 - DNA, 1227 bp, Brassica napus; identical to SEQ ID NO: 108205
  CDS (1)..(1227)

SEQ ID NO: 108284 - protein, 408 aa, Brassica napus; identical to SEQ ID NO: 108206

SEQ ID NO: 108285 - DNA, 1233 bp, Brassica napus; identical to SEQ ID NO: 108207
  CDS (1)..(1233)

SEQ ID NO: 108286 - protein, 410 aa, Brassica napus; identical to SEQ ID NO: 108208

SEQ ID NO: 108287 - DNA, 1227 bp, Brassica napus; identical to SEQ ID NO: 108209
  CDS (1)..(1227)

SEQ ID NO: 108288 - protein, 408 aa, Brassica napus; identical to SEQ ID NO: 108210

SEQ ID NO: 108289 - DNA, 1245 bp, Zea mays; identical to SEQ ID NO: 108211
  CDS (1)..(1245)

SEQ ID NO: 108290 - protein, 414 aa, Zea mays; identical to SEQ ID NO: 108212

SEQ ID NO: 108291 - DNA, 1224 bp, Zea mays; identical to SEQ ID NO: 108213
  CDS (1)..(1224)

SEQ ID NO: 108292 - protein, 407 aa, Zea mays; identical to SEQ ID NO: 108214

SEQ ID NO: 108293 - DNA, 1500 bp, Zea mays; identical to SEQ ID NO: 108215
  CDS (1)..(1500)

SEQ ID NO: 108294 - protein, 499 aa, Zea mays; identical to SEQ ID NO: 108216

SEQ ID NO: 108295 - DNA, 1578 bp, Zea mays; identical to SEQ ID NO: 108217
  CDS (1)..(1578)

SEQ ID NO: 108296 - protein, 525 aa, Zea mays; identical to SEQ ID NO: 108218

SEQ ID NO: 108297 - DNA, 2301 bp, Zea mays; identical to SEQ ID NO: 108219
  CDS (1)..(2301)

SEQ ID NO: 108298 - protein, 766 aa, Zea mays; identical to SEQ ID NO: 108220

SEQ ID NO: 108299 - DNA, 1422 bp, Zea mays; identical to SEQ ID NO: 108221
  CDS (1)..(1422)

SEQ ID NO: 108300 - protein, 473 aa, Zea mays; identical to SEQ ID NO: 108222

SEQ ID NO: 108301 - DNA, 1500 bp, Zea mays; identical to SEQ ID NO: 108223
  CDS (1)..(1500)

SEQ ID NO: 108302 - protein, 499 aa, Zea mays; identical to SEQ ID NO: 68298

SEQ ID NO: 108303 - DNA, 1506 bp, Zea mays; identical to SEQ ID NO: 108225
  CDS (1)..(1506)

SEQ ID NO: 108304 - protein, 501 aa, Zea mays; identical to SEQ ID NO: 108226

SEQ ID NO: 108305 - DNA, 1857 bp, Zea mays; identical to SEQ ID NO: 108227
  CDS (1)..(1857)

SEQ ID NO: 108306 - protein, 618 aa, Zea mays; identical to SEQ ID NO: 108228

SEQ ID NO: 108307 - DNA, 1722 bp, Zea mays; identical to SEQ ID NO: 108229
  CDS (1)..(1722)

SEQ ID NO: 108308 - protein, 573 aa, Zea mays; identical to SEQ ID NO: 108230

SEQ ID NO: 108309 - DNA, 1224 bp, Zea mays; identical to SEQ ID NO: 108231
  CDS (1)..(1224)

SEQ ID NO: 108310 - protein, 407 aa, Zea mays; identical to SEQ ID NO: 108214

SEQ ID NO: 108311 - DNA, 2127 bp, Zea mays; identical to SEQ ID NO: 108233
  CDS (1)..(2127)

SEQ ID NO: 108312 - protein, 708 aa, Zea mays; identical to SEQ ID NO: 108234

SEQ ID NO: 108313 - DNA, 1290 bp, Zea mays; identical to SEQ ID NO: 108235
  CDS (1)..(1290)

SEQ ID NO: 108314 - protein, 429 aa, Zea mays; identical to SEQ ID NO: 108236

SEQ ID NO: 108315 - DNA, 1554 bp, Zea mays; identical to SEQ ID NO: 108237
  CDS (1)..(1554)

SEQ ID NO: 108316 - protein, 517 aa, Zea mays; identical to SEQ ID NO: 108238

SEQ ID NO: 108317 - DNA, 1926 bp, Zea mays; identical to SEQ ID NO: 108239
  CDS (1)..(1926)

SEQ ID NO: 108318 - protein, 641 aa, Zea mays; identical to SEQ ID NO: 108240

SEQ ID NO: 108319 - DNA, 1233 bp, Zea mays; identical to SEQ ID NO: 108241
  CDS (1)..(1233)

SEQ ID NO: 108320 - protein, 410 aa, Zea mays; identical to SEQ ID NO: 108242

SEQ ID NO: 108321 - DNA, 1224 bp, Zea mays; identical to SEQ ID NO: 108243
  CDS (1)..(1224)

SEQ ID NO: 108322 - protein, 407 aa, Zea mays; identical to SEQ ID NO: 108214

SEQ ID NO: 108323 - DNA, 1944 bp, Zea mays; identical to SEQ ID NO: 108245
  CDS (1)..(1944)

SEQ ID NO: 108324 - protein, 647 aa, Zea mays; identical to SEQ ID NO: 108246

SEQ ID NO: 108325 - DNA, 1584 bp, Zea mays; identical to SEQ ID NO: 108247
  CDS (1)..(1584)

SEQ ID NO: 108326 - protein, 527 aa, Zea mays; identical to SEQ ID NO: 108248

SEQ ID NO: 108327 - DNA, 21 bp, Artificial sequence
  primer
atggcaggaatggcaccagag

SEQ ID NO: 108328 - DNA, 22 bp, Artificial sequence
  primer
ctagagaaggtcggcgacattg

SEQ ID NO: 108329 - protein, 402 aa, Artificial sequence; identical to SEQ ID NO: 79814
  consensus sequence
  Variant (2)..(5): Xaa in position 2 to 5 is any amino acid
  Variant (7)..(17): Xaa in position 7 to 17 is any amino acid
  Variant (19)..(21): Xaa in position 19 to 21 is any amino acid
  Variant (23)..(23): Xaa in position 23 is any amino acid
  Variant (27)..(29): Xaa in position 27 to 29 is any amino acid
  Variant (32)..(33): Xaa in position 32 to 33 is any amino acid
  Variant (35)..(35): Xaa in position 35 is any amino acid
  Variant (37)..(37): Xaa in position 37 is any amino acid
  Variant (39)..(42): Xaa in position 39 to 42 is any amino acid
  Variant (52)..(52): Xaa in position 52 is any amino acid
  Variant (54)..(54): Xaa in position 54 is any amino acid
  Variant (57)..(69): Xaa in position 57 to 69 is any amino acid
  Variant (70)..(96): Xaa in position 70 to 96 is any or no amino acid
  Variant (98)..(98): Xaa in position 98 is any amino acid
  Variant (100)..(100): Xaa in position 100 is any amino acid
  Variant (107)..(107): Xaa in position 107 is any amino acid
  Variant (109)..(128): Xaa in position 109 to 128 is any amino acid
  Variant (129)..(130): Xaa in position 129 to 130 is any or no amino acid
  Variant (133)..(137): Xaa in position 133 to 137 is any amino acid
  Variant (139)..(141): Xaa in position 139 to 141 is any amino acid
  Variant (143)..(150): Xaa in position 143 to 150 is any amino acid
  Variant (151)..(152): Xaa in position 151 to 152 is any or no amino acid
  Variant (158)..(158): Xaa in position 158 is any amino acid
  Variant (160)..(174): Xaa in position 160 to 174 is any amino acid
  Variant (175)..(175): Xaa in position 175 is any or no amino acid
  Variant (182)..(182): Xaa in position 182 is any amino acid
  Variant (185)..(185): Xaa in position 185 is any amino acid
  Variant (189)..(190): Xaa in position 189 to 190 is any amino acid
  Variant (192)..(199): Xaa in position 192 to 199 is any amino acid
  Variant (201)..(203): Xaa in position 201 to 203 is any amino acid
  Variant (204)..(205): Xaa in position 204 to 205 is any or no amino acid
  Variant (207)..(209): Xaa in position 207 to 209 is any amino acid
  Variant (214)..(228): Xaa in position 214 to 228 is any amino acid
  Variant (229)..(229): Xaa in position 229 is any or no amino acid
  Variant (231)..(245): Xaa in position 231 to 245 is any amino acid
  Variant (246)..(249): Xaa in position 246 to 249 is any or no amino acid
  Variant (251)..(257): Xaa in position 251 to 257 is any amino acid
  Variant (258)..(266): Xaa in position 258 to 266 is any or no amino acid
  Variant (268)..(270): Xaa in position 268 to 270 is any amino acid
  Variant (272)..(284): Xaa in position 272 to 284 is any amino acid
  Variant (285)..(287): Xaa in position 285 to 287 is any or no amino acid
  Variant (289)..(290): Xaa in position 289 to 290 is any amino acid
  Variant (293)..(301): Xaa in position 293 to 301 is any amino acid
  Variant (303)..(305): Xaa in position 303 to 305 is any amino acid
  Variant (306)..(308): Xaa in position 306 to 308 is any or no amino acid
  Variant (310)..(316): Xaa in position 310 to 316 is any amino acid
  Variant (318)..(320): Xaa in position 318 to 320 is any amino acid
  Variant (322)..(323): Xaa in position 322 to 323 is any amino acid
  Variant (325)..(333): Xaa in position 325 to 333 is any amino acid
  Variant (335)..(338): Xaa in position 335 to 338 is any amino acid
  Variant (344)..(344): Xaa in position 344 is any amino acid
  Variant (349)..(349): Xaa in position 349 is any amino acid
  Variant (351)..(356): Xaa in position 351 to 356 is any amino acid
  Variant (358)..(358): Xaa in position 358 is any amino acid
  Variant (360)..(362): Xaa in position 360 to 362 is any amino acid
  Variant (364)..(368): Xaa in position 364 to 368 is any amino acid
  Variant (370)..(370): Xaa in position 370 is any amino acid
  Variant (381)..(382): Xaa in position 381 to 382 is any amino acid
  Variant (384)..(384): Xaa in position 384 is any amino acid
  Variant (386)..(399): Xaa in position 386 to 399 is any amino acid
  Variant (400)..(400): Xaa in position 400 is any or no amino acid

SEQ ID NO: 108330 - protein, 61 aa, Artificial sequence; identical to SEQ ID NO: 79815
  protein pattern
  Variant (1)..(1): Xaa in position 1 is Phe or Trp
  Variant (2)..(3): Xaa in position 2 to 3 is any amino acid
  Variant (4)..(4): Xaa in position 4 is Leu, Phe, Ile or Met
  Variant (5)..(5): Xaa in position 5 is any amino acid
  Variant (6)..(6): Xaa in position 6 is Leu, Ile, Phe, Met or Val
  Variant (7)..(9): Xaa in position 7 to 9 is any amino acid
  Variant (10)..(10): Xaa in position 10 is Leu, Ile, Val, Met or Phe
  Variant (11)..(13): Xaa in position 11 to 13 is any amino acid
  Variant (14)..(14): Xaa in position 14 is Leu, Val, Ile, Ala or Met
  Variant (15)..(17): Xaa in position 15 to 17 is any amino acid
  Variant (18)..(18): Xaa in position 18 is Gly, Asn, Lys, Asp or Glu
  Variant (19)..(19): Xaa in position 19 is Tyr, Phe, Ile or His
  Variant (20)..(21): Xaa in position 20 to 21 is any amino acid
  Variant (22)..(22): Xaa in position 22 is Pro, Ala or Cys
  Variant (23)..(23): Xaa in position 23 is Thr, Ser or Lys
  Variant (24)..(24): Xaa in position 24 is any amino acid
  Variant (25)..(25): Xaa in position 25 is Ile or Val
  Variant (27)..(28): Xaa in position 27 to 28 is any amino acid
  Variant (29)..(29): Xaa in position 29 is Ala, Thr, Ser or Cys
  Variant (30)..(30): Xaa in position 30 is Ile, Leu or Val
  Variant (32)..(33): Xaa in position 32 to 33 is any amino acid
  Variant (34)..(34): Xaa in position 34 is Leu, Met, Ile or Val
  Variant (35)..(35): Xaa in position 35 is any amino acid
  Variant (36)..(36): Xaa in position 36 is Gly, Arg, Gln, Met, Asn or Glu
  Variant (37)..(37): Xaa in position 37 is any amino acid
  Variant (39)..(39): Xaa in position 39 is Val, Leu, Ile, Met or Ala
  Variant (40)..(40): Xaa in position 40 is Leu, Met, Ile, Val or Ala
  Variant (41)..(41): Xaa in position 41 is Gly, Ala, Val, Ile or Leu
  Variant (42)..(42): Xaa in position 42 is any amino acid
  Variant (43)..(43): Xaa in position 43 is Ala or Ser
  Variant (44)..(44): Xaa in position 44 is Gln, Pro, Ala or Lys
  Variant (47)..(47): Xaa in position 47 is Thr or Ser
  Variant (51)..(51): Xaa in position 51 is Ala, Leu, Gly, Val, Phe or Met
  Variant (52)..(52): Xaa in position 52 is Ala, Gly or Ser
  Variant (53)..(53): Xaa in position 53 is Phe or Tyr
  Variant (54)..(54): Xaa in position 54 is any amino acid
  Variant (55)..(55): Xaa in position 55 is Leu, Ile or Val
  Variant (56)..(56): Xaa in position 56 is Pro or Ala
  Variant (57)..(57): Xaa in position 57 is Ile, Leu, Met, Ala, Val, Thr or Ser
  Variant (58)..(58): Xaa in position 58 is Leu, Ile, Val, Phe or Met
  Variant (59)..(60): Xaa in position 59 to 60 is any amino acid
  Variant (61)..(61): Xaa in position 61 is Leu, Ile, Val or Met

SEQ ID NO: 108331 - protein, 113 aa, Artificial sequence; identical to SEQ ID NO: 79816
  protein pattern
  Variant (6)..(6): Xaa in position 6 is Ala, Val, Ser, Thr or Gly
  Variant (7)..(7): Xaa in position 7 is any amino acid
  Variant (9)..(9): Xaa in position 9 is Val, Ile, Thr, Ser or Ala
  Variant (10)..(15): Xaa in position 10 to 15 is any amino acid
  Variant (16)..(16): Xaa in position 16 is Tyr, Leu, Phe, Met, Ala or Val
  Variant (17)..(17): Xaa in position 17 is Gly, Ala, Ser, Thr, Val or Leu
  Variant (18)..(26): Xaa in position 18 to 26 is any amino acid
  Variant (27)..(28): Xaa in position 27 to 28 is any or no amino acid
  Variant (29)..(29): Xaa in position 29 is Ile, Val, Leu, Ala or Met
  Variant (30)..(30): Xaa in position 30 is Tyr, Phe, Thr, Ile, Val, Leu or Met
  Variant (33)..(37): Xaa in position 33 to 37 is any amino acid
  Variant (38)..(38): Xaa in position 38 is Gln or His
  Variant (39)..(41): Xaa in position 39 to 41 is any amino acid
  Variant (42)..(42): Xaa in position 42 is Leu, Phe, Ile, Met or Val
  Variant (43)..(46): Xaa in position 43 to 46 is any amino acid
  Variant (47)..(48): Xaa in position 47 to 48 is any or no amino acid
  Variant (49)..(49): Xaa in position 49 is Ile, Val, Leu or Phe
  Variant (50)..(50): Xaa in position 50 is Leu, Val, Ile or Met
  Variant (51)..(51): Xaa in position 51 is Val or Ile
  Variant (52)..(52): Xaa in position 52 is Ala or Gly
  Variant (53)..(53): Xaa in position 53 is Thr or Cys
  Variant (54)..(54): Xaa in position 54 is Pro or Thr
  Variant (57)..(57): Xaa in position 57 is Leu, Ile, Val, Met, Phe or Ala
  Variant (58)..(58): Xaa in position 58 is Leu, Ile, Met, Val or Ala
  Variant (59)..(59): Xaa in position 59 is Asp, Gln or Glu
  Variant (60)..(70): Xaa in position 60 to 70 is any amino acid
  Variant (71)..(71): Xaa in position 71 is any or no amino acid
  Variant (72)..(72): Xaa in position 72 is Val, Leu, Ile, Thr, Cys or Pro
  Variant (73)..(74): Xaa in position 73 to 74 is any amino acid
  Variant (75)..(75): Xaa in position 75 is Leu, Phe, Val, Ile, Met or Cys
  Variant (76)..(76): Xaa in position 76 is Val or Ile
  Variant (77)..(77): Xaa in position 77 is Leu, Ile, Phe or Val
  Variant (80)..(80): Xaa in position 80 is Ala, Ser or Gly
  Variant (82)..(82): Xaa in position 82 is Arg, Glu or Gln
  Variant (83)..(83): Xaa in position 83 is Met or Leu
  Variant (84)..(84): Xaa in position 84 is Leu, Phe or Met
  Variant (85)..(85): Xaa in position 85 is any amino acid
  Variant (86)..(86): Xaa in position 86 is Met, Leu, Ile or Phe
  Variant (89)..(91): Xaa in position 89 to 91 is any amino acid
  Variant (92)..(92): Xaa in position 92 is Ile, Val, Leu, Ala or Met
  Variant (93)..(94): Xaa in position 93 to 94 is any amino acid
  Variant (95)..(95): Xaa in position 95 is Ile, Val, Leu or Met
  Variant (96)..(103): Xaa in position 96 to 103 is any amino acid
  Variant (104)..(105): Xaa in position 104 to 105 is any or no amino acid
  Variant (106)..(106): Xaa in position 106 is Gln or His
  Variant (107)..(108): Xaa in position 107 to 108 is any amino acid
  Variant (109)..(109): Xaa in position 109 is Leu, Phe or Met
  Variant (110)..(110): Xaa in position 110 is Phe or Tyr
  Variant (111)..(111): Xaa in position 111 is Ser or Thr

SEQ ID NO: 108332 - protein, 96 aa, Artificial sequence; identical to SEQ ID NO: 79817
  protein pattern
  Variant (2)..(4): Xaa in position 2 to 4 is any amino acid
  Variant (5)..(5): Xaa in position 5 is Lys, Arg or Gln
  Variant (6)..(10): Xaa in position 6 to 10 is any amino acid
  Variant (11)..(11): Xaa in position 11 is Leu, Val, Ile or Met
  Variant (12)..(14): Xaa in position 12 to 14 is any amino acid
  Variant (15)..(15): Xaa in position 15 is Leu, Met or Ile
  Variant (16)..(24): Xaa in position 16 to 24 is any amino acid
  Variant (25)..(27): Xaa in position 25 to 27 is any or no amino acid
  Variant (28)..(28): Xaa in position 28 is Ile, Leu, Met, Val or Phe
  Variant (29)..(29): Xaa in position 29 is any amino acid
  Variant (30)..(30): Xaa in position 30 is Gly, Ala or Ser
  Variant (31)..(33): Xaa in position 31 to 33 is any amino acid
  Variant (35)..(36): Xaa in position 35 to 36 is any amino acid
  Variant (38)..(40): Xaa in position 38 to 40 is any amino acid
  Variant (41)..(41): Xaa in position 41 is Leu, Ile, Val or Met
  Variant (42)..(43): Xaa in position 42 to 43 is any amino acid
  Variant (44)..(44): Xaa in position 44 is Phe, Leu, Met or Ile
  Variant (46)..(51): Xaa in position 46 to 51 is any amino acid
  Variant (52)..(52): Xaa in position 52 is Leu or Met
  Variant (53)..(53): Xaa in position 53 is Val, Ile or Leu
  Variant (54)..(54): Xaa in position 54 is Ala, Cys or Thr
  Variant (55)..(55): Xaa in position 55 is Thr or Ser
  Variant (57)..(57): Xaa in position 57 is Val or Ile
  Variant (59)..(59): Xaa in position 59 is Ala, Ser or Gly
  Variant (62)..(62): Xaa in position 62 is Leu or Ile
  Variant (63)..(63): Xaa in position 63 is Asp or His
  Variant (64)..(64): Xaa in position 64 is Ile, Val or Leu
  Variant (65)..(66): Xaa in position 65 to 66 is any amino acid
  Variant (67)..(67): Xaa in position 67 is Val, Leu, Ile or Met
  Variant (68)..(69): Xaa in position 68 to 69 is any amino acid
  Variant (71)..(71): Xaa in position 71 is Val, Ile, Phe, Tyr, Leu or Met
  Variant (73)..(73): Xaa in position 73 is Phe, Tyr or Leu
  Variant (74)..(74): Xaa in position 74 is Asp, Glu or His
  Variant (75)..(75): Xaa in position 75 is Leu, Ile, Met or Val
  Variant (77)..(79): Xaa in position 77 to 79 is any amino acid
  Variant (80)..(80): Xaa in position 80 is Glu, Asp, Lys or Gln
  Variant (81)..(81): Xaa in position 81 is any amino acid
  Variant (83)..(83): Xaa in position 83 is Val, Ile, Leu or Met
  Variant (86)..(86): Xaa in position 86 is Ile or Val
  Variant (89)..(89): Xaa in position 89 is Thr or Ser
  Variant (90)..(90): Xaa in position 90 is Gly or Ala
  Variant (92)..(92): Xaa in position 92 is Ala, Asn, Gly or Leu
  Variant (93)..(93): Xaa in position 93 is Gly, Ala, Asn or Glu
  Variant (94)..(95): Xaa in position 94 to 95 is any amino acid

SEQ ID NO: 108333 - DNA, 1864 bp, Brassica napus
  CDS (34)..(1596)
agtgaagctcctcctctcgagtctcgaacaacaatggcgacaatggctgcaatcggatccttaaaagtcccttcctcttcctcgaaccacacccgtagattatcatcttcttctcaacggaagactctctcgttctcgtcgtcttctcttaccggagagaaactcaacccaacgcaggagatcatcatctccaatctcccacgtcgcaacgagagaagaacgccatcgatcgtctctccaaaagcagtttccgattcgcaaaactcgcaaacttgccttgatcctgacgctagcagaagtgtgttggggataattctgggaggtggtgctggaacgagattgtatccgctaacgaagaagagagcgaagccagctgttcctctcggcgccaactaccgtctcattgatatcccagtgagcaattgcttgaacagtaacatctccaagatctatgtccttactcagttcaactccgcttctctcaaccgccatctctcccgagcttacgccagcaacatgggtggttacaagaacgaaggcttcgtcgaggttcttgctgctcaacagagtcccgagaatcccaattggtttcaggggactgctgatgcagtgaggcagtacttgtggctgtttgaagagcacaatgtgttggagtttttggttcttgcaggggatcatttgtaccgtatggactacgagaagttcattcaagcgcatcgtgagaccgacgctgatatcactgttgctgctcttcctatggatgagaaacgtgccacggcttttggacttatgaagattgatgacgaaggaaggatcattgagtttgctgagaagcctaaaggagagcagttaaaggctatgaaggttgatacaacaatcttgggacttgatgacgaaagggccaaagagatgccctttattgctagtatggggatatatgttgttagcaagaatgtgatgttggacttgctccgagaccagttccctggagctaatgacttcgggagtgaagttatccctggtgctactgatcttggactcagagtgcaagcttatctgtatgatggatactgggaagatattggtaccattgaagccttttacaatgctaatcttgggatcaccaagaaaccagtaccagatttcagcttctatgaccgttcagcaccaatctacacacagcctcggtacttacctccatccaagatgcttgatgccgatgttaccgatagtgtgatcggtgaaggttgtgtcatcaagaattgcaaaatccaccattccgtcattggtcttcggtcttgcatatcggagggtgcaatcatagaagacaccttgttgatgggtgctgactactacgagactgatgcggataggacactcctggctgcaaaaggcagcatcccgattggcattggccgagactctcacattaaaagagctatcattgacaagaatgctcgcattggtgacaacgtcaagatcatcaacacggacaatgtgcaagaagctgccagagagacggatggatacttcatcaagagcggcattgttacagtgatcaaggatgctctgattcctagtggaactgttatctaagagacaccaccaccccgtttgacaatcttcttaatatctcatggttttgacctcgagttagcttccactgatgctatctctaatgttatccgaggtcagggcctatgcatcctcctgccttatccctaaataatattctctactttgtattctagatctttggcgatatatgcgtatatatacatgcatttttttttaaaaaaaaaagcacaacattccctctatgtaacaaaactatgaaccagaaattgttaaaaaaaaaaaaaaa

SEQ ID NO: 108334 - protein, 520 aa, Brassica napus
MATMAAIGSLKVPSSSSNHTRRLSSSSQRKTLSFSSSSLTGEKLNPTQEIIISNLPRRNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 108335 - DNA, 1878 bp, Brassica napus
  CDS (98)..(1669)
cttcgcctcgttctctcctttgggtgcatgaaggacatatcacattaattcaaaaccagacaatacgaataaggtctttacaatccgcttaaaaaatatggattcttgttgctacttgggattggggacaaacactgtcttgcccaaagacggttacaagaatatagagaacagtttttggggtgagaagatcaaaggaagcttctctaaaccttttgcttcagattcaagttccaaggagttaagatatcgaaagtcgccgaggccaggtgttgcttatgcggttgctacttcaaagaatgctaaagaggctttgagactacagccttcgatgttgggggagagaagaaaagcagatccaaaaaacgtggcagcaatcattctgggaggaggcaatggagctaaactcttccctctcaccaagcgagctgcaactccagctgttcctgtgggtggatgctataggatgatcgacatccctatgagtaattgcattaacagttgcatcaacaagatcttcgtgctcactcagtttaactcggcttccctcaaccgccacttggctcgtacttatttcgggaatggcatcaactttggagatggtttcgttgaggttctagctgctacacagactcctggtgaagcagggaagaaatggtttcaaggaacagcagatgctgtcagaaagtttctctgggtgtttgaggatgctaagaataggaacattgagaatattatcatcttgtctggagatcatctctacagaatgaactacatggactttgttcagtaccatgtggatagcaacgcggatattactctttcgtgcgcgccagtgggtgagagtcgtgcatcggattatggactagtgaacattgatcgaaccggacgtgtggtccatttctgtgagaaaccaactggcatcgatctcaaatcaatgcaaagtgatacgacaatgcttggactgtctcaacaagaagcagtgaaatctccgtacattgcatcaatgggagtttactgtttcaaaacggaagctttgctgaagcttctgacacggcgctatccgagttccaatgactttggatctgagatcatccctgcagctataagagatcacaatgttcaaggatacgtctacagagactattgggaagatattggaactataaagagcttctatgatgctaatcttgctcttgtcgaggagcatcccaagtttgagttttatgatcaggatacacctttctacacttctcctcggtttctacctcccaccaaaactgagaaatgccgcatagtggattcgataatatcacacggatgtttcttgggagaatgcagcatccaacgttccatcattggtgaaaggtcacgtcttgactatggtgttgagcttcaggatactttgatgttgggagcggatagttaccaaaccgaatctgagatagcgtctttgctcgcggaaggcaatgtaccaattggcattggcagagacacaaagatcaggaaatgcatcattgacaagaatgcaaagatcgggaagaacgtgatgatcttgaacagtgatgatgtgcaagaagctgataggccagaggaggggttctacattaggtctgggatcactgtggttgtggaaaaggctaccattaaagacggcactgtcatatgaaccaacaacggagtgatctgattgagaacactcttgaccaacgatcttgattgaggtgtttttgaagtgttgtttttgggtggaagcagtgaaaacagagacagttgtgataatgtttttaatgtaaattacttgagagtactacttagaaccaaaagagagtttaagcttaccaataagagtgatctacctataaaaaaaaaaaaaaa

SEQ ID NO: 108336 - protein, 523 aa, Brassica napus
MDSCCYLGLGTNTVLPKDGYKNIENSFWGEKIKGSFSKPFASDSSSKELRYRKSPRPGVAYAVATSKNAKEALRLQPSMLGERRKADPKNVAAIILGGGNGAKLFPLTKRAATPAVPVGGCYRMIDIPMSNCINSCINKIFVLTQFNSASLNRHLARTYFGNGINFGDGFVEVLAATQTPGEAGKKWFQGTADAVRKFLWVFEDAKNRNIENIIILSGDHLYRMNYMDFVQYHVDSNADITLSCAPVGESRASDYGLVNIDRTGRVVHFCEKPTGIDLKSMQSDTTMLGLSQQEAVKSPYIASMGVYCFKTEALLKLLTRRYPSSNDFGSEIIPAAIRDHNVQGYVYRDYWEDIGTIKSFYDANLALVEEHPKFEFYDQDTPFYTSPRFLPPTKTEKCRIVDSIISHGCFLGECSIQRSIIGERSRLDYGVELQDTLMLGADSYQTESEIASLLAEGNVPIGIGRDTKIRKCIIDKNAKIGKNVMILNSDDVQEADRPEEGFYIRSGITVVVEKATIKDGTVI

SEQ ID NO: 108337 - DNA, 2212 bp, Glycine max
  CDS (383)..(1978)
gaattcccgggtcgacagcgaagtcagtgacagatcgaaagacttcgcaggtttctcgtgagtcgttaacgttagtgtagtgtcccttgctatttgccaatacaactcattctacatttctatcttctccttctccattaccaaatttttctgtacgtagtttctacctcctaggtcccaccttcgtttctctgaaaaatctcatctttttggggctcttttcacttgaatctccccagttatgattcctcaacttatggtacaaattgtctgaaaagtttggtactttattaaagtagttttgctcttccctcatacaaattccattgagcagaaagttaccaaatccaaaaaggtttctatttccgttattgatttagcaatggattcagcttgtgcaaccctgaatggccgccatctagccaaagttagtgagggaattggaagaaacagaacaagtggcttctggggtgagagtacgaggggaagtgtgaacacaaaaaggtttttgagtgttcaatcatgcaagacttcacgaaccaataggaatcttagaaactccaagcctggaagtggaattgcacgcgctgttctcacatcagacatcgacgaagattccatggcatttcaaggggtacccacttttgagaaacctgaagtggacccaaaaagtgtggcttccatcatattgggtggaggtgcaggaactcgactctttcctcttactggcagaagagccaagccagcggttccaattggagggtgttatagactcatagatatccccatgagcaattgcatcaatagtggcatcagaaaaattttcatcttgacgcagttcaattctttctctctcaaccgccacctgtcccgtgcatacagcttcggaaatggcatgacttttggagatgggtttgtggaggtcttggcagctactcaaacaccgggtgaggctgggaagaagtggttccaagggacagctgatgctgtaagacaatttatatgggtttttgaggatgccaagaacaagaatgttgagcatatattgatactttctggcgatcatctttaccgtatggactatatggactttgtacagagacatgttgacacaaatgccgatatcacagtttcatgtgtacccatggatgacagtcgggcatcagactatggactgatgaaaattgataaaacaggacggattatacagtttgcagaaaaacctaagggatcagatctaaaggcaatgcgtgttgacaccactcttttagggttattgccacaagaagcagaaaaacatccttatattgcatccatgggtgtctacgtgtttagaactgaaaccttgctgcaactattaagatggaaatgttcttcatgcaatgactttggatctgaaattatcccatctgctgtgaatgagcacaatgtccaggcatatttgttcaatgactactgggaagatattggaactataaagtccttctttgatgcaaatcttgctctaacagaacagcctcctaaatttgaattctatgatccaaagacacctttcttcacttcccccagattcctaccacctaccaaagtagaaaaatgcaagattgtggatgcaattatatctcatggttgcttcttgagggagtgcagcgttcaacattctattgttggagtacgctcacgtttggagtctggtgtggagcttcaggatacgatgatgatgggtgctgactattatcaaactgagtatgaaattgcatctctggtggcagaagggaaggttccaattggtgtcggggcaaatactaaaatcaggaattgcataatcgacaagaatgccaagataggaagaaatgtgatcatagcaaacaccgatggtgttcaagaagctgacagggcaaaggaaggattctacattaggtcgggcatcacagttacattaaaaaatgcaacaatcaaagatggaacagttatatgaagcacttcaagttatccagcaggccactttataatagttttgacataagtacattcacttccgacataatagtagatgaaatgctagctcgtacattacaaagtttctctcgatatatctctataatagttatgtttattgcatttgtaggacacttcacttgtaataacaggcaattcttgccactacgattaagttataaattaaagtttctaacttaaaaaaaaaaaaaaa

SEQ ID NO: 108338 - protein, 531 aa, Glycine max
MDSACATLNGRHLAKVSEGIGRNRTSGFWGESTRGSVNTKRFLSVQSCKTSRTNRNLRNSKPGSGIARAVLTSDIDEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGMTFGDGFVEVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPKGSDLKAMRVDTTLLGLLPQEAEKHPYIASMGVYVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASLVAEGKVPIGVGANTKIRNCIIDKNAKIGRNVIIANTDGVQEADRAKEGFYIRSGITVTLKNATIKDGTVI

SEQ ID NO: 108339 - DNA, 21 bp, Artificial sequence
  primer
atggcgacaatggctgcaatc

SEQ ID NO: 108340 - DNA, 25 bp, Artificial sequence
  primer
ttagataacagttccactaggaatc

SEQ ID NO: 108341 - protein, 527 aa, Artificial sequence; identical to SEQ ID NO: 15681
  consensus sequence
  Variant (2)..(4): Xaa in position 2 to 4 is any amino acid
  Variant (10)..(10): Xaa in position 10 is any amino acid
  Variant (13)..(13): Xaa in position 13 is any amino acid
  Variant (15)..(15): Xaa in position 15 is any amino acid
  Variant (19)..(20): Xaa in position 19 to 20 is any amino acid
  Variant (23)..(23): Xaa in position 23 is any amino acid
  Variant (28)..(28): Xaa in position 28 is any amino acid
  Variant (30)..(31): Xaa in position 30 to 31 is any amino acid
  Variant (39)..(39): Xaa in position 39 is any amino acid
  Variant (43)..(43): Xaa in position 43 is any amino acid
  Variant (46)..(46): Xaa in position 46 is any amino acid
  Variant (48)..(48): Xaa in position 48 is any amino acid
  Variant (50)..(50): Xaa in position 50 is any amino acid
  Variant (52)..(53): Xaa in position 52 to 53 is any amino acid
  Variant (62)..(62): Xaa in position 62 is any amino acid
  Variant (67)..(75): Xaa in position 67 to 75 is any amino acid
  Variant (77)..(81): Xaa in position 77 to 81 is any amino acid
  Variant (83)..(83): Xaa in position 83 is any amino acid
  Variant (90)..(90): Xaa in position 90 is any amino acid
  Variant (92)..(92): Xaa in position 92 is any amino acid
  Variant (94)..(99): Xaa in position 94 to 99 is any amino acid
  Variant (110)..(112): Xaa in position 110 to 112 is any amino acid
  Variant (114)..(114): Xaa in position 114 is any amino acid
  Variant (117)..(127): Xaa in position 117 to 127 is any amino acid
  Variant (129)..(129): Xaa in position 129 is any amino acid
  Variant (131)..(131): Xaa in position 131 is any amino acid
  Variant (133)..(140): Xaa in position 133 to 140 is any amino acid
  Variant (149)..(152): Xaa in position 149 to 152 is any amino acid
  Variant (154)..(154): Xaa in position 154 is any amino acid
  Variant (156)..(159): Xaa in position 156 to 159 is any amino acid
  Variant (164)..(167): Xaa in position 164 to 167 is any amino acid
  Variant (169)..(197): Xaa in position 169 to 197 is any amino acid
  Variant (200)..(202): Xaa in position 200 to 202 is any amino acid
  Variant (205)..(205): Xaa in position 205 is any amino acid
  Variant (209)..(210): Xaa in position 209 to 210 is any amino acid
  Variant (213)..(215): Xaa in position 213 to 215 is any amino acid
  Variant (217)..(217): Xaa in position 217 is any amino acid
  Variant (223)..(224): Xaa in position 223 to 224 is any amino acid
  Variant (226)..(227): Xaa in position 226 to 227 is any amino acid
  Variant (229)..(229): Xaa in position 229 is any amino acid
  Variant (233)..(234): Xaa in position 233 to 234 is any amino acid
  Variant (238)..(242): Xaa in position 238 to 242 is any amino acid
  Variant (244)..(246): Xaa in position 244 to 246 is any amino acid
  Variant (254)..(255): Xaa in position 254 to 255 is any amino acid
  Variant (258)..(263): Xaa in position 258 to 263 is any amino acid
  Variant (265)..(265): Xaa in position 265 is any amino acid
  Variant (268)..(286): Xaa in position 268 to 286 is any amino acid
  Variant (288)..(289): Xaa in position 288 to 289 is any amino acid
  Variant (296)..(296): Xaa in position 296 is any amino acid
  Variant (299)..(299): Xaa in position 299 is any amino acid
  Variant (301)..(308): Xaa in position 301 to 308 is any amino acid
  Variant (311)..(314): Xaa in position 311 to 314 is any amino acid
  Variant (323)..(324): Xaa in position 323 to 324 is any amino acid
  Variant (326)..(327): Xaa in position 326 to 327 is any amino acid
  Variant (331)..(332): Xaa in position 331 to 332 is any amino acid
  Variant (334)..(337): Xaa in position 334 to 337 is any amino acid
  Variant (339)..(339): Xaa in position 339 is any amino acid
  Variant (341)..(341): Xaa in position 341 is any amino acid
  Variant (345)..(347): Xaa in position 345 to 347 is any amino acid
  Variant (349)..(350): Xaa in position 349 to 350 is any amino acid
  Variant (352)..(353): Xaa in position 352 to 353 is any amino acid
  Variant (355)..(355): Xaa in position 355 is any amino acid
  Variant (359)..(359): Xaa in position 359 is any amino acid
  Variant (361)..(369): Xaa in position 361 to 369 is any amino acid
  Variant (371)..(372): Xaa in position 371 to 372 is any amino acid
  Variant (374)..(375): Xaa in position 374 to 375 is any amino acid
  Variant (378)..(382): Xaa in position 378 to 382 is any amino acid
  Variant (384)..(386): Xaa in position 384 to 386 is any amino acid
  Variant (389)..(390): Xaa in position 389 to 390 is any amino acid
  Variant (392)..(392): Xaa in position 392 is any amino acid
  Variant (395)..(398): Xaa in position 395 to 398 is any amino acid
  Variant (400)..(403): Xaa in position 400 to 403 is any amino acid
  Variant (405)..(407): Xaa in position 405 to 407 is any amino acid
  Variant (412)..(412): Xaa in position 412 is any amino acid
  Variant (414)..(414): Xaa in position 414 is any amino acid
  Variant (416)..(421): Xaa in position 416 to 421 is any amino acid
  Variant (423)..(425): Xaa in position 423 to 425 is any amino acid
  Variant (427)..(428): Xaa in position 427 to 428 is any amino acid
  Variant (432)..(432): Xaa in position 432 is any amino acid
  Variant (434)..(434): Xaa in position 434 is any amino acid
  Variant (436)..(437): Xaa in position 436 to 437 is any amino acid
  Variant (439)..(470): Xaa in position 439 to 470 is any amino acid
  Variant (477)..(477): Xaa in position 477 is any amino acid
  Variant (480)..(481): Xaa in position 480 to 481 is any amino acid
  Variant (483)..(483): Xaa in position 483 is any amino acid
  Variant (485)..(485): Xaa in position 485 is any amino acid
  Variant (487)..(490): Xaa in position 487 to 490 is any amino acid
  Variant (495)..(495): Xaa in position 495 is any amino acid
  Variant (497)..(499): Xaa in position 497 to 499 is any amino acid
  Variant (501)..(504): Xaa in position 501 to 504 is any amino acid
  Variant (506)..(506): Xaa in position 506 is any amino acid
  Variant (510)..(515): Xaa in position 510 to 515 is any amino acid
  Variant (517)..(520): Xaa in position 517 to 520 is any amino acid
  Variant (522)..(523): Xaa in position 522 to 523 is any amino acid
  Variant (525)..(526): Xaa in position 525 to 526 is any amino acid

SEQ ID NO: 108342 - protein, 57 aa, Artificial sequence; identical to SEQ ID NO: 15677
  protein pattern
  Variant (1)..(1): Xaa in position 1 is Gly, Arg or Phe
  Variant (2)..(2): Xaa in position 2 is Thr, Ser, Ala, Lys or Val
  Variant (3)..(3): Xaa in position 3 is any amino acid
  Variant (5)..(5): Xaa in position 5 is Phe, Tyr or Gln
  Variant (6)..(6): Xaa in position 6 is Pro or Leu
  Variant (8)..(8): Xaa in position 8 is Thr or Arg
  Variant (9)..(11): Xaa in position 9 to 11 is any amino acid
  Variant (13)..(13): Xaa in position 13 is any amino acid
  Variant (14)..(14): Xaa in position 14 is Pro, Arg or Ala
  Variant (18)..(18): Xaa in position 18 is Leu, Ile, Met, Val, Phe or Ala
  Variant (20)..(20): Xaa in position 20 is Gly or Ala
  Variant (21)..(21): Xaa in position 21 is any amino acid
  Variant (24)..(24): Xaa in position 24 is Leu, Met or Lys
  Variant (25)..(25): Xaa in position 25 is Ile or Asn
  Variant (27)..(27): Xaa in position 27 is Ile or Val
  Variant (29)..(29): Xaa in position 29 is Met, Ile or Val
  Variant (33)..(33): Xaa in position 33 is Leu, Ile or Phe
  Variant (36)..(36): Xaa in position 36 is any amino acid
  Variant (37)..(37): Xaa in position 37 is Ile or Val
  Variant (38)..(38): Xaa in position 38 is any amino acid
  Variant (40)..(40): Xaa in position 40 is any or no amino acid
  Variant (41)..(41): Xaa in position 41 is Ile or Val
  Variant (42)..(42): Xaa in position 42 is Tyr or Phe
  Variant (43)..(43): Xaa in position 43 is Val, Ile or Cys
  Variant (44)..(44): Xaa in position 44 is Leu, Met or Arg
  Variant (45)..(45): Xaa in position 45 is Thr or Ser
  Variant (47)..(47): Xaa in position 47 is Phe or Tyr
  Variant (49)..(49): Xaa in position 49 is Ser or Leu
  Variant (50)..(50): Xaa in position 50 is any amino acid
  Variant (51)..(51): Xaa in position 51 is Ser, Ala or Phe
  Variant (52)..(52): Xaa in position 52 is any or no amino acid
  Variant (53)..(53): Xaa in position 53 is Leu, Ile or Pro
  Variant (54)..(54): Xaa in position 54 is Asn or Ile
  Variant (55)..(55): Xaa in position 55 is Arg or Gly
  Variant (56)..(56): Xaa in position 56 is His or Asn
  Variant (57)..(57): Xaa in position 57 is Leu or Ile

SEQ ID NO: 108343 - protein, 68 aa, Artificial sequence; identical to SEQ ID NO: 15678
  protein pattern
  Variant (2)..(2): Xaa in position 2 is any amino acid
  Variant (4)..(4): Xaa in position 4 is Glu or Gln
  Variant (5)..(5): Xaa in position 5 is Val, Ala or Gly
  Variant (6)..(6): Xaa in position 6 is Leu or Phe
  Variant (8)..(8): Xaa in position 8 is Ala, Gly or Asp
  Variant (9)..(9): Xaa in position 9 is any amino acid
  Variant (10)..(10): Xaa in position 10 is Gln or His
  Variant (11)..(16): Xaa in position 11 to 16 is any amino acid
  Variant (17)..(18): Xaa in position 17 to 18 is any or no amino acid
  Variant (21)..(21): Xaa in position 21 is Gln, Arg or Glu
  Variant (22)..(22): Xaa in position 22 is Gly or Ala
  Variant (23)..(23): Xaa in position 23 is any or no amino acid
  Variant (25)..(25): Xaa in position 25 is Asp or His
  Variant (26)..(26): Xaa in position 26 is Ala or Ser
  Variant (27)..(27): Xaa in position 27 is Val or Ile
  Variant (28)..(28): Xaa in position 28 is Arg or Thr
  Variant (29)..(29): Xaa in position 29 is any amino acid
  Variant (30)..(30): Xaa in position 30 is Phe, Tyr or Cys
  Variant (31)..(31): Xaa in position 31 is any amino acid
  Variant (33)..(33): Xaa in position 33 is Leu, Ile, Val or Ala
  Variant (34)..(34): Xaa in position 34 is any or no amino acid
  Variant (35)..(35): Xaa in position 35 is Phe or Leu
  Variant (36)..(36): Xaa in position 36 is Glu or Asp
  Variant (37)..(37): Xaa in position 37 is Asp, Glu or Asn
  Variant (38)..(39): Xaa in position 38 to 39 is any amino acid
  Variant (40)..(43): Xaa in position 40 to 43 is any or no amino acid
  Variant (44)..(44): Xaa in position 44 is Val or Ile
  Variant (45)..(47): Xaa in position 45 to 47 is any amino acid
  Variant (48)..(48): Xaa in position 48 is Leu, Ile, Val or Ala
  Variant (49)..(49): Xaa in position 49 is Ile or Val
  Variant (51)..(51): Xaa in position 51 is Ala, Ser or Cys
  Variant (53)..(60): Xaa in position 53 to 60 is any or no amino acid
  Variant (62)..(62): Xaa in position 62 is any amino acid
  Variant (63)..(63): Xaa in position 63 is Leu or Met
  Variant (65)..(65): Xaa in position 65 is Arg or Gln
  Variant (67)..(67): Xaa in position 67 is any amino acid

SEQ ID NO: 108344 - protein, 31 aa, Artificial sequence; identical to SEQ ID NO: 15679
  protein pattern
  Variant (1)..(1): Xaa in position 1 is Arg, Glu or Leu
  Variant (2)..(2): Xaa in position 2 is Ala, Ser or Pro
  Variant (3)..(3): Xaa in position 3 is Ser or Thr
  Variant (4)..(4): Xaa in position 4 is any amino acid
  Variant (5)..(5): Xaa in position 5 is Phe, Tyr or Asn
  Variant (8)..(8): Xaa in position 8 is Met, Val or Leu
  Variant (9)..(9): Xaa in position 9 is Lys or Asn
  Variant (10)..(10): Xaa in position 10 is any amino acid
  Variant (12)..(13): Xaa in position 12 to 13 is any amino acid
  Variant (15)..(15): Xaa in position 15 is Arg, Lys, Ala or Asn
  Variant (16)..(16): Xaa in position 16 is Ile or Val
  Variant (17)..(18): Xaa in position 17 to 18 is any amino acid
  Variant (20)..(20): Xaa in position 20 is Ala, Ser, Leu, Phe or Cys
  Variant (22)..(22): Xaa in position 22 is Lys or Asn
  Variant (23)..(23): Xaa in position 23 is Pro or Gln
  Variant (24)..(27): Xaa in position 24 to 27 is any amino acid
  Variant (28)..(28): Xaa in position 28 is Leu, Met, His or Arg
  Variant (29)..(30): Xaa in position 29 to 30 is any amino acid

SEQ ID NO: 108345 - protein, 68 aa, Artificial sequence; identical to SEQ ID NO: 15680
  protein pattern
  Variant (4)..(4): Xaa in position 4 is Ser or Asn
  Variant (6)..(6): Xaa in position 6 is Ile or Val
  Variant (7)..(7): Xaa in position 7 is Ile or Leu
  Variant (9)..(9): Xaa in position 9 is any amino acid
  Variant (10)..(10): Xaa in position 10 is Ala or Ser
  Variant (11)..(20): Xaa in position 11 to 20 is any amino acid
  Variant (21)..(21): Xaa in position 21 is any or no amino acid
  Variant (22)..(22): Xaa in position 22 is Phe or Tyr
  Variant (23)..(24): Xaa in position 23 to 24 is any amino acid
  Variant (29)..(29): Xaa in position 29 is Ile or Val
  Variant (31)..(31): Xaa in position 31 is Thr or Ser
  Variant (32)..(32): Xaa in position 32 is Ile or Val
  Variant (33)..(33): Xaa in position 33 is any amino acid
  Variant (34)..(34): Xaa in position 34 is Ser, Ala or Thr
  Variant (36)..(36): Xaa in position 36 is Tyr, Phe or Cys
  Variant (37)..(37): Xaa in position 37 is any amino acid
  Variant (38)..(38): Xaa in position 38 is Ala or Ser
  Variant (39)..(39): Xaa in position 39 is Asn or Ser
  Variant (40)..(40): Xaa in position 40 is Leu, Ile or Met
  Variant (41)..(41): Xaa in position 41 is Ala, Gly or Ser
  Variant (42)..(42): Xaa in position 42 is Leu or Ile
  Variant (43)..(48): Xaa in position 43 to 48 is any amino acid
  Variant (49)..(49): Xaa in position 49 is any or no amino acid
  Variant (51)..(51): Xaa in position 51 is any amino acid
  Variant (52)..(52): Xaa in position 52 is Phe or Leu
  Variant (53)..(53): Xaa in position 53 is Tyr or Asn
  Variant (54)..(54): Xaa in position 54 is Asp or Gly
  Variant (55)..(57): Xaa in position 55 to 57 is any amino acid
  Variant (58)..(58): Xaa in position 58 is Pro or Ala
  Variant (59)..(59): Xaa in position 59 is any amino acid
  Variant (60)..(60): Xaa in position 60 is Tyr, Phe or Asn
  Variant (62)..(63): Xaa in position 62 to 63 is any amino acid
  Variant (64)..(64): Xaa in position 64 is Arg or Gly
  Variant (65)..(65): Xaa in position 65 is any amino acid
  Variant (66)..(66): Xaa in position 66 is Leu or Cys

SEQ ID NO: 108346 - DNA, 901 bp, Hordeum vulgare
  CDS (108)..(572)
ccaacctccgtccgtgctctgctccccgtgcggaaggcggctggccggcggcagctacggcggcgcgcgaccggacgacgtacacgcagatctgctaaaggagcaacatggcaacacttaaagatgtggcaacacggaaacctattctagcaacaatccgcctcctggttcctgctggagcagcccgcccggcaccacctgtcggaccagctctgggtttctacaggctcaatctgatggcattctgcaaggatttcaacgccaggacgcagaagtacaaggcagagactccgatgcaagtcacgctgaccgcctacaaggacagcaccttcgagtttgtggtcaagtcgccatcggtctcatggttcctcaagaaagcggcgggcatcgagagcgcgagcagccgtccgggccacaacatggtgacgtccctctcgctccgccatgtctatgagatcgcaaagctgaagcagtccgacccgttctgcaagcacatgtccctcgaggccctgtgcaagtccatcatcggcacggccaagtccatgggcattgaaatcgtgaaggatctctgaccggtctggctggactagctctcaggcatatttttttatcttgtgttcatctacagccagtctagtttcgtctgatttgaaagaaaggtagggatgggatttatctgtcgaaatctggcggcgcccgtcttggtgatcagtttgtatcatgtgacagttttcttcagtgtaaccatttggtggtggtcgggtagtaagtttctgcctccctctactactccccctgttccaaaataaatgtcatggttttagttcaaatttgaagtattttgcactgaacttgttgaaatggcaacttgagcgccttccatgccaaaaaaaaaaaaaaa

SEQ ID NO: 108347 - protein, 154 aa, Hordeum vulgare
MATLKDVATRKPILATIRLLVPAGAARPAPPVGPALGFYRLNLMAFCKDFNARTQKYKAETPMQVTLTAYKDSTFEFVVKSPSVSWFLKKAAGIESASSRPGHNMVTSLSLRHVYEIAKLKQSDPFCKHMSLEALCKSIIGTAKSMGIEIVKDL

SEQ ID NO: 108348 - DNA, 22 bp, Artificial sequence
  primer
atggcaacacttaaagatgtgg

SEQ ID NO: 108349 - DNA, 21 bp, Artificial sequence
  primer
tcagagatccttcacgatttc

SEQ ID NO: 108350 - protein, 167 aa, Artificial sequence; identical to SEQ ID NO: 38093
  consensus sequence
  Variant (2)..(4): Xaa in position 2 to 4 is any amino acid
  Variant (8)..(8): Xaa in position 8 is any amino acid
  Variant (10)..(10): Xaa in position 10 is any amino acid
  Variant (13)..(13): Xaa in position 13 is any amino acid
  Variant (15)..(15): Xaa in position 15 is any amino acid
  Variant (17)..(17): Xaa in position 17 is any or no amino acid
  Variant (18)..(19): Xaa in position 18 to 19 is Pro or no amino acid
  Variant (20)..(20): Xaa in position 20 is Val or no amino acid
  Variant (26)..(27): Xaa in position 26 to 27 is any amino acid
  Variant (32)..(33): Xaa in position 32 to 33 is any amino acid
  Variant (35)..(35): Xaa in position 35 is any amino acid
  Variant (37)..(37): Xaa in position 37 is any amino acid
  Variant (40)..(41): Xaa in position 40 to 41 is any amino acid
  Variant (43)..(46): Xaa in position 43 to 46 is any amino acid
  Variant (47)..(51): Xaa in position 47 to 51 is any or no amino acid
  Variant (53)..(54): Xaa in position 53 to 54 is any amino acid
  Variant (58)..(58): Xaa in position 58 is any amino acid
  Variant (61)..(63): Xaa in position 61 to 63 is any amino acid
  Variant (65)..(66): Xaa in position 65 to 66 is any or no amino acid
  Variant (70)..(70): Xaa in position 70 is any amino acid
  Variant (72)..(73): Xaa in position 72 to 73 is any amino acid
  Variant (75)..(75): Xaa in position 75 is any amino acid
  Variant (78)..(80): Xaa in position 78 to 80 is any amino acid
  Variant (83)..(83): Xaa in position 83 is any amino acid
  Variant (85)..(87): Xaa in position 85 to 87 is any amino acid
  Variant (89)..(90): Xaa in position 89 to 90 is any amino acid
  Variant (91)..(98): Xaa in position 91 to 98 is any or no amino acid
  Variant (101)..(102): Xaa in position 101 to 102 is any amino acid
  Variant (104)..(107): Xaa in position 104 to 107 is any amino acid
  Variant (108)..(120): Xaa in position 108 to 120 is any or no amino acid
  Variant (123)..(123): Xaa in position 123 is any amino acid
  Variant (126)..(128): Xaa in position 126 to 128 is any amino acid
  Variant (130)..(131): Xaa in position 130 to 131 is any amino acid
  Variant (134)..(135): Xaa in position 134 to 135 is any amino acid
  Variant (137)..(138): Xaa in position 137 to 138 is any amino acid
  Variant (140)..(143): Xaa in position 140 to 143 is any or no amino acid
  Variant (145)..(148): Xaa in position 145 to 148 is any amino acid
  Variant (150)..(153): Xaa in position 150 to 153 is any amino acid
  Variant (155)..(155): Xaa in position 155 is any amino acid
  Variant (157)..(157): Xaa in position 157 is any amino acid
  Variant (166)..(166): Xaa in position 166 is any amino acid

SEQ ID NO: 108351 - protein, 38 aa, Artificial sequence; identical to SEQ ID NO: 38094
  protein pattern
  Variant (1)..(1): Xaa in position 1 is Ile, Leu, Val, Met, Ala or Phe
  Variant (2)..(2): Xaa in position 2 is Lys, Arg, Glu or Asn
  Variant (3)..(3): Xaa in position 3 is Leu, Ile, Val, Phe, Ala or Thr
  Variant (4)..(4): Xaa in position 4 is any amino acid
  Variant (5)..(5): Xaa in position 5 is Val, Ile, Leu, Phe or Cys
  Variant (6)..(6): Xaa in position 6 is any amino acid
  Variant (7)..(7): Xaa in position 7 is Ala, Gly or Ser
  Variant (8)..(8): Xaa in position 8 is Gly, Ala, Asn, Gln or Thr
  Variant (9)..(9): Xaa in position 9 is any amino acid
  Variant (11)..(11): Xaa in position 11 is any amino acid
  Variant (12)..(12): Xaa in position 12 is Pro, Thr, Ala or Ser
  Variant (13)..(13): Xaa in position 13 is Ala, Ser, Gly, Thr or no amino acid
  Variant (14)..(14): Xaa in position 14 is Pro or no amino acid
  Variant (15)..(15): Xaa in position 15 is Pro, Lys or no amino acid
  Variant (16)..(16): Xaa in position 16 is Val, Ile, Leu or no amino acid
  Variant (17)..(17): Xaa in position 17 is Gly or Ala
  Variant (18)..(18): Xaa in position 18 is Pro, Ser, Gln or Thr
  Variant (19)..(19): Xaa in position 19 is any amino acid
  Variant (20)..(20): Xaa in position 20 is Leu, Ile or Phe
  Variant (21)..(21): Xaa in position 21 is Gly, Ala or Ser
  Variant (22)..(23): Xaa in position 22 to 23 is any amino acid
  Variant (24)..(24): Xaa in position 24 is Gly, Pro, Gln, Lys, Arg or Asn
  Variant (25)..(25): Xaa in position 25 is Val, Ile, Leu or Ala
  Variant (26)..(26): Xaa in position 26 is Asn, Lys, Pro, Ser or Asp
  Variant (27)..(27): Xaa in position 27 is Ile, Val, Leu, Met, Ala or Ser
  Variant (28)..(29): Xaa in position 28 to 29 is any amino acid
  Variant (30)..(30): Xaa in position 30 is Phe or Val
  Variant (31)..(31): Xaa in position 31 is Cys, Val, Thr, Phe or Ile
  Variant (32)..(33): Xaa in position 32 to 33 is any amino acid
  Variant (34)..(34): Xaa in position 34 is Phe, Tyr or Ile
  Variant (36)..(37): Xaa in position 36 to 37 is any amino acid
  Variant (38)..(38): Xaa in position 38 is Thr or Ser

SEQ ID NO: 108352 - protein, 39 aa, Artificial sequence; identical to SEQ ID NO: 38095
  protein pattern
  Variant (1)..(1): Xaa in position 1 is Ile, Val, Leu, Thr, Met or Cys
  Variant (2)..(2): Xaa in position 2 is Pro, Thr, Gln or Ala
  Variant (3)..(3): Xaa in position 3 is Val, Thr, Cys or Ala
  Variant (4)..(4): Xaa in position 4 is any amino acid
  Variant (5)..(5): Xaa in position 5 is Ile, Val or Leu
  Variant (6)..(9): Xaa in position 6 to 9 is any amino acid
  Variant (10)..(10): Xaa in position 10 is Asp, Glu, Pro, Lys or Asn
  Variant (11)..(11): Xaa in position 11 is Glu, Ser, Ala or no amino acid
  Variant (12)..(12): Xaa in position 12 is Thr or no amino acid
  Variant (13)..(13): Xaa in position 13 is Arg, Lys, Asn or Ser
  Variant (14)..(14): Xaa in position 14 is Ser, Thr, Ala, Asn or Lys
  Variant (15)..(15): Xaa in position 15 is Phe, Tyr, Val or Ile
  Variant (16)..(16): Xaa in position 16 is any amino acid
  Variant (17)..(17): Xaa in position 17 is Phe, Ile, Leu, Met, Tyr or Val
  Variant (18)..(18): Xaa in position 18 is any amino acid
  Variant (19)..(19): Xaa in position 19 is Thr, Leu, Val, Met, Ile or Ser
  Variant (20)..(21): Xaa in position 20 to 21 is any amino acid
  Variant (22)..(22): Xaa in position 22 is Pro, Thr or Ser
  Variant (23)..(23): Xaa in position 23 is Pro, Thr, Ser, Gln or Lys
  Variant (24)..(24): Xaa in position 24 is Ala, Thr, Val, Met, Ile, Leu or Ser
  Variant (25)..(27): Xaa in position 25 to 27 is any amino acid
  Variant (28)..(28): Xaa in position 28 is Leu, Ile or Val
  Variant (29)..(33): Xaa in position 29 to 33 is any amino acid
  Variant (34)..(34): Xaa in position 34 is Ile, Leu, Val, Ala or Phe
  Variant (35)..(36): Xaa in position 35 to 36 is any amino acid
  Variant (37)..(37): Xaa in position 37 is any or no amino acid
  Variant (38)..(38): Xaa in position 38 is Gly or Ala
  Variant (39)..(39): Xaa in position 39 is Ser, Ala, Thr or His

SEQ ID NO: 108353 - protein, 46 aa, Artificial sequence; identical to SEQ ID NO: 38096
  protein pattern
  Variant (1)..(1): Xaa in position 1 is Gly, Ala, Ser or Thr
  Variant (2)..(2): Xaa in position 2 is any amino acid
  Variant (3)..(3): Xaa in position 3 is Ile, Val, Leu, Ala or Met
  Variant (4)..(7): Xaa in position 4 to 7 is any amino acid
  Variant (8)..(8): Xaa in position 8 is Val, Leu, Ile, Ala or Cys
  Variant (9)..(10): Xaa in position 9 to 10 is any amino acid
  Variant (11)..(11): Xaa in position 11 is Ile, Val or Leu
  Variant (12)..(12): Xaa in position 12 is Ala or Val
  Variant (13)..(14): Xaa in position 13 to 14 is any amino acid
  Variant (16)..(17): Xaa in position 16 to 17 is any amino acid
  Variant (18)..(18): Xaa in position 18 is Asp, Gln, Ala or Ser
  Variant (19)..(22): Xaa in position 19 to 22 is any or no amino acid
  Variant (23)..(23): Xaa in position 23 is Leu, Met, Val, Ile, His or Cys
  Variant (24)..(27): Xaa in position 24 to 27 is any amino acid
  Variant (28)..(28): Xaa in position 28 is Leu, Ile, Val, Met or Glu
  Variant (29)..(34): Xaa in position 29 to 34 is any amino acid
  Variant (35)..(35): Xaa in position 35 is Ile, Val, Leu or Met
  Variant (36)..(36): Xaa in position 36 is any amino acid
  Variant (37)..(37): Xaa in position 37 is Gly or Ala
  Variant (38)..(38): Xaa in position 38 is Thr, Ser, Gln or Val
  Variant (39)..(39): Xaa in position 39 is Ala, Cys, Leu or Val
  Variant (40)..(40): Xaa in position 40 is any amino acid
  Variant (41)..(41): Xaa in position 41 is Ser, Asn, Ala, Pro, Gln, Thr or Arg
  Variant (42)..(42): Xaa in position 42 is Met, Ile, Leu, Val or Cys
  Variant (44)..(44): Xaa in position 44 is Ile, Leu, Val, Phe or Tyr
  Variant (45)..(45): Xaa in position 45 is any amino acid
  Variant (46)..(46): Xaa in position 46 is Val, Ile or Thr

SEQ ID NO: 108354 - DNA, 1029 bp, Glycine max
  CDS (1)..(1029)
atggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgtcagcaaggctggtcttgctaaacttattggactcgctggagaaaccaatgttcagggtgaagaacagaagaaactggatgttctttccaatgaggttttcatcaaggctctcataagcagtggccgaacatgcatcttggtttctgaagaagatgaagaagcgataattgtggagccttctaagcgcggaaagtactgtgtttgctttgacccattggatggctcgtccaacattgattgtggggtttccattggcacaatctttggggtttatgtgttgaaagatgtccatgaaccaaccatagaagatgtcctgctacctgggaagaacatggtggcagctggttactgtatgtatggaagctcttgcacgcttgtgttaagcactggagcaggtgttaatggtttcacccttgacccatctcttggtgagttcatcctaactcaccctaacattaagatcccaaagaaaggtaaaatttattcagtgaatgaaggaaatgccaaaaactgggatcgtcctactgctacttacgttgaaaaatgcaagtttcctgaagatggttcatcaccaaagtctctaagatatattggaagcatggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaaggaacgggcacttgatttagttccaacgaagttgcacgagcgatctcccatattccttggtagctatgatgatgttgaggaaatcaaagctctttatgctgctgctgagggtgaacaagaatga

SEQ ID NO: 108355 - protein, 342 aa, Glycine max
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGKYCVCFDPLDGSSNIDCGVSIGTIFGVYVLKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 108356 - DNA, 20 bp, Artificial sequence
  primer
atggaccacagcgctgatgc

SEQ ID NO: 108357 - DNA, 21 bp, Artificial sequence
  primer
tcattcttgttcaccctcagc

SEQ ID NO: 108358 - protein, 334 aa, Artificial sequence; identical to SEQ ID NO: 40195
  consensus sequence
  Variant (2)..(13): Xaa in position 2 to 13 is any amino acid
  Variant (14)..(23): Xaa in position 14 to 23 is any or no amino acid
  Variant (25)..(26): Xaa in position 25 to 26 is any amino acid
  Variant (28)..(29): Xaa in position 28 to 29 is any amino acid
  Variant (31)..(31): Xaa in position 31 is any amino acid
  Variant (32)..(38): Xaa in position 32 to 38 is any or no amino acid
  Variant (40)..(43): Xaa in position 40 to 43 is any amino acid
  Variant (47)..(67): Xaa in position 47 to 67 is any amino acid
  Variant (71)..(78): Xaa in position 71 to 78 is any amino acid
  Variant (79)..(90): Xaa in position 79 to 90 is any or no amino acid
  Variant (92)..(92): Xaa in position 92 is any amino acid
  Variant (94)..(97): Xaa in position 94 to 97 is any amino acid
  Variant (106)..(106): Xaa in position 106 is any amino acid
  Variant (108)..(112): Xaa in position 108 to 112 is any amino acid
  Variant (114)..(114): Xaa in position 114 is any amino acid
  Variant (117)..(124): Xaa in position 117 to 124 is any amino acid
  Variant (125)..(152): Xaa in position 125 to 152 is any or no amino acid
  Variant (154)..(157): Xaa in position 154 to 157 is any amino acid
  Variant (162)..(163): Xaa in position 162 to 163 is any amino acid
  Variant (166)..(170): Xaa in position 166 to 170 is any amino acid
  Variant (172)..(174): Xaa in position 172 to 174 is any amino acid
  Variant (176)..(176): Xaa in position 176 is any amino acid
  Variant (178)..(178): Xaa in position 178 is any or no amino acid
  Variant (180)..(181): Xaa in position 180 to 181 is any amino acid
  Variant (183)..(183): Xaa in position 183 is any amino acid
  Variant (186)..(186): Xaa in position 186 is any amino acid
  Variant (187)..(192): Xaa in position 187 to 192 is any or no amino acid
  Variant (194)..(194): Xaa in position 194 is any amino acid
  Variant (196)..(196): Xaa in position 196 is any amino acid
  Variant (198)..(210): Xaa in position 198 to 210 is any amino acid
  Variant (211)..(214): Xaa in position 211 to 214 is any or no amino acid
  Variant (216)..(239): Xaa in position 216 to 239 is any amino acid
  Variant (240)..(247): Xaa in position 240 to 247 is any or no amino acid
  Variant (249)..(251): Xaa in position 249 to 251 is any amino acid
  Variant (253)..(253): Xaa in position 253 is any amino acid
  Variant (255)..(255): Xaa in position 255 is any amino acid
  Variant (257)..(257): Xaa in position 257 is any amino acid
  Variant (260)..(260): Xaa in position 260 is any amino acid
  Variant (262)..(263): Xaa in position 262 to 263 is any amino acid
  Variant (265)..(265): Xaa in position 265 is any or no amino acid
  Variant (267)..(269): Xaa in position 267 to 269 is any amino acid
  Variant (272)..(272): Xaa in position 272 is any amino acid
  Variant (273)..(281): Xaa in position 273 to 281 is any or no amino acid
  Variant (286)..(287): Xaa in position 286 to 287 is any amino acid
  Variant (290)..(291): Xaa in position 290 to 291 is any amino acid
  Variant (293)..(297): Xaa in position 293 to 297 is any amino acid
  Variant (303)..(306): Xaa in position 303 to 306 is any amino acid
  Variant (308)..(311): Xaa in position 308 to 311 is any amino acid
  Variant (312)..(312): Xaa in position 312 is any or no amino acid
  Variant (314)..(316): Xaa in position 314 to 316 is any amino acid
  Variant (318)..(320): Xaa in position 318 to 320 is any amino acid
  Variant (322)..(322): Xaa in position 322 is any amino acid
  Variant (324)..(328): Xaa in position 324 to 328 is any amino acid
  Variant (331)..(333): Xaa in position 331 to 333 is any amino acid

SEQ ID NO: 108359 - protein, 80 aa, Artificial sequence; identical to SEQ ID NO: 40196
  protein pattern
  Variant (1)..(1): Xaa in position 1 is Gly or Arg
  Variant (2)..(2): Xaa in position 2 is Glu or Asp
  Variant (3)..(3): Xaa in position 3 is any amino acid
  Variant (4)..(4): Xaa in position 4 is Gln, Val or Pro
  Variant (5)..(5): Xaa in position 5 is Lys, Gln, Met, Leu, Ala or Arg
  Variant (6)..(6): Xaa in position 6 is any amino acid
  Variant (7)..(7): Xaa in position 7 is Leu, Met, Ala or Ile
  Variant (9)..(9): Xaa in position 9 is Val, Leu, Ile or Glu
  Variant (10)..(10): Xaa in position 10 is any amino acid
  Variant (11)..(11): Xaa in position 11 is Ser, Ala, Gly, Thr or Cys
  Variant (12)..(12): Xaa in position 12 is Asn, Asp or His
  Variant (13)..(14): Xaa in position 13 to 14 is any amino acid
  Variant (15)..(15): Xaa in position 15 is Phe, Leu, Val, Ile or Met
  Variant (16)..(26): Xaa in position 16 to 26 is any amino acid
  Variant (27)..(27): Xaa in position 27 is any or no amino acid
  Variant (28)..(28): Xaa in position 28 is Leu, Ile, Met, Val, Phe, Ala or Tyr
  Variant (29)..(29): Xaa in position 29 is Ala, Val, Ser, Gly or Cys
  Variant (30)..(30): Xaa in position 30 is Ser, Glu or Thr
  Variant (32)..(32): Xaa in position 32 is Glu or Met
  Variant (33)..(33): Xaa in position 33 is any amino acid
  Variant (34)..(34): Xaa in position 34 is Asp, Glu, Ala or Lys
  Variant (35)..(41): Xaa in position 35 to 41 is any amino acid
  Variant (42)..(52): Xaa in position 42 to 52 is any or no amino acid
  Variant (53)..(53): Xaa in position 53 is Gly or Ala
  Variant (54)..(54): Xaa in position 54 is any amino acid
  Variant (55)..(55): Xaa in position 55 is Tyr, Leu, Phe, Ile or Val
  Variant (56)..(56): Xaa in position 56 is any amino acid
  Variant (57)..(57): Xaa in position 57 is Val, Leu or Ile
  Variant (58)..(59): Xaa in position 58 to 59 is any amino acid
  Variant (62)..(62): Xaa in position 62 is Leu or Ile
  Variant (65)..(65): Xaa in position 65 is Ser or Cys
  Variant (66)..(66): Xaa in position 66 is Ser, Ala or Arg
  Variant (67)..(67): Xaa in position 67 is Asn or Leu
  Variant (68)..(68): Xaa in position 68 is Ile, Leu, Val, Thr or Met
  Variant (69)..(69): Xaa in position 69 is Asp, Glu or Asn
  Variant (70)..(70): Xaa in position 70 is any amino acid
  Variant (71)..(71): Xaa in position 71 is Asn, Gly, Leu, Ala, Asp or Ser
  Variant (72)..(73): Xaa in position 72 to 73 is any amino acid
  Variant (74)..(74): Xaa in position 74 is Val, Ile, Thr or Leu
  Variant (76)..(76): Xaa in position 76 is Thr or Ser
  Variant (77)..(77): Xaa in position 77 is Ile or Val
  Variant (78)..(78): Xaa in position 78 is Phe, Val or Trp
  Variant (79)..(79): Xaa in position 79 is Ser, Gly or Ala
  Variant (80)..(80): Xaa in position 80 is Ile, Val or Leu

SEQ ID NO: 108360 - protein, 78 aa, Artificial sequence; identical to SEQ ID NO: 40197
  protein pattern
  Variant (1)..(1): Xaa in position 1 is Gly or Ala
  Variant (2)..(3): Xaa in position 2 to 3 is any amino acid
  Variant (4)..(4): Xaa in position 4 is Gln, Met, Leu or Ile
  Variant (5)..(5): Xaa in position 5 is Val, Leu, Ile, Thr or Arg
  Variant (6)..(6): Xaa in position 6 is Ala, Cys or Ser
  Variant (7)..(7): Xaa in position 7 is Ala, Ser or Gly
  Variant (8)..(8): Xaa in position 8 is Gly, Cys or Leu
  Variant (9)..(9): Xaa in position 9 is Tyr or Phe
  Variant (10)..(10): Xaa in position 10 is any amino acid
  Variant (11)..(11): Xaa in position 11 is Leu, Met, Val, Ile, Ser or Thr
  Variant (13)..(13): Xaa in position 13 is Gly or Ser
  Variant (14)..(14): Xaa in position 14 is Ser, Pro, Ala or Thr
  Variant (15)..(15): Xaa in position 15 is any amino acid
  Variant (16)..(16): Xaa in position 16 is Thr, Cys, Val, Ala, Ile or Leu
  Variant (17)..(17): Xaa in position 17 is any amino acid
  Variant (18)..(18): Xaa in position 18 is Leu, Phe, Met, Val or Ile
  Variant (19)..(19): Xaa in position 19 is Val, Leu, Met, Ala or Ile
  Variant (20)..(20): Xaa in position 20 is Leu, Tyr, Ile, Val, Phe, Met or Cys
  Variant (21)..(21): Xaa in position 21 is Thr, Ser, Ala or Cys
  Variant (22)..(22): Xaa in position 22 is any amino acid
  Variant (23)..(23): Xaa in position 23 is Gly, Ala, Asp, Glu, Lys or Arg
  Variant (24)..(24): Xaa in position 24 is any amino acid
  Variant (25)..(25): Xaa in position 25 is Gly, Ala or Pro
  Variant (26)..(26): Xaa in position 26 is any or no amino acid
  Variant (27)..(27): Xaa in position 27 is Val, Leu or Thr
  Variant (28)..(29): Xaa in position 28 to 29 is any amino acid
  Variant (30)..(30): Xaa in position 30 is Phe, Tyr, Leu or Trp
  Variant (31)..(32): Xaa in position 31 to 32 is any amino acid
  Variant (33)..(33): Xaa in position 33 is Asp, Glu, Asn, Ser or His
  Variant (34)..(34): Xaa in position 34 is any amino acid
  Variant (35)..(40): Xaa in position 35 to 40 is any or no amino acid
  Variant (41)..(41): Xaa in position 41 is Gly, Ala, Asn, Gln, Lys, Arg or Met
  Variant (42)..(42): Xaa in position 42 is any amino acid
  Variant (43)..(43): Xaa in position 43 is Phe, Tyr or Trp
  Variant (44)..(44): Xaa in position 44 is any amino acid
  Variant (45)..(45): Xaa in position 45 is Leu, Ile or Val
  Variant (46)..(49): Xaa in position 46 to 49 is any amino acid
  Variant (50)..(50): Xaa in position 50 is Ile, Leu, Met or Val
  Variant (51)..(51): Xaa in position 51 is any amino acid
  Variant (52)..(52): Xaa in position 52 is Ile, Leu, Met, Val, Phe or Tyr
  Variant (53)..(55): Xaa in position 53 to 55 is any amino acid
  Variant (56)..(59): Xaa in position 56 to 59 is any or no amino acid
  Variant (60)..(60): Xaa in position 60 is Tyr, Phe or Ile
  Variant (61)..(61): Xaa in position 61 is Ser, Ala or Asn
  Variant (62)..(62): Xaa in position 62 is any amino acid
  Variant (63)..(63): Xaa in position 63 is Asn or Gly
  Variant (64)..(64): Xaa in position 64 is any amino acid
  Variant (65)..(65): Xaa in position 65 is Gly, Ser or Ala
  Variant (66)..(69): Xaa in position 66 to 69 is any amino acid
  Variant (70)..(70): Xaa in position 70 is Trp, Phe or Tyr
  Variant (71)..(76): Xaa in position 71 to 76 is any amino acid
  Variant (77)..(77): Xaa in position 77 is Tyr or Phe
  Variant (78)..(78): Xaa in position 78 is Ile, Val, Leu, Phe, Met or Thr

SEQ ID NO: 108361 - protein, 90 aa, Artificial sequence; identical to SEQ ID NO: 40198
  protein pattern
  Variant (1)..(1): Xaa in position 1 is Tyr, Phe, Lys or Leu
  Variant (2)..(2): Xaa in position 2 is any amino acid
  Variant (3)..(3): Xaa in position 3 is Ala, Met, Leu, Ser, Thr or Gly
  Variant (5)..(5): Xaa in position 5 is Tyr or Trp
  Variant (6)..(6): Xaa in position 6 is Ile, Val, Ser, Gly, Thr, Asn or Leu
  Variant (7)..(7): Xaa in position 7 is Gly, Ala or Cys
  Variant (8)..(8): Xaa in position 8 is Ser, Ala or Gly
  Variant (9)..(9): Xaa in position 9 is Met, Leu or Phe
  Variant (11)..(11): Xaa in position 11 is Ala, Gly, Ser or Pro
  Variant (12)..(12): Xaa in position 12 is Asp or Glu
  Variant (13)..(13): Xaa in position 13 is Val, Phe, Ile, Ala, Thr, Met or Leu
  Variant (14)..(14): Xaa in position 14 is His, Tyr or Asn
  Variant (15)..(15): Xaa in position 15 is Arg or Gln
  Variant (16)..(16): Xaa in position 16 is Thr, Ile, Asn or Val
  Variant (17)..(17): Xaa in position 17 is Leu, Ile, Met or Phe
  Variant (18)..(18): Xaa in position 18 is any amino acid
  Variant (19)..(19): Xaa in position 19 is Tyr, Arg, Lys, Gln or Thr
  Variant (21)..(21): Xaa in position 21 is Lys, Gly or no amino acid
  Variant (23)..(23): Xaa in position 23 is Ile, Val, Leu or Met
  Variant (24)..(24): Xaa in position 24 is Phe, Tyr or Ala
  Variant (25)..(25): Xaa in position 25 is any amino acid
  Variant (26)..(26): Xaa in position 26 is Tyr or Asn
  Variant (28)..(28): Xaa in position 28 is any amino acid
  Variant (29)..(37): Xaa in position 29 to 37 is any or no amino acid
  Variant (38)..(38): Xaa in position 38 is Gly, Asp or Leu
  Variant (39)..(39): Xaa in position 39 is Lys, Arg or His
  Variant (42)..(42): Xaa in position 42 is any amino acid
  Variant (43)..(43): Xaa in position 43 is Leu, Met, Val or Gln
  Variant (44)..(44): Xaa in position 44 is Tyr, Phe or Cys
  Variant (46)..(46): Xaa in position 46 is Ala, Cys, Val, Gly, Thr, Ser or Leu
  Variant (47)..(47): Xaa in position 47 is any amino acid
  Variant (49)..(49): Xaa in position 49 is Met, Ile, Leu, Val or Phe
  Variant (50)..(50): Xaa in position 50 is Ala, Ser or Gly
  Variant (51)..(51): Xaa in position 51 is Phe, Tyr, Met, Leu or Trp
  Variant (52)..(52): Xaa in position 52 is Leu, Ile or Val
  Variant (53)..(53): Xaa in position 53 is any amino acid
  Variant (54)..(54): Xaa in position 54 is Glu, Thr or Gln
  Variant (55)..(55): Xaa in position 55 is any amino acid
  Variant (56)..(56): Xaa in position 56 is Ala or Val
  Variant (57)..(57): Xaa in position 57 is Gly or Ser
  Variant (58)..(58): Xaa in position 58 is Gly or Ala
  Variant (59)..(59): Xaa in position 59 is any amino acid
  Variant (60)..(60): Xaa in position 60 is Ala, Ser, Gly or Cys
  Variant (61)..(61): Xaa in position 61 is Thr, Ser, Val, Phe or Ile
  Variant (62)..(62): Xaa in position 62 is Thr, Asp or Asn
  Variant (63)..(64): Xaa in position 63 to 64 is any amino acid
  Variant (65)..(65): Xaa in position 65 is Gly, Met or Asn
  Variant (66)..(67): Xaa in position 66 to 67 is any amino acid
  Variant (68)..(68): Xaa in position 68 is Ile, Val, Leu, Ala or Met
  Variant (69)..(69): Xaa in position 69 is Leu or Met
  Variant (70)..(70): Xaa in position 70 is Asp, Glu, Ser, Gly, Arg or Leu
  Variant (71)..(71): Xaa in position 71 is Ile, Leu, Val, Ala, Gln or Arg
  Variant (72)..(72): Xaa in position 72 is any amino acid
  Variant (73)..(73): Xaa in position 73 is Pro or Ala
  Variant (74)..(75): Xaa in position 74 to 75 is any amino acid
  Variant (76)..(76): Xaa in position 76 is Leu, Ile or Val
  Variant (77)..(77): Xaa in position 77 is His or Asp
  Variant (78)..(78): Xaa in position 78 is Gln, Glu, Asp, Ala or Gly
  Variant (79)..(79): Xaa in position 79 is Arg, Lys or Thr
  Variant (80)..(80): Xaa in position 80 is any amino acid
  Variant (81)..(81): Xaa in position 81 is Pro, Ser, Gly or Ala
  Variant (82)..(83): Xaa in position 82 to 83 is any amino acid
  Variant (84)..(84): Xaa in position 84 is Leu, Ile, Val, Phe or Met
  Variant (86)..(86): Xaa in position 86 is Ser, Thr, Asn, Cys or Gly
  Variant (87)..(89): Xaa in position 87 to 89 is any amino acid
  Variant (90)..(90): Xaa in position 90 is Val, Ile or Met

SEQ ID NO: 108362 - DNA, 1300 bp, Helianthus annuus
  CDS (51)..(1133)
cacaactacacacctacacttacacaactacgtacacagctacacgtacaatggcaacctcaccggaatccgagcatccgatcaaggcgtatggttatgcggcccgcgacacgtctggattactttcccctctcaccttctccagaagggctactggagagaaagatgtgaggttcaaagttctttactgcggaatctgtcattccgatcttcacgttgtcaaaaacgaatggggatttaccaagtacccgattactccagggcatgagattgttggtgtggtgacagaagtaggaagcaaagtggagaatttcaagattggagacaaagttggggttgggtgcttggtgggatcatgtagatcatgtcaaagttgtgcttctgactatgaacagtattgcgataagcaggtacaaacttatggtttcaccaactttgatggcacacagacgtacggtggatactccgatcacatggtttcagatgagcattttgtactccgttggccggagaacttaccacttgattctggtgcaccgttgctatgtgctgggatcacaacttacagccctctcaagtactttggattggacaagcctggtacgaaagtgggcgtggttgggctcggtgggctcggtcatgttgctgtgaagatggctaaggcatttggggctgaagttactgtttttagtacttcccctgctaaggagaaagaagcaattcagggacttaaagctgaccatttcgtaaacagtaaagatggacttcaaatgcaggctgctaagggcacactcgatggcatcatcgacacagtgtccgcaaatcatccaattgcgccattgcttaatgcacttacaccccatggaaagcttgttcttgttggtgcacctgagaagccacttgaagtagcagcattttcgttgatcatgggaaggaagcttgttgcgggtagtaacattggtggaattaaagagactcaggaaatgcttgactttgcagcaaagcatgggataactgcagatatagaggttataccgatagactatgtgaacacagcgatggaaaggctgttgaaatccgatgtgaggtaccgatttgtgatcgatgtggcgaactcgatcaaggctgaataggttgagtcttgaagttcttgctgaatgttgtatttctctttatagttttgagtatttgtgagcatgttatagagaagtgagagtcctgaggcttcttcgtttgtatgcatttgtttttggtattgttaataacttaatatatgtatcaaactaaaaaaaaaaaaaaa

SEQ ID NO: 108363 - protein, 360 aa, Helianthus annuus
MATSPESEHPIKAYGYAARDTSGLLSPLTFSRRATGEKDVRFKVLYCGICHSDLHVVKNEWGFTKYPITPGHEIVGVVTEVGSKVENFKIGDKVGVGCLVGSCRSCQSCASDYEQYCDKQVQTYGFTNFDGTQTYGGYSDHMVSDEHFVLRWPENLPLDSGAPLLCAGITTYSPLKYFGLDKPGTKVGVVGLGGLGHVAVKMAKAFGAEVTVFSTSPAKEKEAIQGLKADHFVNSKDGLQMQAAKGTLDGIIDTVSANHPIAPLLNALTPHGKLVLVGAPEKPLEVAAFSLIMGRKLVAGSNIGGIKETQEMLDFAAKHGITADIEVIPIDYVNTAMERLLKSDVRYRFVIDVANSIKAE

SEQ ID NO: 108364 - DNA, 1335 bp, Brassica napus
  CDS (30)..(1112)
cctcactcactcagacaaaagagaaacaaatggcgaaatctccagagacagagcatccgaacaaagcctttggttgggctgccaaagacaaatctggtgtactctctcctttccatttctccagaagagacaatggtgacaatgatgtgacagtgaaaatcttgtactgtggagtgtgccacactgatttacataccatcaaaaacgactggggtttctcctattatcctgtagttcccgggcatgaaatagttggaatagctacaaaagttggcaaaaacgtgactaaattcagagaaggagaccgtgttggagtaggagtgatcactggttcttgccagtcttgcgaatcttgtaaccaagatcttgaaaactactgtccccaaatgtctttcacctacaactccataggatccgatggaaccaagacctacggtggatattcggagtccattgtggtcgatcaacgttttgtcttacagtttcccgagggattgcctagcgattcgggtgcccccttgctgtgtgctggtatcactgtgtatagtccaatgaagtactatggtatgaccgagccagggaagcatttgggcgtggctggacttggtgggcttggtcatgttgctgtcaagattggtaaagcctttggtttgaaagttactgtgattagttcttctcctagtaaagaagacgaagctattaatcgacttggtgctgattcgtttcttgtctcatctgatcctcagaagatgaaggctgcaattggaactatggactatattatcgatacggtatcagcagtacatgctctgtttccattgcttggtttactcaaagtcaatggaaagcttgtcacgttaggcttacctgagaagcctcttgagctaccaatcttccctcttgttctcggaagaaaaatggtgggaggaagtgacattggagggatgaaggagacacaagagatgcttgagttctgcgctaagcataacataacggcagatattgagctgatcaagatggatgagattaacactgcgatggagaggcttgctaagtctgatgttaggtacaggttcgtgatcgacgtggctaactccttgagccctccatgacttagccgaacctaagagttggctctggaggagtttgtatctttgggctttttctgtgtttgtttctctcgcgttatctccgttttctactttcttgttagtgaactggtttcttgtggaacaagtcacctaaattatcagagaactttactctgtttttcttttcatgttttcgatattgagatataataagtctttctgattagagaaaaaaaaaaaaaaa

SEQ ID NO: 108365 - protein, 360 aa, Brassica napus
MAKSPETEHPNKAFGWAAKDKSGVLSPFHFSRRDNGDNDVTVKILYCGVCHTDLHTIKNDWGFSYYPVVPGHEIVGIATKVGKNVTKFREGDRVGVGVITGSCQSCESCNQDLENYCPQMSFTYNSIGSDGTKTYGGYSESIVVDQRFVLQFPEGLPSDSGAPLLCAGITVYSPMKYYGMTEPGKHLGVAGLGGLGHVAVKIGKAFGLKVTVISSSPSKEDEAINRLGADSFLVSSDPQKMKAAIGTMDYIIDTVSAVHALFPLLGLLKVNGKLVTLGLPEKPLELPIFPLVLGRKMVGGSDIGGMKETQEMLEFCAKHNITADIELIKMDEINTAMERLAKSDVRYRFVIDVANSLSPP

SEQ ID NO: 108366 - DNA, 1814 bp, Glycine max
  CDS (166)..(1449)
tgaatattaaggtagtaagatgagacgtcaagtttggatctctatctcattgttgatttagtattaaatttctatgtagttgttgtttgtagtaatcatcaactcactcagttgccgtaggttgtcgtgatccatcacaacactttgtcactgaaattcagaaaaatggcatcagcaatgtttcgtaggaacatcatcacccactactccaagtttgcttcttctttgtcttcgttgcctcgccattcctcaatctacaaccctctctctatgtctgtttcttcatttcatagcgaaagtgttggtggtggtggtgggttgccatcttccatgcgtggagctgtgtattgggaaccgaacaagccgctaaccatcgaggaatttcacatgcctcgccccaaggccggtgaagttctcatcaaaacaaaggcctgtggagtatgccactctgatctacatgttatgaaaggtgaaattccgtttaccagtccttgtgttgtggggcatgagattaccggtgaggttgttgaacatggagcactcactgacagcaaaaccatagaaaggcttccagttggatctcgagttgttggggccttcatcatgccttgtggcaactgctcctactgttcaaagggccatgatgatctatgtgaagctttctttgcctataaccgggcaaaaggaaccctctatgatggtgaaactcgactcttttttcgaaacagtggaaaaccagcatacatgtatagtatgggagggcttgctgaatactgtgttgtgccagcaaatggagtgtctgtgttaccagactcattgccatatacagagtctgcaattctaggatgtgctgtttttactgcttacggcgctatggctcatgcagctcaagtgcgtcctggtgattctgttgctgttattggaactggaggtgttggttctagttgtttacagatagctagagcctttggtgcctcagatataattgctgtggatgtacgggatgaaaagctacagaaagcaaagacatttggtgctactcacactgtaaattcagcaaaggaagatcccattgaaaagatacttgaaattactggtggaaagggtgttgatgttgctgtggaagccttggggaaaccacagacatttgctcaatgtacacaaagtgtgaaggatgggggaaaagctgtgatgattggactggcacaagctggttctttaggagaggtggatataaatcggcttgttcgcagaaagatacaagttattggctcctatgggggcagggcaaggcaagatcttccaaagttaattagactggcagaaacaggtatcttcaatcttggccatgctgtttcaagaacatacacttttgaggaggcgggaaaagcattccaagatctcaatgaaggaaaaattgtcggtcgagctgtgattgagataatatagctctatattcccagaaatgcttttctgcagcagcaatagctatgcttttcacaccccacaagatatacatgctttggagttgcaaggtgttggtaccctgagaacataaataaatagatgtcttctgatgtttcattgcaggggcatgttcaaatgaaaactgtttttctttttgtgcatttctttgcttctaactcatgtaatcaggtaggtacaccaaggtgaagaataatagtctctgaatgctcatcattggcgtgtcgtaaaactgatgatgaaaatgcaggaaaataacagaaaagctagagatgctccaagaaagtaaattaaaaaaaaaatgtttccgacataaaaaaaaaaaaaaa

SEQ ID NO: 108367 - protein, 427 aa, Glycine max
MASAMFRRNIITHYSKFASSLSSLPRHSSIYNPLSMSVSSFHSESVGGGGGLPSSMRGAVYWEPNKPLTIEEFHMPRPKAGEVLIKTKACGVCHSDLHVMKGEIPFTSPCVVGHEITGEVVEHGALTDSKTIERLPVGSRVVGAFIMPCGNCSYCSKGHDDLCEAFFAYNRAKGTLYDGETRLFFRNSGKPAYMYSMGGLAEYCVVPANGVSVLPDSLPYTESAILGCAVFTAYGAMAHAAQVRPGDSVAVIGTGGVGSSCLQIARAFGASDIIAVDVRDEKLQKAKTFGATHTVNSAKEDPIEKILEITGGKGVDVAVEALGKPQTFAQCTQSVKDGGKAVMIGLAQAGSLGEVDINRLVRRKIQVIGSYGGRARQDLPKLIRLAETGIFNLGHAVSRTYTFEEAGKAFQDLNEGKIVGRAVIEII

SEQ ID NO: 108368 - DNA, 1226 bp, Helianthus annuus
  CDS (25)..(1107)
cctctccaaaagcattaattatcaatggcgaaatcacctgaatccgagcatccgatcaaggcctatggttatgctgctcgagacacttccggagttctttctcctctcactttctcacgaagggctacaggtgataaggatgtgaggtttaaagttttgtattgcgggatctgccattctgatctccactttgccaagaacgaatggggcatgtctacatatcccattcttcctgggcatgagatcgtgggtgtggtgacagaagtaggcaccaaggtggagaaattcaaagttggggacactgtaggggttggatgtttggtgggatcatgcggatcttgtcaaagttgtgccaatgatcttgaaagctactgtcccaaacagattctaacttacggtttcctgtaccatgatggcacacttacatacggtggctactccgatcacatggtggcagatgagcattttgtgctgcgttggcccgagaatttgccccttgattcgggtgcaccattgttatgtgccggcatcacaacttatagcccactcagacactttggactagacaagcctggtatgaaggtgggtgtggttggtcttggtgggcttggtcatgttgcggtcaagtttgccaaggcttttggagccgaggttacagtcatcagtaccagctcggctaagaagcaagaagcgcttcaaggacttaaagctgaccatttcattgttagcaaagaccctgagcaaatgcagtgtgcagcaagttctttggatggaataattgacactgtctctgcgtctcaccccattgaaccattgttgagtgtgctcaaacaagatgggaagcttgtttttctgggtgtaccagagaagccaattgagatatctacgtattctttaattatggggagaaagatcgttactggaagtgcgacgggagggctaaaggagactcaggagatgcttgattttgccgcaaaacatggcgtgactgcagatattgagctaattcccatagactatgtgaacacggctatggatcgcgtcttgaaatcggatgttagataccgatttgtcattgatgtggcgaacaccctcaaagctccataggtgaattgtttaattttgtgtttgttgtttaagaacttgagtcagtgttggattgttgtcgctatatgttttatgaataaagactcggttcctcttcagttgataaaaaaaaaaaaaaa

SEQ ID NO: 108369 - protein, 360 aa, Helianthus annuus
MAKSPESEHPIKAYGYAARDTSGVLSPLTFSRRATGDKDVRFKVLYCGICHSDLHFAKNEWGMSTYPILPGHEIVGVVTEVGTKVEKFKVGDTVGVGCLVGSCGSCQSCANDLESYCPKQILTYGFLYHDGTLTYGGYSDHMVADEHFVLRWPENLPLDSGAPLLCAGITTYSPLRHFGLDKPGMKVGVVGLGGLGHVAVKFAKAFGAEVTVISTSSAKKQEALQGLKADHFIVSKDPEQMQCAASSLDGIIDTVSASHPIEPLLSVLKQDGKLVFLGVPEKPIEISTYSLIMGRKIVTGSATGGLKETQEMLDFAAKHGVTADIELIPIDYVNTAMDRVLKSDVRYRFVIDVANTLKAP

SEQ ID NO: 108370 - DNA, 1062 bp, Brassica napus
  CDS (1)..(1062)
atgggaaaggaggcattcggattggccgcaaaagacaattctggagttctctcgactttccatttctctagaagggagacaggagagaaggatgttaggttcaaagttttgttctgtggaatctgtcactctgatttgcatatgatcaagaatgagtggggaatatctacttaccctctcgtccccgggcatgagattgttggtgtggtgactgaagtgggaagcaaagtgactaaattcaaaactggagacaaagtcggagtaggttgcatggttggctcgtgcggatcatgtgatagctgcaccgaaggtctcgagaactactgtccaaaatcgatccaaacgtacggattcaagtattacgacgacacaataacctacggtggttactccgacaacatggtttgcgacgaaggtttcatcatccgtatgcccgaaaatctcccattggacgctgctgctccgctactatgcgcggggatcacggtctactccccgctaaaacatcacgggctcgacaagcctggcatgcacattggtgtggttggactaggcggtttgggtcacgtggcggtgaaatttgctaaggctatgggtcttaaggttacggttattagtacttcggatagtaagagagacgaagcgattaataggcttggtgcggacgcgttcgtggtgagccgtgaccaaaaacagattaaggatgcaatgaggacattggatggtattattaataccgtatctgcgactcattcccttcttcctttgctcggtttgctaaagcctaagggaaaacttgttatggttggtgcaccagaaaagccactcgagctcccggtcatgcctctcatcttcgagaggaagatggtaatgggaagtatgataggagggataaaggagactcaagagatggtggatatggcaggaaaacacaacatcactgctgatattgagcttatctctgcggactatgtcaacactgccatggaacggctcgagaaggccgacgttagataccgttttgtgattgatgttgccaacacattgaagcctactccttaa

SEQ ID NO: 108371 - protein, 353 aa, Brassica napus
MGKEAFGLAAKDNSGVLSTFHFSRRETGEKDVRFKVLFCGICHSDLHMIKNEWGISTYPLVPGHEIVGVVTEVGSKVTKFKTGDKVGVGCMVGSCGSCDSCTEGLENYCPKSIQTYGFKYYDDTITYGGYSDNMVCDEGFIIRMPENLPLDAAAPLLCAGITVYSPLKHHGLDKPGMHIGVVGLGGLGHVAVKFAKAMGLKVTVISTSDSKRDEAINRLGADAFVVSRDQKQIKDAMRTLDGIINTVSATHSLLPLLGLLKPKGKLVMVGAPEKPLELPVMPLIFERKMVMGSMIGGIKETQEMVDMAGKHNITADIELISADYVNTAMERLEKADVRYRFVIDVANTLKPTP

SEQ ID NO: 108372 - DNA, 1074 bp, Brassica napus
  CDS (1)..(1074)
atggggaaaatggaggtagagaggaaaacaacaggctgggctgcgagagacccttctgggttactctctccttacacttacactctcagagagacaggaccagaggatgttcacataagaatcatatgctgtggaatctgccacacagatctccatcaaaccaaaaacgatcttggcatgtcaaactaccccatggttcctgggcacgaggttgttggggaagtggtggaggtgggatcagatgtgagcaagttcaccgcaggggatatagttggagttggttgtctcgttggatgctgcggaggttgtagcccctgcgagagagatctggaacagtattgtcccaagaaaatatggagctacaacgatgtttacatcgatggtcaaccaacacaaggcggtttcgctagagccaccgtcgttcaccaaaagtttgtggtgaagattccagaaggaatggctgttgagcaggcggcaccactactgtgtgccggtgtgacagtgtacagtccactggctcacttcggtctgaagcgaccaggcctaagaggaggtatactagggctaggtggagttggtcacatgggtgtgaaaatagccaaagcaatgggtcaccatgtgactgtcataagctcatcaaacaagaagaaagaagaggctttgaaagatcttggagcagatgattacgtgatcggatccgaccaatcgaagatgaacgaattggcggattcaatggattacataatcgacacggtccctgttcatcatgcacttgagccttacttgtctctgcttaggcttgatgggaaactcatactcatgggagtcataagcaatccattacaatttctcactcctatggttatgcttgggaggaaagtgataacggggagcttcattgggagcatgaaggaaacagaggagatgcttgagttctgtaaagaaaagggtttgagttcgatcatcgaagtagtgaagatggattatgtgaacactgcgtttgagagactcgagaagaacgatgtgcgttataggttcgtggttgatgtcgaaggaagcaaacttgaggcttga

SEQ ID NO: 108373 - protein, 357 aa, Brassica napus; identical to SEQ ID NO: 100289

SEQ ID NO: 108374 - DNA, 1074 bp, Brassica napus
  CDS (1)..(1074)
atgggaaaggtgcctgcgacggaggcgttcggattggccgcgaaagacgaatccggagttctctcgcctttccgtttctcaagaagggagacgggagagaaggatgtgaggttaaaagtgttgttctgtggaatttgccacactgatgtatgtatggccagaaacgagtggggatttactacttaccctctcgtccccgggcatgagattgttggcgtggtgactgaagtcggagctaaagtgattaaattcaaagccggagacaaagtcggagttggttatatgctcagctcgtgccggtcatgtgacatctgcaccgatgaccaagagaaccactgtccaaaaatgattatgacgtccggaggaaagtactacgatgacaccatgacttatggtggttactctgaccacctggtttgtgaagaggattacatcatccgtattcctgaaaatctcccgttagacgctgccgcgccgctactctgcgctggggtcacggtttattcaccgttgaagtctcacggactcgacaagcccggaatccacattggtgtggtgggactaggcggtttaggtcacgtagcagtgaaatttgccaaggctatgggtactaaggttacggttattagttcgtcagagagtaagagagacgaggcgattaatcggcttggtgcggatctgttcttagtgagccgtgacccggaagagatgaaggatgcaatggggactatggatggtattattgatacagtatctgccactcatccgcttcttccgcttcttggtttgctaaaatataagggaaaattaattatggttggtgcacccgataaaccacttgaccttccagctttaccgctcatcttagggaagaagatggtggtgggaagtatgacaggagggataaaagagtctcaagagatggttgattttgccggtaaacacaacataacggcagatattgagcttatctctgcggattatgtcaacatggctatggaacggctagaaaagggggatgttagataccgttttgtgattgatgttgccaacacaatgaagcctactccttag

SEQ ID NO: 108375 - protein, 357 aa, Brassica napus
MGKVPATEAFGLAAKDESGVLSPFRFSRRETGEKDVRLKVLFCGICHTDVCMARNEWGFTTYPLVPGHEIVGVVTEVGAKVIKFKAGDKVGVGYMLSSCRSCDICTDDQENHCPKMIMTSGGKYYDDTMTYGGYSDHLVCEEDYIIRIPENLPLDAAAPLLCAGVTVYSPLKSHGLDKPGIHIGVVGLGGLGHVAVKFAKAMGTKVTVISSSESKRDEAINRLGADLFLVSRDPEEMKDAMGTMDGIIDTVSATHPLLPLLGLLKYKGKLIMVGAPDKPLDLPALPLILGKKMVVGSMTGGIKESQEMVDFAGKHNITADIELISADYVNMAMERLEKGDVRYRFVIDVANTMKPTP

SEQ ID NO: 108376 - DNA, 1074 bp, Brassica napus
  CDS (1)..(1074)
atgggagaggtccttaagaaggaggcgtacggactggctgtaaaagacgaatctggagttatctcgcctttccgtttctcaagaagggagacaggagaaaatgatgtgaggttaaaagtgttgttctgtggaatttgccacacagatttaagcatggccataaacgagtgggggtttactagttacccccttgtccccgggcatgaaatagtgggcgtggtgactgaagtcggagccaaagtgactaaattcaacgccggagacaaagtgggagttggttatatggtcagctcatgcgggtcatgtgaaacctgcattgatgaccaagagaactactgtccaaaaatgatcctaacgtccggaggcaagtattacgatgacactataacatatggtggttactccgaccatatggtttgtgaagaggactacatcatccgtattccagaaaatcttcccttagacgctaccgcgccgctactctgcgctgggaccaccgtctattccccgatgaagtatcacgggctcgacaagccgggtatgcacattggtgtggtgggactaggcggtttaggtcatgtagctgtgaaatttgctaaggctatgggtattaaggttacagttattagtacttcggataggaagagagacgaggcgttaactcggcttggtgcggatctgttcttggtgagccgtgacccggaacagatgaaggatgcaatgggtactatggatggtattattgataccgtatctgctactcatccagttcttccgattcttgatttgcttaaatataagggtaaacttattatggttggtgcacctgataaaccacttgagcttccggttctgcctctcatctttgggaaaaagatggtggtgggaagtatggtaggagggataaaagagactcaagagatgatggatttggccggaaaacacaacatcacggcagatattgagcttatctctgcggattatgtcaacactgccatggaacggctccagaaggctgacgttagataccgttttgtgattgatgttgccaacaccttgaagcctagtccttaa

SEQ ID NO: 108377 - protein, 357 aa, Brassica napus
MGEVLKKEAYGLAVKDESGVISPFRFSRRETGENDVRLKVLFCGICHTDLSMAINEWGFTSYPLVPGHEIVGVVTEVGAKVTKFNAGDKVGVGYMVSSCGSCETCIDDQENYCPKMILTSGGKYYDDTITYGGYSDHMVCEEDYIIRIPENLPLDATAPLLCAGTTVYSPMKYHGLDKPGMHIGVVGLGGLGHVAVKFAKAMGIKVTVISTSDRKRDEALTRLGADLFLVSRDPEQMKDAMGTMDGIIDTVSATHPVLPILDLLKYKGKLIMVGAPDKPLELPVLPLIFGKKMVVGSMVGGIKETQEMMDLAGKHNITADIELISADYVNTAMERLQKADVRYRFVIDVANTLKPSP

SEQ ID NO: 108378 - DNA, 1083 bp, Brassica napus
  CDS (1)..(1083)
atggcgaaatctccagagacagagcatccgaacaaagcctttggttgggctgccaaagacaaatctggtgtactcactcctttccatttctccagaagagacaatggtgacaatgatgtgacagtgaagatcttgtattgtggagtgtgccacactgatttacataccatcaaaaacgactggggcttctcgtattatcctgtagttccagggcatgaaatagttggaatagctacaaaagttggcaaaaacgtgactaaattcagagaaggagaccgtgtaggagtaggagtgatcactggttcttgccaatcttgcgaatcttgtaaccaagatcttgaaaactactgtccccaaatgtctttcacctacaactccataggatccgatggaaccaagacctacggtggatattcggagtccattgtggtcgatcaacgttttgtcttgcagtttcccgagggattacctagcgattcgggtgcccccttgctgtgtgctggaatcactgtgtatagtccaatgaagtattatggtatgaccgagcctgggaagcatttgggtgtggctggacttggtgggcttggtcatgttgctgtcaagattggtaaagcctttggtttgaaagtcactgtgattagttcttctcctagtaaagaagacgaagctattaatcgacttggtgctgattcgtttcttgtctcatctgatcctcagaagatgaaggctgcaattggaactatggactatattatcgatacggtatcagcagtacatgctctgtttccattgcttggtttactcaaagtcaatggaaagcttgtcacgttaggcttacctgagaagcctcttgagctaccaatcttccctcttgttctcggaagaaaaatggtgggaggaagtgacattggagggatgaaggagacacaagagatgcttgaattctgcgctaagcataacataacggcagatattgaactgatcaagatggatgagattaacactgcgatggagaggcttgctaagtctgatgttaggtacaggttcgtgatcgacgtcgctaactccttgagccctccatga

SEQ ID NO: 108379 - protein, 360 aa, Brassica napus
MAKSPETEHPNKAFGWAAKDKSGVLTPFHFSRRDNGDNDVTVKILYCGVCHTDLHTIKNDWGFSYYPVVPGHEIVGIATKVGKNVTKFREGDRVGVGVITGSCQSCESCNQDLENYCPQMSFTYNSIGSDGTKTYGGYSESIVVDQRFVLQFPEGLPSDSGAPLLCAGITVYSPMKYYGMTEPGKHLGVAGLGGLGHVAVKIGKAFGLKVTVISSSPSKEDEAINRLGADSFLVSSDPQKMKAAIGTMDYIIDTVSAVHALFPLLGLLKVNGKLVTLGLPEKPLELPIFPLVLGRKMVGGSDIGGMKETQEMLEFCAKHNITADIELIKMDEINTAMERLAKSDVRYRFVIDVANSLSPP

SEQ ID NO: 108380 - DNA, 1074 bp, Brassica napus
  CDS (1)..(1074)
atggggaaaatggaggtagagaggaaaacaacaggctgggctgcgagagacccttctgggttactctctccttacacttacactctcagagagacaggaccagaggatgttcacataagaatcatatgctgtggaatctgccacacagatctccatcaaaccaaaaacgatcttggcatgtcaaactaccccatggttcctgggcacgaggttgttggggaagtggtggaggtgggatcagatgtgagcaagttcaccgcaggggatatagttggagttggttgtctcgttggatgctgcggaggttgtagcccctgcgagagggatctggaacagtattgtcccaagaaaatatggagctacaacgatgtttacatcgatggtcaacctacacaaggcggtttcgctagagccaccgtcgttcaccaaaagtttgtggtgaagattccagaaggaatggctgttgagcaggcggcaccactactgtgtgccggtgtgacagtgtacagtccactggctcacttcggtctgaagcgaccaggcctaagaggaggtatactagggctaggtggagttggtcacatgggtgtgaaaatagccaaagcaatgggtcaccatgtgactgtcataagctcatcaaacaagaagaaagaagaggctttgaaagatcttggagcagatgattacgtgatcggatccgaccaatcgaagatgaacgaattggcggattcaatggattacataatcgacacggtccctgttcatcatgcacttgagccttacttgtctctgcttaggcttgatgggaaactcatactcatgggagtcataagcaatccattacaatttctcactcctatggttatgcttgggaggaaagtgataacggggagcttcattgggagcatgaaggaaacagaggagatgcttgagttctgtaaagaaaagggtttgagttcgatcatcgaagtagtgaagatggattatgtgaacactgcgtttgagagactcgagaagaacgatgtgcgttataggttcgtggttgatgtcgaaggaagcaaacttgaggcttga

SEQ ID NO: 108381 - protein, 357 aa, Brassica napus; identical to SEQ ID NO: 100289

SEQ ID NO: 108382 - DNA, 1074 bp, Zea mays
  CDS (1)..(1074)
atggcgggaggcaaggaggcgcacgggtgggcagccagggatgtctctggtcacctctccccttaccacttctcacggagggttcagagagacgacgacgtcaccatcaaggtgctcttctgcgggctttgccacactgacctccatgtcatcaagaacgagtttggcaacgccaagtaccccgtcgttcccgggcacgagatcgtcggcgtcgtcacggacgtcggctccggcgtcacaagcttcaagcccggcgacacggtgggcgtgggctacttcgtcgactcctgccgcagctgcaacagctgcagcaaggggtacgagagctactgcccgcagctcgtggagacgtccaacggcgtgagcctggacgacgacggcggcgccaccaccaagggcggcttctccgacgccctcgtcgtccaccagcgctacgtggtgcgggtcccggccagcctgccgcccgccggggccgcgccgctgctgtgcgccggcgtcaccgtgttcagccccatggtgcagtacggcctgaacgcgccggggaagcacctgggcgtcgtcggcctcggcggcctcggccacctggccgtccgcttcggcaaggcgttcgggatgaaggtcaccgtcatcagcacgtcgctgggcaagcgggacgaggccctcggccgcctcggcgccgacgcgttcctggtcagccgcgaccccgagcagatgagggcggcggcgggcaccttggacggcgtcatcgacacggtgtcggccgaccaccctgtcgtgccgctgctggacctgctcaagccgatgggccagatggtcgtcgtcggcctgcccaccaagccgctccaggtgcctgccttcagcctcgtcgccggcgggaagcgcgtggccgggagtgccggcggcggcgtcggggagtgccaggccatgctcgactttgccggcgagcacgggatcaccgcggatgtggaggtcgtcgggatggactacgtcaataccgccatccagcgcctagagaggaacgatgtcaggtaccgcttcgttgtcgacgtcgcgggcagcaagattggaggctag

SEQ ID NO: 108383 - protein, 357 aa, Zea mays
MAGGKEAHGWAARDVSGHLSPYHFSRRVQRDDDVTIKVLFCGLCHTDLHVIKNEFGNAKYPVVPGHEIVGVVTDVGSGVTSFKPGDTVGVGYFVDSCRSCNSCSKGYESYCPQLVETSNGVSLDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYVNTAIQRLERNDVRYRFVVDVAGSKIGG

SEQ ID NO: 108384 - DNA, 1245 bp, Zea mays
  CDS (1)..(1245)
atgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggcagatggtggtcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctag

SEQ ID NO: 108385 - protein, 414 aa, Zea mays
MSYHCRVLVPVPFHYPPGAGARVGAGAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDEDQMKAATGTMDGIIDTVSAWHPITPLLALLKPLGQMVVVGAPSKPLELPAYAIVPGGKGVAGNNVGSVRDCQAMLEFAGKHGIGAEVEVIKMDYVNTAMERLEKNDVRYRFVIDVAGSLGSAA

SEQ ID NO: 108386 - DNA, 1065 bp, Zea mays
  CDS (1)..(1065)
atggctgctgaatcagagaacggcaactgcaaagcttgggcagcgagagatccttctggagttctctcaccacacagttttaaccgcagagcagtgcaaagcggcgatgtttcgctgaagatcatatactgtggagtctgttatgcagacgttgcttggacgcggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatggctaccctttggcgaaggcagcacctcttctgtgtgctggaataaccgtgtatactccaatgatgcgacacaacatgaaccaacctggaaagtcacttggggtcattggtcttggtggtctgggtcacatggctgtgaaatttggtaaagcatttggtcttaaggtcacagttttcagtacaagtgaatcaaagagagatgaagccatcaacctccttggagcagataattttgttatatcatcagacacacagcaaatggagtccctgaagaactccctgcacttcataattgacactgcttccggtgaccatccatttgatccgtatttctctctccttaaggttggtggtgtgatgacattggtaggttttccaagtgagatcaaaatgcatcctgcaagccttatacttggtgcgcggaccttgtctggcagtgttgttggaggtataaaagacatccaagaaatggttaacttctgtgcagccaacaatatctatccggagattgagatcattaagatagattatatcaacgaggctctcgcgaggcttgttaatcgagatgtgaaataccgctttgtaatcgacatcgagaactccttcaagtag

SEQ ID NO: 108387 - protein, 354 aa, Zea mays
MAAESENGNCKAWAARDPSGVLSPHSFNRRAVQSGDVSLKIIYCGVCYADVAWTRNKLNDSKYPLVPGHEIAGVVTQVGADVKGFKVGDHVGVGTYVNSCRDCENCNISLDNHCPKAVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFSTSESKRDEAINLLGADNFVISSDTQQMESLKNSLHFIIDTASGDHPFDPYFSLLKVGGVMTLVGFPSEIKMHPASLILGARTLSGSVVGGIKDIQEMVNFCAANNIYPEIEIIKIDYINEALARLVNRDVKYRFVIDIENSFK

SEQ ID NO: 108388 - DNA, 1080 bp, Zea mays
  CDS (1)..(1080)
atggctcccactcccactcacacggcggcggcggtggcgctcgccgcgcacgactcgtccggccacctcgcgccgctcaccatcacccgcaggagcaccggggacgacgatgtagcgataaagatcctgtactgtgggatgtgtcactctgaccttcacagcatcaagaacgagtggcacaacgccacgtaccccatggtccctggtcacgagatcgccggagtggtgacggaggtgggcaagaacgtgaccagcttcaaggccggggaccgcgtcggcgtgggctgcatggtgaactcgtgccagtcgtgcggcagctgcgacgaggacttcgagaacagctgccgggccgtcatcttcacctacaactccgtcgaccgcgacggcaccgtcacctacggcggctactccagcagcgtggtggtgcacgagcgcttcgtggtccggttccccgacgcgatgccgctggatcggggggcgccgctgctgtgcgcgggcatcacagtgtacagccccatgaagtaccacggcctgaacgtgccggggaagcacgtcggcgtgatggggctgggaggcctgggccacgtcgccgtcaagttcgccaaggcgttcggggccaaggtcacggtcatcagcacgtcgcctgggaagaagcaggaggcgctcgaccggcttggcgccgacgccttcgtcgtcagcaaggacgccgaagaaatgaaggcggctgcgagcaccatggacggcatcatcaacacggtgtcggcgaacctcaccttggccccgtacatgggcctgctcaagcccaacggcaagatgatcatggtcggcctgcccaccaagcctctcgagatcccgccctttgatctcatcattgggaacaagaccctggccgggagctgcatcggcggcatgagggacacgcaggagatgatcaacgtggcggccaagcacggcgtgacggcggacatagaactggtggccgcggactacgtgaacacggccatggagcgcctggccaaggctgacgtcaggtaccgcttcgtcatcgacatcggcaacaccctcaagaattcagagtga

SEQ ID NO: 108389 - protein, 359 aa, Zea mays
MAPTPTHTAAAVALAAHDSSGHLAPLTITRRSTGDDDVAIKILYCGMCHSDLHSIKNEWHNATYPMVPGHEIAGVVTEVGKNVTSFKAGDRVGVGCMVNSCQSCGSCDEDFENSCRAVIFTYNSVDRDGTVTYGGYSSSVVVHERFVVRFPDAMPLDRGAPLLCAGITVYSPMKYHGLNVPGKHVGVMGLGGLGHVAVKFAKAFGAKVTVISTSPGKKQEALDRLGADAFVVSKDAEEMKAAASTMDGIINTVSANLTLAPYMGLLKPNGKMIMVGLPTKPLEIPPFDLIIGNKTLAGSCIGGMRDTQEMINVAAKHGVTADIELVAADYVNTAMERLAKADVRYRFVIDIGNTLKNSE

SEQ ID NO: 108390 - DNA, 1077 bp, Zea mays
  CDS (1)..(1077)
atggcgggaggcaaggaagcgcacgggtgggcagccagggatgtctctggtcacctctccccttaccacttctcacggagggttcagagagacgacgacgtcaccatcaaggtgctcttctgcgggctttgccacactgacctccacgtcatcaagaacgagtttggcaacgccaagtaccccgtcgttcccgggcacgagatcgtcggcgtcgtcaccgacgtcggctccggcgtcacaagcttcaagcccggcgacacggtgggcgtgggctacttcgtcgactcctgccgcagctgcgacagctgcagcaaggggtacgagagctactgcccgcagctcgtggagacgtccaacggcgtgagcctggacgacgatgacggcggcgccaccaccaagggcggcttctccgacgccctcgtcgtccaccagcgctacgtggtgcgggtcccggccagcctgccgcccgccggggccgcgccgctgctgtgcgccggcgtcaccgtgttcagccccatggtgcagtacggcctgaacgcgccggggaagcacctgggcgtcgtcggcctcggcggcctcggccacctggccgtccgcttcggcaaggcgttcgggatgaaggtcaccgtcatcagcacgtcgctgggcaagcgggacgaggccctcggccgcctcggtgccgacgcgttcctggtcagccgcgaccccgagcagatgagggcggcggcgggcaccttggacggcgtcatcgacacggtgtcggccgaccaccctgtcgtgccgctgctggacctgctcaagccgatgggccagatggtcgtcgtcggcctgcccaccaagccgctccaggtgcctgccttcagcctcgtcgccggcgggaagcgcgtggccgggagtgccggcggcggcgtcggggagtgccaggccatgctcgactttgccggcgagcacgggatcaccgcggatgtggaggtcgtcgggatggactacgtcaataccgccatccagcgcctagagaggaacgatgtcaggtaccgcttcgttgtcgacgtcgcgggcagcaagattggaggctag

SEQ ID NO: 108391 - protein, 358 aa, Zea mays
MAGGKEAHGWAARDVSGHLSPYHFSRRVQRDDDVTIKVLFCGLCHTDLHVIKNEFGNAKYPVVPGHEIVGVVTDVGSGVTSFKPGDTVGVGYFVDSCRSCDSCSKGYESYCPQLVETSNGVSLDDDDGGATTKGGFSDALVVHQRYVVRVPASLPPAGAAPLLCAGVTVFSPMVQYGLNAPGKHLGVVGLGGLGHLAVRFGKAFGMKVTVISTSLGKRDEALGRLGADAFLVSRDPEQMRAAAGTLDGVIDTVSADHPVVPLLDLLKPMGQMVVVGLPTKPLQVPAFSLVAGGKRVAGSAGGGVGECQAMLDFAGEHGITADVEVVGMDYVNTAIQRLERNDVRYRFVVDVAGSKIGG

SEQ ID NO: 108392 - DNA, 1245 bp, Zea mays
  CDS (1)..(1245)
atgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcggatgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggcagatggtgatcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctag

SEQ ID NO: 108393 - protein, 414 aa, Zea mays
MSYHCRVLVPVPFHYPPGAGARVGAGAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDEDQMKAATGTMDGIIDTVSAWHPITPLLALLKPLGQMVIVGAPSKPLELPAYAIVPGGKGVAGNNVGSVRDCQAMLEFAGKHGIGAEVEVIKMDYVNTAMERLEKNDVRYRFVIDVAGSLGSAA

SEQ ID NO: 108394 - DNA, 1104 bp, Zea mays
  CDS (1)..(1104)
atggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacgaggtggtcggcgaggtggtggaggtcgggcccgaggtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaccccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatggcggcggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactga

SEQ ID NO: 108395 - protein, 367 aa, Zea mays
MGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 108396 - DNA, 20 bp, Artificial sequence
  primer
atggcaacctcaccggaatc

SEQ ID NO: 108397 - DNA, 22 bp, Artificial sequence
  primer
ctattcagccttgatcgagttc

SEQ ID NO: 108398 - protein, 457 aa, Artificial sequence; identical to SEQ ID NO: 84968
  consensus sequence
  Variant (2)..(2): Xaa in position 2 is any amino acid
  Variant (5)..(5): Xaa in position 5 is any amino acid
  Variant (7)..(7): Xaa in position 7 is any amino acid
  Variant (9)..(16): Xaa in position 9 to 16 is any amino acid
  Variant (17)..(31): Xaa in position 17 to 31 is any or no amino acid
  Variant (35)..(36): Xaa in position 35 to 36 is any amino acid
  Variant (38)..(38): Xaa in position 38 is any amino acid
  Variant (40)..(42): Xaa in position 40 to 42 is any amino acid
  Variant (44)..(46): Xaa in position 44 to 46 is any amino acid
  Variant (47)..(48): Xaa in position 47 to 48 is any or no amino acid
  Variant (50)..(54): Xaa in position 50 to 54 is any amino acid
  Variant (57)..(57): Xaa in position 57 is any amino acid
  Variant (60)..(66): Xaa in position 60 to 66 is any amino acid
  Variant (68)..(69): Xaa in position 68 to 69 is any amino acid
  Variant (70)..(74): Xaa in position 70 to 74 is any or no amino acid
  Variant (76)..(77): Xaa in position 76 to 77 is any amino acid
  Variant (79)..(82): Xaa in position 79 to 82 is any amino acid
  Variant (84)..(85): Xaa in position 84 to 85 is any amino acid
  Variant (87)..(98): Xaa in position 87 to 98 is any amino acid
  Variant (99)..(115): Xaa in position 99 to 115 is any or no amino acid
  Variant (117)..(131): Xaa in position 117 to 131 is any amino acid
  Variant (133)..(139): Xaa in position 133 to 139 is any amino acid
  Variant (140)..(148): Xaa in position 140 to 148 is any or no amino acid
  Variant (151)..(151): Xaa in position 151 is any amino acid
  Variant (156)..(156): Xaa in position 156 is any amino acid
  Variant (158)..(158): Xaa in position 158 is any amino acid
  Variant (160)..(169): Xaa in position 160 to 169 is any amino acid
  Variant (170)..(173): Xaa in position 170 to 173 is any or no amino acid
  Variant (175)..(180): Xaa in position 175 to 180 is any amino acid
  Variant (182)..(182): Xaa in position 182 is any amino acid
  Variant (188)..(192): Xaa in position 188 to 192 is any amino acid
  Variant (194)..(196): Xaa in position 194 to 196 is any amino acid
  Variant (198)..(215): Xaa in position 198 to 215 is any amino acid
  Variant (216)..(222): Xaa in position 216 to 222 is any or no amino acid
  Variant (225)..(261): Xaa in position 225 to 261 is any amino acid
  Variant (262)..(301): Xaa in position 262 to 301 is any or no amino acid
  Variant (303)..(307): Xaa in position 303 to 307 is any amino acid
  Variant (309)..(325): Xaa in position 309 to 325 is any amino acid
  Variant (326)..(358): Xaa in position 326 to 358 is any or no amino acid
  Variant (361)..(362): Xaa in position 361 to 362 is any amino acid
  Variant (364)..(405): Xaa in position 364 to 405 is any amino acid
  Variant (406)..(454): Xaa in position 406 to 454 is any or no amino acid
  Variant (456)..(456): Xaa in position 456 is any amino acid

SEQ ID NO: 108399 - protein, 93 aa, Artificial sequence; identical to SEQ ID NO: 84969
  protein pattern
  Variant (1)..(1): Xaa in position 1 is Ile, Val, Leu, Phe or Met
  Variant (2)..(2): Xaa in position 2 is any amino acid
  Variant (3)..(3): Xaa in position 3 is Ile, Val, Met or Leu
  Variant (4)..(5): Xaa in position 4 to 5 is any amino acid
  Variant (6)..(6): Xaa in position 6 is Cys, Ser, Ala or Thr
  Variant (7)..(7): Xaa in position 7 is Gly or Ala
  Variant (8)..(8): Xaa in position 8 is Val, Ile, Leu or Met
  Variant (10)..(10): Xaa in position 10 is any amino acid
  Variant (11)..(11): Xaa in position 11 is Ser, Thr or Ala
  Variant (12)..(12): Xaa in position 12 is Asp or Glu
  Variant (13)..(13): Xaa in position 13 is Leu, Ile, Val or Met
  Variant (14)..(18): Xaa in position 14 to 18 is any amino acid
  Variant (19)..(33): Xaa in position 19 to 33 is any or no amino acid
  Variant (34)..(34): Xaa in position 34 is Pro, Gly or Asn
  Variant (35)..(35): Xaa in position 35 is any amino acid
  Variant (36)..(36): Xaa in position 36 is Val, Ile, Thr, Cys or Ala
  Variant (37)..(37): Xaa in position 37 is any amino acid
  Variant (40)..(40): Xaa in position 40 is Glu or Gln
  Variant (41)..(41): Xaa in position 41 is Ile, Gly or Val
  Variant (42)..(42): Xaa in position 42 is Val, Ile, Ala or Thr
  Variant (44)..(44): Xaa in position 44 is any amino acid
  Variant (45)..(45): Xaa in position 45 is Val, Ile or Ala
  Variant (46)..(47): Xaa in position 46 to 47 is any amino acid
  Variant (48)..(48): Xaa in position 48 is Val, Leu, Ile, Thr or Met
  Variant (49)..(49): Xaa in position 49 is Gly or Ala
  Variant (50)..(57): Xaa in position 50 to 57 is any amino acid
  Variant (58)..(60): Xaa in position 58 to 60 is any or no amino acid
  Variant (62)..(62): Xaa in position 62 is Asp, Gln, Glu, Ser or Lys
  Variant (63)..(63): Xaa in position 63 is any amino acid
  Variant (64)..(64): Xaa in position 64 is Val or Ala
  Variant (65)..(65): Xaa in position 65 is Gly, Ser or Ala
  Variant (66)..(66): Xaa in position 66 is Val, Ile or Leu
  Variant (67)..(72): Xaa in position 67 to 72 is any amino acid
  Variant (73)..(73): Xaa in position 73 is Cys or Asp
  Variant (74)..(81): Xaa in position 74 to 81 is any or no amino acid
  Variant (83)..(84): Xaa in position 83 to 84 is any amino acid
  Variant (86)..(92): Xaa in position 86 to 92 is any amino acid

SEQ ID NO: 108400 - protein, 76 aa, Artificial sequence; identical to SEQ ID NO: 84970
  protein pattern
  Variant (1)..(1): Xaa in position 1 is Ala, Ser, Gly or Thr
  Variant (2)..(2): Xaa in position 2 is Pro or Ser
  Variant (3)..(3): Xaa in position 3 is Leu, Ile, Met, Val or Phe
  Variant (4)..(4): Xaa in position 4 is any amino acid
  Variant (6)..(6): Xaa in position 6 is Ala or Gly
  Variant (8)..(8): Xaa in position 8 is Ile, Val, Leu, Ala or Ser
  Variant (10)..(10): Xaa in position 10 is any amino acid
  Variant (11)..(11): Xaa in position 11 is Tyr, Phe or Trp
  Variant (12)..(12): Xaa in position 12 is any amino acid
  Variant (13)..(13): Xaa in position 13 is Pro, Ala, Gly or Ser
  Variant (14)..(14): Xaa in position 14 is Leu, Met, Ile, Val or Phe
  Variant (15)..(23): Xaa in position 15 to 23 is any amino acid
  Variant (24)..(29): Xaa in position 24 to 29 is any or no amino acid
  Variant (30)..(30): Xaa in position 30 is Gly, Ala, Val, Ile, Leu or Met
  Variant (31)..(31): Xaa in position 31 is Ile, Val, Ser, Pro or Leu
  Variant (32)..(32): Xaa in position 32 is any amino acid
  Variant (33)..(33): Xaa in position 33 is Gly or Ala
  Variant (34)..(34): Xaa in position 34 is any amino acid
  Variant (36)..(36): Xaa in position 36 is Gly or Ala
  Variant (37)..(37): Xaa in position 37 is Leu, Val or Ile
  Variant (38)..(38): Xaa in position 38 is Gly or Ala
  Variant (39)..(39): Xaa in position 39 is any amino acid
  Variant (40)..(40): Xaa in position 40 is Met, Leu, Val, Ile or Phe
  Variant (41)..(41): Xaa in position 41 is Ala, Gly or Leu
  Variant (42)..(42): Xaa in position 42 is Val, Ile, Leu or Ala
  Variant (43)..(43): Xaa in position 43 is Lys, Gln, Leu or Met
  Variant (44)..(44): Xaa in position 44 is any amino acid
  Variant (45)..(45): Xaa in position 45 is Ala, Gly, Leu or Ser
  Variant (46)..(48): Xaa in position 46 to 48 is any amino acid
  Variant (49)..(49): Xaa in position 49 is Gly or Phe
  Variant (50)..(63): Xaa in position 50 to 63 is any amino acid
  Variant (64)..(73): Xaa in position 64 to 73 is any or no amino acid
  Variant (74)..(74): Xaa in position 74 is Leu, Met, Val, Ile or Phe
  Variant (75)..(75): Xaa in position 75 is Gly or Ala
  Variant (76)..(76): Xaa in position 76 is Ala, Gly or Val

SEQ ID NO: 108401 - DNA, 602 bp, Brassica napus
  CDS (30)..(431)
gaattcccgggtcgacagcgaagggaacgatgacaatgatgagatctttctcgatggcaatgttgctcgtcgcactagtttcatccatctctattgtttcttcggcttcttcatcccctgaagccgagtttgttaagaagaccatctcttcccacaagatcgttatcttctccaaatcctactgcccgtattgcaggagagccaaatctgtgttcagtgagctggatcaggttcctcatgttgtggagcttgatgaaagagaagatgggtggaacgttcagagtgcacttggagagattgttggaaggcgaacagtaccacaggttttcattaacggaaagcacattggaggatcagacgatactgtagaagcgcatgaaagcggtgaactggccaagcttctcggtctttccaccaaagctgaactctaggttcaatgtagttgtagttggagcaatattcaggtgtaagcacttcaattttccagtttcatgataacttgtaatgtgttctgaaggttataaacgtcttgtcatggttttgtgaaactgtattaaagactacgagttggattgagattaaaaaaataaaaaaaaaaaaaa

SEQ ID NO: 108402 - protein, 133 aa, Brassica napus
MTMMRSFSMAMLLVALVSSISIVSSASSSPEAEFVKKTISSHKIVIFSKSYCPYCRRAKSVFSELDQVPHVVELDEREDGWNVQSALGEIVGRRTVPQVFINGKHIGGSDDTVEAHESGELAKLLGLSTKAEL

SEQ ID NO: 108403 - DNA, 23 bp, Artificial sequence
  primer
atgacaatgatgagatctttctc

SEQ ID NO: 108404 - DNA, 20 bp, Artificial sequence
  primer
ctagagttcagctttggtgg

SEQ ID NO: 108405 - protein, 80 aa, Artificial sequence; identical to SEQ ID NO: 7429
  consensus sequence
  Variant (2)..(3): Xaa in position 2 to 3 is any amino acid
  Variant (5)..(53): Xaa in position 5 to 53 is any amino acid
  Variant (57)..(58): Xaa in position 57 to 58 is any amino acid
  Variant (60)..(65): Xaa in position 60 to 65 is any amino acid
  Variant (68)..(77): Xaa in position 68 to 77 is any amino acid
  Variant (79)..(79): Xaa in position 79 is any amino acid

SEQ ID NO: 108406 - protein, 11 aa, Artificial sequence
  protein pattern
  Variant (1)..(1): Xaa in position 1 is Val, Ile, Met or Ala
  Variant (2)..(2): Xaa in position 2 is Val, Phe, Ala, Thr or Glu
  Variant (3)..(3): Xaa in position 3 is Val, Met or Ile
  Variant (4)..(4): Xaa in position 4 is Phe, Tyr or Ala
  Variant (5)..(5): Xaa in position 5 is Ser, Ala, Val or Ile
  Variant (6)..(6): Xaa in position 6 is Lys or Asn
  Variant (7)..(8): Xaa in position 7 to 8 is any amino acid
  Variant (9)..(9): Xaa in position 9 is Cys or Ile
  Variant (10)..(10): Xaa in position 10 is any amino acid
  Variant (11)..(11): Xaa in position 11 is Tyr, Phe, Met or Leu
XXXXXXXXXXX

SEQ ID NO: 108407 - protein, 14 aa, Artificial sequence
  protein pattern
  Variant (1)..(1): Xaa in position 1 is Thr, Ser or Ala
  Variant (2)..(2): Xaa in position 2 is Val, Met, Ile or Phe
  Variant (4)..(4): Xaa in position 4 is any amino acid
  Variant (5)..(5): Xaa in position 5 is Val, Ile or Leu
  Variant (6)..(6): Xaa in position 6 is Phe, Tyr, Ile or Val
  Variant (7)..(7): Xaa in position 7 is Ile, Val, Phe or Leu
  Variant (8)..(12): Xaa in position 8 to 12 is any amino acid
  Variant (14)..(14): Xaa in position 14 is Gly, Asp or Ser
XXPXXXXXXXXXGX

SEQ ID NO: 108408 - DNA, 735 bp, Zea mays; identical to SEQ ID NO: 100304
  CDS (1)..(735)

SEQ ID NO: 108409 - protein, 244 aa, Zea mays; identical to SEQ ID NO: 100305

SEQ ID NO: 108410 - DNA, 591 bp, Brassica napus
  CDS (1)..(591)
atgacttcttcagtgcatgagctctctgataacaatgaaagtcataagaagcaagaacgtccagattcccaaactccaccaccggttccttcaggaccatgttctgaatctatagatacaagctccgtctactcagaaccgattgcgcatgggctctacccgtatccagatccttactacagaagcgtctttgcacatcaagcctatcttccacatccatatcctggggtccaaatgcagttaatgggaatgcatcaacaagtggttccattacagtgtgatgcagtcgaggagcctgtgtttgttaacgcaaagcaataccacggtatactcaggcgtaggcaatccagggcaaaacttgaggctcggaacagagccatcaagtcaaagaagccatatatgcatgagtctcggcatttgcatgcgataaaccgacctagaggatgtggaggccggtttctcaatgccaagaagaagaatggagagcgtaaggaagaggaggaggcaacctctgatgagaacacttcagaagcaagttctagcatcaggtctgagaaagcagccatgggtcctaatgtcagtagatcttga

SEQ ID NO: 108411 - protein, 196 aa, Brassica napus
MTSSVHELSDNNESHKKQERPDSQTPPPVPSGPCSESIDTSSVYSEPIAHGLYPYPDPYYRSVFAHQAYLPHPYPGVQMQLMGMHQQVVPLQCDAVEEPVFVNAKQYHGILRRRQSRAKLEARNRAIKSKKPYMHESRHLHAINRPRGCGGRFLNAKKKNGERKEEEEATSDENTSEASSSIRSEKAAMGPNVSRS

SEQ ID NO: 108412 - DNA, 21 bp, Artificial sequence
  primer
atgagacagaatggcgcggtg

SEQ ID NO: 108413 - DNA, 20 bp, Artificial sequence
  primer
ctactcaccgccccctctcg

SEQ ID NO: 108414 - protein, 56 aa, Artificial sequence; identical to SEQ ID NO: 28584
  consensus sequence
  Variant (2)..(3): Xaa in position 2 to 3 is any amino acid
  Variant (9)..(11): Xaa in position 9 to 11 is any amino acid
  Variant (13)..(14): Xaa in position 13 to 14 is any amino acid
  Variant (17)..(18): Xaa in position 17 to 18 is any amino acid
  Variant (20)..(22): Xaa in position 20 to 22 is any amino acid
  Variant (24)..(34): Xaa in position 24 to 34 is any amino acid
  Variant (35)..(35): Xaa in position 35 is any or no amino acid
  Variant (37)..(37): Xaa in position 37 is any amino acid
  Variant (43)..(43): Xaa in position 43 is any amino acid
  Variant (46)..(47): Xaa in position 46 to 47 is any amino acid
  Variant (49)..(49): Xaa in position 49 is any amino acid
  Variant (51)..(52): Xaa in position 51 to 52 is any amino acid

SEQ ID NO: 108415 - protein, 27 aa, Artificial sequence
  protein pattern
  Variant (2)..(2): Xaa in position 2 is any amino acid
  Variant (3)..(3): Xaa in position 3 is Tyr or Phe
  Variant (9)..(9): Xaa in position 9 is Tyr or Phe
  Variant (10)..(10): Xaa in position 10 is any amino acid
  Variant (11)..(11): Xaa in position 11 is Arg, Ala or Gly
  Variant (13)..(13): Xaa in position 13 is Leu or Met
  Variant (14)..(14): Xaa in position 14 is Lys or Arg
  Variant (17)..(17): Xaa in position 17 is any amino acid
  Variant (18)..(18): Xaa in position 18 is Ala or Ser
  Variant (20)..(20): Xaa in position 20 is Ala or Gln
  Variant (21)..(21): Xaa in position 21 is Lys or Arg
  Variant (22)..(22): Xaa in position 22 is Leu or Ala
  Variant (24)..(24): Xaa in position 24 is Glu, Ala or Leu
  Variant (25)..(26): Xaa in position 25 to 26 is any amino acid
  Variant (27)..(27): Xaa in position 27 is Arg or Lys
PXXVNAKQXXXIXXRRXXRXXXEXXXX

SEQ ID NO: 108416 - protein, 26 aa, Artificial sequence
  protein pattern
  Variant (1)..(1): Xaa in position 1 is Lys or Arg
  Variant (2)..(2): Xaa in position 2 is any amino acid
  Variant (3)..(3): Xaa in position 3 is Arg or Lys
  Variant (4)..(4): Xaa in position 4 is Lys or Arg
  Variant (5)..(5): Xaa in position 5 is Pro, Lys or Arg
  Variant (7)..(7): Xaa in position 7 is Leu or Met
  Variant (13)..(13): Xaa in position 13 is any amino acid
  Variant (16)..(16): Xaa in position 16 is Met, Ile or Leu
  Variant (17)..(17): Xaa in position 17 is Arg or Asn
  Variant (19)..(19): Xaa in position 19 is Pro, Ala or Ile
  Variant (21)..(21): Xaa in position 21 is Gly, Ala or Ser
  Variant (22)..(22): Xaa in position 22 is any amino acid
XXXXXYXHESRHXHAXXRXRXXGGRF

SEQ ID NO: 108417 - DNA, 1099 bp, Brassica napus
  CDS (54)..(923)
aacacatttaagaagaaaaccaaaaacaaaaaaatcaagaaagaagcagaagaatggccattaacggtgacgataaggtttcaggagaagaaacagcttcgtcgaaccggccggttagagtctacgccgatggaatctatgatttgttccacttcggtcacgctcgcgccatcgaacaagccaagaaatcgtttccgaacacgtatctgctcgtaggatgttgtaacgacgagatcacaaacaaattcaaaggaaagaccgtgatgacagagtccgaacgctatgaatctctccgacattgcaagtgggtcgatgaagtgattccagatgcaccatgggttctcaccaccgagtttctcgataagcatcagatcgactacgtagctcatgatgctcttccatatgcggatgctagtggagctggaaacgatgtctatgagtttgtaaagtcgattgggaagtttaaagaaactaaacgaacagaggggatatcgacatcagatataatcatgagaattgtgaaagattataatcagtatgtgttgcgtaacttggaccgaggatattccagagaagagctcggtgtcagctttgttaaggagaagaggcttagagtgaacgtgaaactgaagaaactacaagagaaagtgaaagaacaacaagaaaagatacaaaccgtagcaaaaactgctgggatgcaccgcaatgagtgggttgaaaatgctgatcgttgggttgctgggtttcttgaaatgtttgaggaaggttgtcataaaatgggaacagccatcagagatgggatccagcaacggctactgaggcaggaatcagaagatgccgaggatgatgagagcgaagaaatttctgatgaggatgaggttgcagaaggggatgaaaactatcatgtcaggaaggtttcttaaatgagaagggcaacaaagagaatgggatagtgaagaaatgagagttttggttcagcattcaagaatttccagatgcggaagaccaaagtgtaacagattccacagttatggactagaattgtttgttatgttcaagtgaatacatgaaaactgtacttccagaaaaaaaaaaaaaa

SEQ ID NO: 108418 - protein, 289 aa, Brassica napus
MAINGDDKVSGEETASSNRPVRVYADGIYDLFHFGHARAIEQAKKSFPNTYLLVGCCNDEITNKFKGKTVMTESERYESLRHCKWVDEVIPDAPWVLTTEFLDKHQIDYVAHDALPYADASGAGNDVYEFVKSIGKFKETKRTEGISTSDIIMRIVKDYNQYVLRNLDRGYSREELGVSFVKEKRLRVNVKLKKLQEKVKEQQEKIQTVAKTAGMHRNEWVENADRWVAGFLEMFEEGCHKMGTAIRDGIQQRLLRQESEDAEDDESEEISDEDEVAEGDENYHVRKVS

SEQ ID NO: 108419 - DNA, 24 bp, Artificial sequence
  primer
atggccattaacggtgacgataag

SEQ ID NO: 108420 - DNA, 25 bp, Artificial sequence
  primer
ttaagaaaccttcctgacatgatag

SEQ ID NO: 108421 - protein, 144 aa, Artificial sequence
  consensus sequence
  Variant (3)..(4): Xaa in position 3 to 4 is any amino acid
  Variant (7)..(8): Xaa in position 7 to 8 is any amino acid
  Variant (10)..(11): Xaa in position 10 to 11 is any amino acid
  Variant (13)..(13): Xaa in position 13 is any amino acid
  Variant (16)..(18): Xaa in position 16 to 18 is any amino acid
  Variant (20)..(20): Xaa in position 20 is any amino acid
  Variant (24)..(36): Xaa in position 24 to 36 is any amino acid
  Variant (38)..(38): Xaa in position 38 is any amino acid
  Variant (41)..(43): Xaa in position 41 to 43 is any amino acid
  Variant (45)..(50): Xaa in position 45 to 50 is any amino acid
  Variant (53)..(55): Xaa in position 53 to 55 is any amino acid
  Variant (57)..(60): Xaa in position 57 to 60 is any amino acid
  Variant (63)..(71): Xaa in position 63 to 71 is any amino acid
  Variant (76)..(78): Xaa in position 76 to 78 is any amino acid
  Variant (81)..(97): Xaa in position 81 to 97 is any amino acid
  Variant (99)..(101): Xaa in position 99 to 101 is any amino acid
  Variant (103)..(115): Xaa in position 103 to 115 is any amino acid
  Variant (117)..(117): Xaa in position 117 is any amino acid
  Variant (119)..(121): Xaa in position 119 to 121 is any amino acid
  Variant (123)..(124): Xaa in position 123 to 124 is any amino acid
  Variant (126)..(131): Xaa in position 126 to 131 is any amino acid
  Variant (134)..(134): Xaa in position 134 is any amino acid
  Variant (136)..(136): Xaa in position 136 is any amino acid
  Variant (139)..(139): Xaa in position 139 is any amino acid
  Variant (141)..(143): Xaa in position 141 to 143 is any amino acid
RVXXDGXXDXXHXGHXXXLXQAKXXXXXXXXXXXXXLXVGXXXDXXXXXXKGXXXVXXXXERXXXXXXXXXVDEVXXXAPXXXXXXXXXXXXXXXXXDXXXHXXXXXXXXXXXXXDXYXXXKXXGXXXXXXRTXGXSTXDXXXR

SEQ ID NO: 108422 - protein, 146 aa, Artificial sequence; identical to SEQ ID NO: 18651
  protein pattern
  Variant (1)..(1): Xaa in position 1 is Arg or Lys
  Variant (2)..(2): Xaa in position 2 is Val, Ile or Leu
  Variant (3)..(3): Xaa in position 3 is Tyr or Trp
  Variant (4)..(4): Xaa in position 4 is any amino acid
  Variant (7)..(7): Xaa in position 7 is Ile, Cys or Val
  Variant (8)..(8): Xaa in position 8 is Phe, Tyr or Met
  Variant (10)..(10): Xaa in position 10 is Leu, Met or Phe
  Variant (11)..(11): Xaa in position 11 is any amino acid
  Variant (13)..(13): Xaa in position 13 is any amino acid
  Variant (14)..(14): Xaa in position 14 is Gly or Ala
  Variant (15)..(15): Xaa in position 15 is His or Asn
  Variant (16)..(18): Xaa in position 16 to 18 is any amino acid
  Variant (19)..(19): Xaa in position 19 is Leu, Ile, Val, Met or Phe
  Variant (20)..(20): Xaa in position 20 is any amino acid
  Variant (21)..(21): Xaa in position 21 is Gln or Pro
  Variant (22)..(22): Xaa in position 22 is any amino acid
  Variant (23)..(23): Xaa in position 23 is Lys or Arg
  Variant (24)..(25): Xaa in position 24 to 25 is any amino acid
  Variant (26)..(26): Xaa in position 26 is Phe, Gly, Ile or Val
  Variant (27)..(28): Xaa in position 27 to 28 is any amino acid
  Variant (29)..(36): Xaa in position 29 to 36 is any or no amino acid
  Variant (37)..(37): Xaa in position 37 is Leu or Val
  Variant (38)..(38): Xaa in position 38 is Ile, Val, Leu, Phe or Tyr
  Variant (39)..(39): Xaa in position 39 is Val, Cys, Ala or Ile
  Variant (41)..(41): Xaa in position 41 is Val, Cys, Ile or Leu
  Variant (42)..(43): Xaa in position 42 to 43 is any amino acid
  Variant (44)..(44): Xaa in position 44 is Asp or Ser
  Variant (45)..(46): Xaa in position 45 to 46 is any amino acid
  Variant (47)..(47): Xaa in position 47 is Thr, Ile, Ala or Leu
  Variant (48)..(50): Xaa in position 48 to 50 is any amino acid
  Variant (51)..(51): Xaa in position 51 is Lys or Gly
  Variant (52)..(52): Xaa in position 52 is Gly or Ile
  Variant (53)..(53): Xaa in position 53 is any amino acid
  Variant (54)..(54): Xaa in position 54 is any or no amino acid
  Variant (55)..(55): Xaa in position 55 is Thr, Pro or Leu
  Variant (56)..(56): Xaa in position 56 is Val or Ile
  Variant (57)..(60): Xaa in position 57 to 60 is any amino acid
  Variant (61)..(61): Xaa in position 61 is Glu or Gln
  Variant (63)..(65): Xaa in position 63 to 65 is any amino acid
  Variant (66)..(66): Xaa in position 66 is Val, Ile, Leu, Ala or Thr
  Variant (67)..(69): Xaa in position 67 to 69 is any amino acid
  Variant (70)..(70): Xaa in position 70 is Lys or Arg
  Variant (71)..(71): Xaa in position 71 is Trp or Tyr
  Variant (72)..(72): Xaa in position 72 is Val or Cys
  Variant (73)..(73): Xaa in position 73 is Asp, Ser or Thr
  Variant (74)..(74): Xaa in position 74 is Glu, Gln, Asp or Lys
  Variant (75)..(75): Xaa in position 75 is Val, Ile or Ser
  Variant (76)..(76): Xaa in position 76 is Ile, Val, Leu or Tyr
  Variant (77)..(78): Xaa in position 77 to 78 is any amino acid
  Variant (79)..(79): Xaa in position 79 is Ala or Val
  Variant (81)..(81): Xaa in position 81 is Trp, Tyr or Phe
  Variant (82)..(87): Xaa in position 82 to 87 is any amino acid
  Variant (88)..(88): Xaa in position 88 is Leu, Met, Ile or Val
  Variant (89)..(98): Xaa in position 89 to 98 is any or no amino acid
  Variant (99)..(99): Xaa in position 99 is Tyr, Phe, Ile or no amino acid
  Variant (100)..(100): Xaa in position 100 is any or no amino acid
  Variant (101)..(101): Xaa in position 101 is Ala, Val, Ile or no amino acid
  Variant (102)..(102): Xaa in position 102 is His or no amino acid
  Variant (103)..(103): Xaa in position 103 is Asp, Gly or no amino acid
  Variant (104)..(104): Xaa in position 104 is any or no amino acid
  Variant (105)..(105): Xaa in position 105 is Asp, Ile, Leu or no amino acid
  Variant (106)..(106): Xaa in position 106 is Pro, Ile or no amino acid
  Variant (107)..(109): Xaa in position 107 to 109 is any amino acid
  Variant (110)..(115): Xaa in position 110 to 115 is any or no amino acid
  Variant (116)..(116): Xaa in position 116 is Asp, Ala, Cys or Lys
  Variant (117)..(117): Xaa in position 117 is any amino acid
  Variant (118)..(118): Xaa in position 118 is Tyr or Pro
  Variant (119)..(121): Xaa in position 119 to 121 is any amino acid
  Variant (122)..(122): Xaa in position 122 is Lys, Arg, Gln or Glu
  Variant (123)..(124): Xaa in position 123 to 124 is any amino acid
  Variant (125)..(125): Xaa in position 125 is Gly, Asn, Gln or Asp
  Variant (126)..(126): Xaa in position 126 is any amino acid
  Variant (127)..(127): Xaa in position 127 is Phe, Tyr or Leu
  Variant (128)..(131): Xaa in position 128 to 131 is any amino acid
  Variant (132)..(132): Xaa in position 132 is Arg or Lys
  Variant (133)..(133): Xaa in position 133 is Thr, Ser or Lys
  Variant (134)..(134): Xaa in position 134 is any amino acid
  Variant (135)..(135): Xaa in position 135 is Gly, His or Ser
  Variant (136)..(136): Xaa in position 136 is Val, Ile or Met
  Variant (137)..(137): Xaa in position 137 is Ser or Glu
  Variant (138)..(138): Xaa in position 138 is Thr or Ser
  Variant (139)..(139): Xaa in position 139 is Ser, Thr or Asp
  Variant (140)..(140): Xaa in position 140 is Asp, Glu, Gly or Thr
  Variant (141)..(141): Xaa in position 141 is Ile, Leu, Ser or Val
  Variant (142)..(142): Xaa in position 142 is Ile, Val or Leu
  Variant (143)..(143): Xaa in position 143 is any amino acid
  Variant (144)..(144): Xaa in position 144 is Arg or Lys
  Variant (145)..(145): Xaa in position 145 is Ile, Met or Leu
  Variant (146)..(146): Xaa in position 146 is Met, Leu, Ile or Val

SEQ ID NO: 108423 - DNA, 993 bp, Brassica napus
  CDS (85)..(837)
gaattcccgggtcgaccgagcaagaatcaaagaagaggcgatcagagatcgaaagctgtcccttcctctcaggtttgttagaagatgtctcgaagatatgatagccgcaccacaatcttctccccagaaggccgtctctaccaagtcgagtacgccatggaggccattggcaacgccggctccgccatcggtatcttatccaaagacggcgtcgttttaatcggcgagaagaaagtcacctccaagcttctccaaacctccacctcctctgagaaaatgtacaagatcgacgaccacgtcgcctgtgctgtcgctggtatcatgtctgacgccaacatcctcatcaacactgctagagtccaagctcaacgctacaccttcatgtaccaggagcccatgcctgttgagcagcttgttcagtctctctgtgatacaaagcaagggtacacgcagttcggtggtcttcgtccctttggagtttcgtttctttttgcagggtgggacaagaaccatgggtttcagctgtatatgagtgaccccagtgggaactacggtggctggaaagctgcggctgtgggagctaacaaccaggcggctcagtctattctgaaacaagattacaaggatgatgcaactagagaagaggcggtggagcttgctctgaaggttttgagcaagaccatggacagcactagcttgacgtcggagaagcttgagcttgctgaggtgtttctgacaccgtcagggagtgttaagtaccatgttcactctcctgactcgctcaccaagctgttggtgaagcacggtgtgactcagcccgctgctgaatcatcctaaactgttgtcagagtcttgatctctgcctggtgctgtgtcccctttatctatcttgttagttctctgtttcacagctttcatttttagtttgatgtttttattagactatgacgatgaaactgaaatttcacaatgttatgagaaaaaaaaaaaaaa

SEQ ID NO: 108424 - protein, 250 aa, Brassica napus
MSRRYDSRTTIFSPEGRLYQVEYAMEAIGNAGSAIGILSKDGVVLIGEKKVTSKLLQTSTSSEKMYKIDDHVACAVAGIMSDANILINTARVQAQRYTFMYQEPMPVEQLVQSLCDTKQGYTQFGGLRPFGVSFLFAGWDKNHGFQLYMSDPSGNYGGWKAAAVGANNQAAQSILKQDYKDDATREEAVELALKVLSKTMDSTSLTSEKLELAEVFLTPSGSVKYHVHSPDSLTKLLVKHGVTQPAAESS

SEQ ID NO: 108425 - DNA, 1016 bp, Brassica napus
  CDS (85)..(837)
acacatctttggtctggagcaaattctcagcgaaaaagagatcaaaatcaaagtcctttcagctctctctcaaaagtcaaaaacatgtctcgaagatacgatagccgcacgacaatcttctccccagaagggcgtctctaccaagtcgagtacgcaatggaagccatcggcaacgccggctccgccatcggtatcttatccaaagacggcgtcgttctgatcggcgagaagaaagtcacctccaagcttctccaaacctccacctcctccgagaagatgtacaagatcgacgaccacgtggcctgcgccgtcgccggcatcatgtccgacgcaaacatcctcatcaacacggctcgtgtccaagcccagcgctacaccttcatgtaccaggagcctatgcctgttgagcagctggttcagtctctctgcgacaccaagcaagggtacacccagttcggtggtcttcgtccctttggagtgtcctttctctttgccgggtgggataagaaccatgggtttcagctgtatatgagtgatccgagtgggaactacggtgggtggaaagctgcagctgtgggagcgaacaaccaggcggctcagtctattctgaaacaagactacaaggaggatgcaactagagaagaggcggtcgagctcgccttgaaggttctgagcaagactatggacagcacgagcttgacatctgagaagcttgagcttgctgaggtgtttttgactccgtcggggagtgttaagtaccatgttcactctcctgactcgcttaccaagctgttgctcaagcatggtgtgactcaacctgctgctgaatcttcctgagcacaaaactatgtccgagttgtctcatctctgcttggtgctattattatatctcctcccatctatcttgttagttctctgtttttaatctctcatgtttagtttgatgtttaattaacaatggcgatgaaactagaattttatctgaaggtactttgaattgagaaaaaaaaaaaaaa

SEQ ID NO: 108426 - protein, 250 aa, Brassica napus
MSRRYDSRTTIFSPEGRLYQVEYAMEAIGNAGSAIGILSKDGVVLIGEKKVTSKLLQTSTSSEKMYKIDDHVACAVAGIMSDANILINTARVQAQRYTFMYQEPMPVEQLVQSLCDTKQGYTQFGGLRPFGVSFLFAGWDKNHGFQLYMSDPSGNYGGWKAAAVGANNQAAQSILKQDYKEDATREEAVELALKVLSKTMDSTSLTSEKLELAEVFLTPSGSVKYHVHSPDSLTKLLLKHGVTQPAAESS

SEQ ID NO: 108427 - DNA, 1018 bp, Brassica napus
  CDS (10)..(762)
gtttccaacatgtctcggaggtatgacagtcgcaccaccatcttctcaccggaaggtcgtctctaccaagttgagtacgctatggaagccattggcaacgctggctccgctattggaatcttggccaaagacggagttgtcctgattggtgaaaagaaagtcacctctaagcttcttcaaacctccacatccgctgagaaaatgtacaagatcgatgaccacgtggcctgtgctgtcgctggtatcatgtctgacgccaacattctcatcaacaccgctcgagtccaagctcagcgttacaccttcatgtaccaagagcctatgccggttgagcagctggttcagtctctatgtgataccaagcaagggtacacacagtttggtggtcttcgtccctttggagtttcttttctttttgcaggatgggacaagaaccatgggtttcaactctatatgagtgacccgagtgggaactacggtggatggaaagctgctgccgttggtgctaataatcaagctgctcagtctattcttaagcaagactacaaggatgatgcgtccagggaagaggtggttgagctcgctctcaaggttttgagcaagacgatggacagcacgagcttgacatctgagaagctcgagcttgctgaggtgtttctgactccatcagggagtgttcagtaccatgttcactcgcctgactctctcactaagcttttggttaagcatggtgtgacgcaaccagctgcagaaactccctaagcttgaaaccactagacttgtacggtaatcgacattctgtgtttgtggtttcccatttgcttttttttcctttggacttgaagatactgtctcggaatcaattactactctggttgtgtcatgaagttatatgttgttatgaatcgaatctgagcacttttatttttgcaatcctgttttgtccgtttctccacaaatgaatttcacatcaaaatgataaatgcaatgtattgtttttcgccaaaaaaaaaaaaaa

SEQ ID NO: 108428 - protein, 250 aa, Brassica napus
MSRRYDSRTTIFSPEGRLYQVEYAMEAIGNAGSAIGILAKDGVVLIGEKKVTSKLLQTSTSAEKMYKIDDHVACAVAGIMSDANILINTARVQAQRYTFMYQEPMPVEQLVQSLCDTKQGYTQFGGLRPFGVSFLFAGWDKNHGFQLYMSDPSGNYGGWKAAAVGANNQAAQSILKQDYKDDASREEVVELALKVLSKTMDSTSLTSEKLELAEVFLTPSGSVQYHVHSPDSLTKLLVKHGVTQPAAETP

SEQ ID NO: 108429 - DNA, 1039 bp, Glycine max
  CDS (84)..(836)
cctcacttcgtttccgtcgcagctttttacacactccaccgctgcttccccttcacctccgatttcgttaatcagagatcaaaatgtctcgaagatatgacagccgtacaacaatcttctccccggaaggacgtctttaccaagtggaatatgcaatggaggctattgggaatgctggtaccgcaatagggatcttatcaaaagatggggtagtgctggttggtgaaaagaaggtcacatccaagctgctccaaacctcaacttccaccgagaaaatgtacaagattgatgatcatgttgcatgcgctgtggctgggataatgtctgatgccaacatcctaatcaataccgcaagggtccaagcccaacgctacacatacgcctatcaagagcccatgccagttgagcagttagttcagtctctctgcgataccaagcaaggttacacccaattcggtggtcttcggccatttggagtttcgttcctatttgcaggatgggacaaaaactttggctttcagctttacatgagcgaccctagtggaaattatggtggctggaaagctggagccattggggcaaataaccaggcagcacaatcaatactgaaacaggactacaaggatgacatcacaagagaagaagcagtacaacttgcattgaaggtgttaagtaaaaccatggacagcacaagtctaacctcagaaaagcttgaacttgcagaggttttcctttcaccctctgggaaagtcaagtatgaagtttgctccccagaggccctgactaagatgttggtgaagtctggtgttacccaacctgcaacagacactgcctagtttgctattccatgcctggtgcactttaattatccctatcttatttatttgtggtgcttttggcattagaagacagatattggctcaaacatttttcaagcttaaacattttgcatgttggtaatgctaatggctttgtattgggtacatcttgattttaaagagagattgatggtatgcgttctatttaaaaaaaaaaaaaa

SEQ ID NO: 108430 - protein, 250 aa, Glycine max
MSRRYDSRTTIFSPEGRLYQVEYAMEAIGNAGTAIGILSKDGVVLVGEKKVTSKLLQTSTSTEKMYKIDDHVACAVAGIMSDANILINTARVQAQRYTYAYQEPMPVEQLVQSLCDTKQGYTQFGGLRPFGVSFLFAGWDKNFGFQLYMSDPSGNYGGWKAGAIGANNQAAQSILKQDYKDDITREEAVQLALKVLSKTMDSTSLTSEKLELAEVFLSPSGKVKYEVCSPEALTKMLVKSGVTQPATDTA

SEQ ID NO: 108431 - DNA, 1129 bp, Glycine max
  CDS (86)..(835)
agcgaaaaagaaaaggcttgacttgagagaaatagagcttcgaatcgaaactcagaattagaaaaaaacacaaatcacaatcacaatggcaaggtacgaccgagcaatcaccgttttctcccccgacggccacctcttccaggtcgagtatgccctcgaagccgtccgcaagggcaacgccgccgtcggcgtccgcggcaccgacaacgtcgtcctcggcgtcgagaagaaatccaccgccaagctccaagactccaggtcggtgaggaagattgtgaatctggacaaccacattgcgctggcatgcgcggggctgaaggccgacgcacgtgtgctcataaacagggcacgtgtggagtgccagagccacaggctcaccgtggaggatcccgtcacggttgagtacataacgcggtacattgctgggctccagcagaagtacacgcagagcggcggtgtgcgaccctttgggctttcgactctcattgtcgggtttgatccctacactggctcgccctccttgtaccagacggatccctctggcaccttctcggcgtggaaggcgaacgccaccgggaggaactcaaattcgattagggagttcctcgagaagaactataaggacacctctggccaggagactgtcaagttggctattcgcgcattgcttgaagttgtggagagcggaggcaagaacatagaagttgctgtgatgactaaggagcatggtctgcatcaactggaggaagctgaaattgatgccatcgttgctgagattgaagcagagaaagcagctgctgaggctgctaagaaagcccctcctaaggagacataattttctgttttgtgttacgcggggcattgttcttgctacgtgttggctgtactcactgaagctaaaattgatgccattgtgtctaaagattgaaacagagaaaacggctgccgaggctgcaaagaataccctttctaaggagacatgattttattttacttctgtttagctcgtgaattgttcttgctagatgttggcctaacttaaaacaactgctttattgtttttgggtactgtcatatagtgtttggtcaaattaattgcatgtcattattattcgaaaaaaaaaaaaaa

SEQ ID NO: 108432 - protein, 249 aa, Glycine max
MARYDRAITVFSPDGHLFQVEYALEAVRKGNAAVGVRGTDNVVLGVEKKSTAKLQDSRSVRKIVNLDNHIALACAGLKADARVLINRARVECQSHRLTVEDPVTVEYITRYIAGLQQKYTQSGGVRPFGLSTLIVGFDPYTGSPSLYQTDPSGTFSAWKANATGRNSNSIREFLEKNYKDTSGQETVKLAIRALLEVVESGGKNIEVAVMTKEHGLHQLEEAEIDAIVAEIEAEKAAAEAAKKAPPKET

SEQ ID NO: 108433 - DNA, 931 bp, Triticum aestivum
  CDS (56)..(805)
ccgccgcccgggaagcccaaaccaaaccctaagcctccgcgaccggccgccggcgatggcccgctacgaccgcgcgatcaccgtcttctcccccgacggccacctcttccaggtcgagtacgccctcgaggccgtccgcaagggcaacgctgccgtcggcgtccgcggcaccgacaccgtcgtcctcggcgtcgagaagaagtccacccccaagctccaggactccaggtccgtgcggaagatcgcgagcctggacacgcacgtcgcgctggcgtgcgcggggctcaaggcggacgcgcgggtgctcatcaaccgcgcccgcgtcgagtgccagagccaccgcctcaccgtcgaggaccccgtcaccgtcgagtacatcactcgctacatcgccggcctgcagcagaagtacacccagagcggtggagtccgccccttcggcctatccaccctcatcgtcggcttcgatccgtacacggacaagcccgccctgtaccagaccgacccctccggcaccttctccgcctggaaggccaacgccacggggaggaactccaactccatgcgggagttcctggagaagaactacaaggacacctccggcaaggagaccatcaagctcaccatccgcgctctgctagaggttgtcgagagtggtgggaagaacatagagattgcagtgatgacaaagaaggatggccttcggcaactcgaggagactgaaatcgatgaatatgttgccgagatcgaggcagagaaggccgcggcagaggcggcaaagaagagtggcccgaaggatacctaattactggatgtgctatatcttcagtctgtcagccgaaaccttttagtgtgtcacctgttacgctacataactttctttaaactgctttaacaagatattgaagtcgttcgcaaaaaaaaaaaaaaa

SEQ ID NO: 108434 - protein, 249 aa, Triticum aestivum
MARYDRAITVFSPDGHLFQVEYALEAVRKGNAAVGVRGTDTVVLGVEKKSTPKLQDSRSVRKIASLDTHVALACAGLKADARVLINRARVECQSHRLTVEDPVTVEYITRYIAGLQQKYTQSGGVRPFGLSTLIVGFDPYTDKPALYQTDPSGTFSAWKANATGRNSNSMREFLEKNYKDTSGKETIKLTIRALLEVVESGGKNIEIAVMTKKDGLRQLEETEIDEYVAEIEAEKAAAEAAKKSGPKDT

SEQ ID NO: 108435 - DNA, 963 bp, Hordeum vulgare
  CDS (65)..(814)
accaccacctccgccgccgggaagcccaaaccaaaccctaagcctcaccgaccggccgccggcgatggcccgctacgaccgcgcgatcacggtcttctcccccgacggccacctcttccaggtcgagtacgccctcgaggccgtccgcaagggcaacgccgccgtcggcgtccgcggcaccgacaccgtcgtcctcggcgtcgagaagaagtccacccccaagctccaggactccaggtccgtgcggaagatcgcgagcctggacacgcacgtcgcgctggcgtgcgcggggctcaaggcggacgcgcgggtgctcatcaaccgcgcgcgcgtcgagtgccagagccaccgcctcaccgtcgaggaccccgtcaccgtcgagtacatcacccgctacatcgccggcctgcagcagaagtacacccagagcggcggagtccgccccttcggcctctccaccctcatcgtcggcttcgatccgtacacggacaagcccgccctgtaccagaccgacccctccggcaccttctccgcctggaaggccaacgccacggggaggaactccaactccatgagggagttcctggagaagaactacaaggacacctccggcaaggagaccatcaagctcaccatccgagcccttctagaggttgttgagagtggcgggaagaacatcgagatcgcagtgatgacaaagaaggatggccttcggcaacttgaggagactgaaatcgatgaatatgttgcggagattgaggcagagaaggccgcggcagaggcggcaaagaagagtggcccgaaggacacctaattactggatgtgctatatcttcattctgtcagccgaaaccttttagcgtgtcacctgttacgttccataactttatttgaaccgctttaacaagatatcgaagtcattcgtaaatgaattgccttgttttcttgaaaaaaaaaaaaaaa

SEQ ID NO: 108436 - protein, 249 aa, Hordeum vulgare; identical to SEQ ID NO: 108434

SEQ ID NO: 108437 - DNA, 22 bp, Artificial sequence
  primer
atgtctcgaagatatgatagcc

SEQ ID NO: 108438 - DNA, 21 bp, Artificial sequence
  primer
ttaggatgattcagcagcggg

SEQ ID NO: 108439 - protein, 258 aa, Artificial sequence
  consensus sequence
  Variant (3)..(7): Xaa in position 3 to 7 is any amino acid
  Variant (11)..(11): Xaa in position 11 is any amino acid
  Variant (13)..(13): Xaa in position 13 is any amino acid
  Variant (15)..(15): Xaa in position 15 is any amino acid
  Variant (21)..(22): Xaa in position 21 to 22 is any amino acid
  Variant (24)..(32): Xaa in position 24 to 32 is any amino acid
  Variant (34)..(51): Xaa in position 34 to 51 is any amino acid
  Variant (53)..(86): Xaa in position 53 to 86 is any amino acid
  Variant (88)..(90): Xaa in position 88 to 90 is any amino acid
  Variant (92)..(99): Xaa in position 92 to 99 is any amino acid
  Variant (101)..(138): Xaa in position 101 to 138 is any amino acid
  Variant (140)..(144): Xaa in position 140 to 144 is any amino acid
  Variant (147)..(147): Xaa in position 147 is any amino acid
  Variant (149)..(154): Xaa in position 149 to 154 is any amino acid
  Variant (156)..(156): Xaa in position 156 is any amino acid
  Variant (158)..(199): Xaa in position 158 to 199 is any amino acid
  Variant (201)..(204): Xaa in position 201 to 204 is any amino acid
  Variant (208)..(213): Xaa in position 208 to 213 is any amino acid
  Variant (215)..(217): Xaa in position 215 to 217 is any amino acid
  Variant (219)..(257): Xaa in position 219 to 257 is any amino acid
YDXXXXXFSPXGXLXQVEYAXXAXXXXXXXXXGXXXXXXXXXXXXXXXXXXLXXXXXXXXXXXXXXXXXXXXXXXXXXXXXXXXXXGXXXDXXXXXXXXRXXXXXXXXXXXXXXXXXXXXXXXXXXXXXXXXXXXXXXTXXXXXRPXGXXXXXXGXDXXXXXXXXXXXXXXXXXXXXXXXXXXXXXXXXXXXXXXXXXXLXXXXPSGXXXXXXAXXXGXXXXXXXXXXXXXXXXXXXXXXXXXXXXXXXXXXXXXXXL

SEQ ID NO: 108440 - protein, 16 aa, Artificial sequence
  protein pattern
  Variant (1)..(1): Xaa in position 1 is Phe, Tyr or Trp
  Variant (2)..(2): Xaa in position 2 is Ser or Thr
  Variant (3)..(3): Xaa in position 3 is Pro, Ser, Glu or Ala
  Variant (4)..(4): Xaa in position 4 is any amino acid
  Variant (6)..(6): Xaa in position 6 is any amino acid
  Variant (7)..(7): Xaa in position 7 is Leu, Val or Ile
  Variant (8)..(8): Xaa in position 8 is any amino acid
  Variant (10)..(10): Xaa in position 10 is Val, Ile or Leu
  Variant (11)..(11): Xaa in position 11 is Glu, Asp, Asn or Arg
  Variant (12)..(12): Xaa in position 12 is Tyr, His or Phe
  Variant (13)..(13): Xaa in position 13 is Ala, Gly, Ile or Ser
  Variant (14)..(15): Xaa in position 14 to 15 is any amino acid
  Variant (16)..(16): Xaa in position 16 is Ala, Ser or Gly
XXXXGXXXQXXXXXXX

SEQ ID NO: 108441 - protein, 77 aa, Artificial sequence
  protein pattern
  Variant (1)..(1): Xaa in position 1 is Arg or Pro
  Variant (2)..(2): Xaa in position 2 is Pro or Ser
  Variant (7)..(7): Xaa in position 7 is Gly or Ala
  Variant (8)..(10): Xaa in position 8 to 10 is any amino acid
  Variant (11)..(11): Xaa in position 11 is Leu, Ile, Val, Met or Thr
  Variant (12)..(13): Xaa in position 12 to 13 is any amino acid
  Variant (14)..(14): Xaa in position 14 is Gly, Ser or Ala
  Variant (15)..(20): Xaa in position 15 to 20 is any amino acid
  Variant (21)..(58): Xaa in position 21 to 58 is any or no amino acid
  Variant (59)..(59): Xaa in position 59 is Leu, Ile or Val
  Variant (60)..(60): Xaa in position 60 is Tyr, Phe or Trp
  Variant (61)..(63): Xaa in position 61 to 63 is any amino acid
  Variant (64)..(64): Xaa in position 64 is Pro or Ala
  Variant (65)..(65): Xaa in position 65 is Ser, Ala or Gly
  Variant (66)..(66): Xaa in position 66 is Gly or Ala
  Variant (67)..(72): Xaa in position 67 to 72 is any amino acid
  Variant (73)..(73): Xaa in position 73 is Ala or Gly
  Variant (74)..(76): Xaa in position 74 to 76 is any amino acid
XXFYLMXXXXXXXXXXXXXXXXXXXXXXXXXXXXXXXXXXXXXXXXXXXXXXXXXXXXXXXXXXXXXXXXXXXXXXG

SEQ ID NO: 108442 - DNA, 246 bp, Zea mays
  CDS (1)..(246)
atgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggcgacgcagacagctccttggacaggctgtggcagaagaagaaggctgatatcaagcagtag

SEQ ID NO: 108443 - protein, 81 aa, Zea mays
MQNEEGKTVDLYVPRKCSATNRIITAKDHASVQINIGHLDANGLYDGHFTTFALSGFVRAQGDADSSLDRLWQKKKADIKQ

SEQ ID NO: 108444 - DNA, 246 bp, Zea mays; identical to SEQ ID NO: 68647
  CDS (1)..(246)

SEQ ID NO: 108445 - protein, 81 aa, Zea mays; identical to SEQ ID NO: 68648

SEQ ID NO: 108446 - DNA, 246 bp, Zea mays; identical to SEQ ID NO: 108442
  CDS (1)..(246)

SEQ ID NO: 108447 - protein, 81 aa, Zea mays; identical to SEQ ID NO: 108443

SEQ ID NO: 108448 - DNA, 21 bp, Artificial sequence
  primer
atgcagaacgaggagggtaag

SEQ ID NO: 108449 - DNA, 22 bp, Artificial sequence
  primer
ctactgcttgatatcagccttc

SEQ ID NO: 108450 - protein, 76 aa, Artificial sequence; identical to SEQ ID NO: 13766
  consensus sequence
  Variant (2)..(2): Xaa in position 2 is any amino acid
  Variant (4)..(5): Xaa in position 4 to 5 is any amino acid
  Variant (7)..(8): Xaa in position 7 to 8 is any amino acid
  Variant (13)..(13): Xaa in position 13 is any amino acid
  Variant (20)..(20): Xaa in position 20 is any amino acid
  Variant (23)..(23): Xaa in position 23 is any amino acid
  Variant (25)..(25): Xaa in position 25 is any amino acid
  Variant (32)..(32): Xaa in position 32 is any amino acid
  Variant (34)..(38): Xaa in position 34 to 38 is any amino acid
  Variant (41)..(57): Xaa in position 41 to 57 is any amino acid
  Variant (59)..(60): Xaa in position 59 to 60 is any amino acid
  Variant (62)..(63): Xaa in position 62 to 63 is any amino acid
  Variant (65)..(66): Xaa in position 65 to 66 is any amino acid
  Variant (68)..(69): Xaa in position 68 to 69 is any amino acid
  Variant (71)..(74): Xaa in position 71 to 74 is any amino acid

SEQ ID NO: 108451 - protein, 33 aa, Artificial sequence; identical to SEQ ID NO: 228
  protein pattern
  Variant (2)..(11): Xaa in position 2 to 11 is any amino acid
  Variant (13)..(13): Xaa in position 13 is any amino acid
  Variant (15)..(15): Xaa in position 15 is any amino acid
  Variant (19)..(28): Xaa in position 19 to 28 is any amino acid
  Variant (30)..(32): Xaa in position 30 to 32 is any amino acid

SEQ ID NO: 108452 - DNA, 1566 bp, Glycine max
  CDS (1)..(1566)
atgttgctggaacttgcacttggtttgtttgtgttagctttgtttctgcacttgcgtcccacaccaagtgcaaaatcaaaagcacttcgccacctcccaaaccctccaagcccaaagcctcgtcttcccttcattggccaccttcacctcttaaaagataaacttctccactatgcactcatcgatctctccaaaaagcatggccccttattctctctctccttcggctccatgccaaccgtcgttgcctccacccctgagttgttcaagctcttcctccaaacccacgaggcaacttccttcaacacaaggttccaaacctctgccataagacgcctcacttacgacaactctgtggccatggttccattcggaccttactggaagttcgtgaggaagctcatcatgaacgaccttctcaacgccaccaccgtcaacaagctcaggcctttgaggacccaacagatccgcaagttccttagggttatggcccaaagcgcagaggcccagaagccccttgacgtcaccgaggagcttctcaaatggaccaacagcaccatctccatgatgatgctcggcgaggctgaggagatcagagacatcgctcgcgaggttcttaagatcttcggcgaatacagcctcactgacttcatctggcctttgaagtatctcaaggttggaaagtatgagaagaggattgatgacatcttgaacaagttcgaccctgtcgttgaaagggtcatcaagaagcgccgtgagatcgtcagaaggagaaagaacggagaagttgttgagggcgaggtcagcggggttttccttgacactttgcttgaattcgctgaggatgagaccatggagatcaaaatcaccaaggaccacatcaagggtcttgttgtcgactttttctcggcaggaacagactccacagcggtggcaacagagtgggcattggcagaactcatcaacaatcctaaggtgttggaaaaggctcgtgaggaggtctacagtgttgtgggaaaggacagacttgtggacgaagttgacactcaaaaccttccttacattagagcaatcgtgaaggagacattccgcatgcacccgccactcccagtggtcaaaagaaagtgcacagaagagtgtgagattaatggatatgtgatcccagagggagcattgattctcttcaatgtatggcaagtaggaagagaccccaaatactgggacagaccatcggagttccgtcctgagaggttcctagagacaggggctgaaggggaagcagggcctcttgatcttaggggacaacattttcaacttctcccatttgggtctgggaggagaatgtgccctggagtcaatctggctacttcgggaatggcaacacttcttgcatctcttattcagtgcttcgacttgcaagtgctgggtccacaaggacagatattgaagggtggtgacgccaaagttagcatggaagagagagccggcctcactgttccaagggcacatagtcttgtctgtgttccacttgcaaggatcggcgttgcatctaaactcctttcttaa

SEQ ID NO: 108453 - protein, 521 aa, Glycine max
MLLELALGLFVLALFLHLRPTPSAKSKALRHLPNPPSPKPRLPFIGHLHLLKDKLLHYALIDLSKKHGPLFSLSFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEAGPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 108454 - DNA, 1566 bp, Glycine max
  CDS (1)..(1566)
atgttgcttgaacttgcacttggtttattggttttggctctgtttctgcacttgcgtcccacacccactgcaaaatcaaaagcacttcgccatctcccaaacccaccaagcccaaagcctcgtcttcccttcataggacaccttcatctcttaaaagacaaacttctccactacgcactcatcgacctctccaaaaaacatggtcccttattctctctctactttggctccatgccaaccgttgttgcctccacaccagaattgttcaagctcttcctccaaacgcacgaggcaacttccttcaacacaaggttccaaacctcagccataagacgcctcacctatgatagctcagtggccatggttcccttcggaccttactggaagttcgtgaggaagctcatcatgaacgaccttctcaacgccaccactgtaaacaagttgaggcctttgaggacccaacagatccgcaagttccttagggttatggcccaaggcgcagaggcacagaagccccttgacttgaccgaggagcttctgaaatggaccaacagcaccatctccatgatgatgctcggcgaggctgaggagatcagagacatcgctcgcgaggttcttaagatctttggcgaatacagcctcactgacttcatctggccattgaagcatctcaaggttggaaagtatgagaagaggatcgacgacatcttgaacaagttcgaccctgtcgttgaaagggtcatcaagaagcgccgtgagatcgtgaggaggagaaagaacggagaggttgttgagggtgaggtcagcggggttttccttgacactttgcttgaattcgctgaggatgagaccatggagatcaaaatcaccaaggaccacatcaagggtcttgttgtcgactttttctcggcaggaacagactccacagcggtggcaacagagtgggcattggcagaactcatcaacaatcctaaggtgttggaaaaggctcgtgaggaggtctacagtgttgtgggaaaggacagacttgtggacgaagttgacactcaaaaccttccttacattagagcaatcgtgaaggagacattccgcatgcacccgccactcccagtggtcaaaagaaagtgcacagaagagtgtgagattaatggatatgtgatcccagagggagcattgattctcttcaatgtatggcaagtaggaagagaccccaaatactgggacagaccatcggagttccgtcctgagaggttcctagagacaggggctgaaggggaagcagggcctcttgatcttaggggacaacattttcaacttctcccatttgggtctgggaggagaatgtgccctggagtcaatctggctacttcgggaatggcaacacttcttgcatctcttattcagtgcttcgacttgcaagtgctgggtccacaaggacagatattgaagggtggtgacgccaaagttagcatggaagagagagccggcctcactgttccaagggcacatagtcttgtctgtgttccacttgcaaggatcggcgttgcatctaaactcctttcttaa

SEQ ID NO: 108455 - protein, 521 aa, Glycine max
MLLELALGLLVLALFLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEAGPLDLRGQHFQLLPFGSGRRMCPGVNLATSGMATLLASLIQCFDLQVLGPQGQILKGGDAKVSMEERAGLTVPRAHSLVCVPLARIGVASKLLS

SEQ ID NO: 108456 - DNA, 1584 bp, Zea mays
  CDS (1)..(1584)
atggcgacctgcgttctgctgatgctgcgggaagtctctccgtgggcgctggccagcgtggtggcgtccgtgtcgctgttgtggctggtggtctggacgctggagtgggcctggtggacgccttggcggctcgagcgggccctgcgggtccagggcctcaagggcaccaggtaccgcctcttcaccggcgacctgagggaaaccgcccgggctaaccgggaggctcgcaagaagccgctgccgctcggcagccacgacatcgccccacgcgtgcagcccatgcatcacagcaccatcaaggaatacgggaaactatcgttcacctggttcggcccaacaccaagggtgatgattcctgacccagagttagtcaaagaggtgctgtctaataagtttggccactttggcaaaccaaggagtaaccgcattgggaggttgctagccaacgggcttgtaaatcatgatggtgaaaaatgggcaaagcacaggagaattcttaatcctgcatttcaccatgaaaaaataaaggggatgatgccagtattttctacctgctgtattgaaatgattactagatgggataattcaatgccttctgagggatcttctgagatagatgtctggcctgagttccagaatcttactggagatgttatctcaagaactgcgtttgggagcaactatcaagaagggaggagaattttcgagctgcaaggagaactagctgaacgcctcatccaatctgttcagacaatatttatcccaggctattggttcttgcccaccaaaaacaacagaaggatgagagcgatcgatgtagagatccgcaaaattctccgtgaaataattgggaagagagagaaggatactaaaaacagagaaacaaataacgacgacttgctgggcttattactggagtcaaacacaaggcaatcaaatggaaatgcaagcctgggattgacaacagaagatgtgattgaggaatgcaagttattttactttgcaggtatggagacaacatcagtccttcttacttggacacttattgtgctaagcatgcacccagaatggcaagagagagcaagagaagaggttttgagccactttggaagaaccacaccggattatgatagcttgagccgcctcaagactataaccatgattctacatgaggtccttaggttgtacccaccggcaacctttctaacaagaagaacttataaggaaatggagctcggtggaatcaaatatcctgcaggagttgacctccttctacccgtcatcttcattcaccatgatcctgacatttggggaaaagacgcaagcgagttcaacccagaaaggtttgccaacggcatctccagcgcaaccaggcatcaggctgctttctttccgttcggaggggggcctagaatctgcatcggccagagctttgcgttgctggaagccaagatgacgctatgcaccatcctccaacgcttctcgttcgagctctcgccatcctacacccacgcgccgtacaccgtgataacactgcaccctcaacatggtgctcagataaggctcaaaaagctttctccgtga

SEQ ID NO: 108457 - protein, 527 aa, Zea mays
MATCVLLMLREVSPWALASVVASVSLLWLVVWTLEWAWWTPWRLERALRVQGLKGTRYRLFTGDLRETARANREARKKPLPLGSHDIAPRVQPMHHSTIKEYGKLSFTWFGPTPRVMIPDPELVKEVLSNKFGHFGKPRSNRIGRLLANGLVNHDGEKWAKHRRILNPAFHHEKIKGMMPVFSTCCIEMITRWDNSMPSEGSSEIDVWPEFQNLTGDVISRTAFGSNYQEGRRIFELQGELAERLIQSVQTIFIPGYWFLPTKNNRRMRAIDVEIRKILREIIGKREKDTKNRETNNDDLLGLLLESNTRQSNGNASLGLTTEDVIEECKLFYFAGMETTSVLLTWTLIVLSMHPEWQERAREEVLSHFGRTTPDYDSLSRLKTITMILHEVLRLYPPATFLTRRTYKEMELGGIKYPAGVDLLLPVIFIHHDPDIWGKDASEFNPERFANGISSATRHQAAFFPFGGGPRICIGQSFALLEAKMTLCTILQRFSFELSPSYTHAPYTVITLHPQHGAQIRLKKLSP

SEQ ID NO: 108458 - DNA, 1590 bp, Zea mays
  CDS (1)..(1590)
atggttcttggagcgttggcgagtgcagtcgcctcgatgagcctcctcatcgtctacggtgtcctgggcgctctgctcctgtggaaggccgcccggctgctggatcggctgtggtgggagccgcggcggctggagcgggcgctgcgcgcgcagggcctgcggggcacgtcgtaccgcttcctcacgggcgacctcagggagtaccgccggtcaaaagaggaggcctgggccaggcccctgccgctgcggtgccacgacatcgccggccacgtcgagccgttcatccacggcgccgtcctggagcacggcaagacgtgcttcacctggttcggccccgtccccagggtgaccgtcgtcgacccggacctggcgagggatgtgatggccaacaagttcggccacttcgagaagcccaagttcccggcgctcaccaagctgttctccgacggtgtggccaaccacgaaggcgagaagtgggtcaagcacaggaggatcctcaaccctgcgttccacctcgagaagctcaagctcatgctgccggcgttctctgcgtgctgtgaagagctcgtcagccgatgggcgcagtcgcttggccctgacggctcgtgcgagctggacgtggacccggagcttcagaccctcaccggcgatgtcatctctcgcaccgcgttcggcagcagctacctcgaaggaagaaagattttccagctgcaggccgagcaagctgagcgcctcatgtccatcattgacaaattcgccgttccgggatacatgtccttgcctacgaaaaacaaccgaaggatgcgccaaatcaaaagcgagatcgactcgattcttcggggcctgatcggtaaaagaatgcaagctatgaaacaaggtgagagcgacaaagatgacctgctgggcttactgctggagtcaaacgcgagagagacaggcgatcagagcggccagcccggccaaggattgacgatggaagaagtcatggaggagtgcaagctgttctacttcgcgggaatggagacgacgtcggtgctgctcacgtggacgatggtcctgctaagcatgcacccggagtggcaggaccgtgcgagggaggaagtcctcggactgttcgggaagaagaaccaaccgggatacgacggcctgagtcgcctcaaaacagtgaccatgatcctctacgaggtcctccggctgtacccgccggccatcgcgttcagcaggaaaacgtacaaggagatggtggtcggagacgtcacgtaccctgccggcgtgaccctggagctgcccgtgctgttcatccaccacgaccccgacatctggggaagcgatgcgcacgagttcaggccggagaggttcgccgagggggtggccagggcgtccaaggataggctagcgttcttccccttcggctggggcccgcggatatgcatcggccagaacttcgcccttctggaggccaagatggcgctgagcatgatccttcagcgcttccagttcgagctcgcgccgacgtatacccatgcgccgcgccgagttataatgctgcgcccgatgcatggtgcccagatcaagctcagagcgatatga

SEQ ID NO: 108459 - protein, 529 aa, Zea mays
MVLGALASAVASMSLLIVYGVLGALLLWKAARLLDRLWWEPRRLERALRAQGLRGTSYRFLTGDLREYRRSKEEAWARPLPLRCHDIAGHVEPFIHGAVLEHGKTCFTWFGPVPRVTVVDPDLARDVMANKFGHFEKPKFPALTKLFSDGVANHEGEKWVKHRRILNPAFHLEKLKLMLPAFSACCEELVSRWAQSLGPDGSCELDVDPELQTLTGDVISRTAFGSSYLEGRKIFQLQAEQAERLMSIIDKFAVPGYMSLPTKNNRRMRQIKSEIDSILRGLIGKRMQAMKQGESDKDDLLGLLLESNARETGDQSGQPGQGLTMEEVMEECKLFYFAGMETTSVLLTWTMVLLSMHPEWQDRAREEVLGLFGKKNQPGYDGLSRLKTVTMILYEVLRLYPPAIAFSRKTYKEMVVGDVTYPAGVTLELPVLFIHHDPDIWGSDAHEFRPERFAEGVARASKDRLAFFPFGWGPRICIGQNFALLEAKMALSMILQRFQFELAPTYTHAPRRVIMLRPMHGAQIKLRAI

SEQ ID NO: 108460 - DNA, 22 bp, Artificial sequence
  primer
atgttgctggaacttgcacttg

SEQ ID NO: 108461 - DNA, 22 bp, Artificial sequence
  primer
ttaagaaaggagtttagatgca

SEQ ID NO: 108462 - protein, 40 aa, Artificial sequence; identical to SEQ ID NO: 28591
  consensus sequence
  Variant (1)..(1): Xaa in position 1 is Ile, Leu, Met or Val
  Variant (2)..(7): Xaa in position 2 to 7 is any amino acid
  Variant (8)..(8): Xaa in position 8 is Phe, Leu, Ile, Val or Tyr
  Variant (9)..(9): Xaa in position 9 is Leu, Ile, Met or Phe
  Variant (10)..(10): Xaa in position 10 is any amino acid
  Variant (11)..(11): Xaa in position 11 is Ala, Gly, Glu or Ser
  Variant (12)..(12): Xaa in position 12 is Gly, Ser or Ala
  Variant (13)..(13): Xaa in position 13 is Gln, His, Tyr, Phe, Arg or Lys
  Variant (14)..(14): Xaa in position 14 is Asp, Glu or His
  Variant (15)..(15): Xaa in position 15 is Thr, Ala or Ser
  Variant (16)..(16): Xaa in position 16 is Thr, Ser, Val or Leu
  Variant (17)..(17): Xaa in position 17 is Ser, Ala, Thr or Gly
  Variant (18)..(18): Xaa in position 18 is Ser, Thr, Ala, His or Asn
  Variant (19)..(20): Xaa in position 19 to 20 is any amino acid
  Variant (21)..(21): Xaa in position 21 is Ser, Thr, Cys, Met, Ala or Leu
  Variant (22)..(22): Xaa in position 22 is Trp, Phe, Ser, Met or Leu
  Variant (23)..(26): Xaa in position 23 to 26 is any amino acid
  Variant (27)..(27): Xaa in position 27 is Leu, Val or Ile
  Variant (28)..(30): Xaa in position 28 to 30 is any amino acid
  Variant (31)..(31): Xaa in position 31 is Pro or Thr
  Variant (32)..(33): Xaa in position 32 to 33 is any amino acid
  Variant (34)..(34): Xaa in position 34 is Leu, Gln, Val, Met or Ile
  Variant (35)..(35): Xaa in position 35 is any amino acid
  Variant (36)..(36): Xaa in position 36 is Lys, Arg, Glu, Ala or Asn
  Variant (37)..(37): Xaa in position 37 is Leu, Val, Ile, Cys or Ala
  Variant (38)..(38): Xaa in position 38 is any amino acid
  Variant (39)..(39): Xaa in position 39 is Glu, Ala, Gln, Asp or Lys
  Variant (40)..(40): Xaa in position 40 is Glu or Asp

SEQ ID NO: 108463 - protein, 21 aa, Artificial sequence
  protein pattern
  Variant (1)..(1): Xaa in position 1 is Leu, Ile, Pro, Val or Ala
  Variant (2)..(5): Xaa in position 2 to 5 is any amino acid
  Variant (6)..(6): Xaa in position 6 is Leu, Ile, Val, Met, Tyr or Thr
  Variant (7)..(8): Xaa in position 7 to 8 is any amino acid
  Variant (9)..(9): Xaa in position 9 is Met, Leu or Ile
  Variant (10)..(10): Xaa in position 10 is any amino acid
  Variant (11)..(11): Xaa in position 11 is Tyr, Leu, Phe or Thr
  Variant (12)..(12): Xaa in position 12 is Thr, Leu, Met, His or Ile
  Variant (13)..(14): Xaa in position 13 to 14 is any amino acid
  Variant (15)..(15): Xaa in position 15 is Val, Cys, Ile or Ala
  Variant (16)..(16): Xaa in position 16 is Ile, Val, Ala or Leu
  Variant (17)..(17): Xaa in position 17 is any amino acid
  Variant (19)..(19): Xaa in position 19 is Thr, Ser, Val, Ala or Cys
  Variant (20)..(20): Xaa in position 20 is Leu, Val, Ser or Met
XXXXXXXXXXXXXXXXXEXXR

SEQ ID NO: 108464 - protein, 33 aa, Artificial sequence; identical to SEQ ID NO: 28593
  protein pattern
  Variant (1)..(1): Xaa in position 1 is Ile, Val, Ala or Leu
  Variant (3)..(3): Xaa in position 3 is Lys, Ala or Thr
  Variant (4)..(4): Xaa in position 4 is Gly, Asp or Ser
  Variant (5)..(6): Xaa in position 5 to 6 is any amino acid
  Variant (7)..(7): Xaa in position 7 is Val, Ile, Leu or Cys
  Variant (8)..(14): Xaa in position 8 to 14 is any amino acid
  Variant (15)..(15): Xaa in position 15 is His, Leu, Ser, Asn, Gln or Gly
  Variant (16)..(18): Xaa in position 16 to 18 is any amino acid
  Variant (19)..(20): Xaa in position 19 to 20 is any or no amino acid
  Variant (21)..(21): Xaa in position 21 is Tyr, Phe or Trp
  Variant (22)..(23): Xaa in position 22 to 23 is any amino acid
  Variant (24)..(24): Xaa in position 24 is any or no amino acid
  Variant (25)..(25): Xaa in position 25 is Pro, Ala, Lys or Val
  Variant (26)..(27): Xaa in position 26 to 27 is any amino acid
  Variant (28)..(28): Xaa in position 28 is Phe, Tyr or Trp
  Variant (29)..(29): Xaa in position 29 is any amino acid
  Variant (31)..(31): Xaa in position 31 is any amino acid
  Variant (33)..(33): Xaa in position 33 is Phe or Trp

SEQ ID NO: 108465 - protein, 25 aa, Artificial sequence
  protein pattern
  Variant (1)..(1): Xaa in position 1 is Phe, Tyr or Trp
  Variant (2)..(2): Xaa in position 2 is Leu, Met, Ile or Phe
  Variant (3)..(3): Xaa in position 3 is Pro, Val, Ala or Thr
  Variant (5)..(5): Xaa in position 5 is Gly or Ser
  Variant (6)..(6): Xaa in position 6 is any amino acid
  Variant (8)..(8): Xaa in position 8 is any amino acid
  Variant (9)..(9): Xaa in position 9 is Arg or His
  Variant (10)..(10): Xaa in position 10 is any amino acid
  Variant (12)..(12): Xaa in position 12 is Ile, Leu, Pro or Val
  Variant (14)..(15): Xaa in position 14 to 15 is any amino acid
  Variant (16)..(16): Xaa in position 16 is Phe, Tyr or Leu
  Variant (17)..(17): Xaa in position 17 is Ala, Val or Gly
  Variant (18)..(20): Xaa in position 18 to 20 is any amino acid
  Variant (21)..(21): Xaa in position 21 is Leu, Met, Ile, Phe, Ala or Thr
  Variant (22)..(24): Xaa in position 22 to 24 is any amino acid
  Variant (25)..(25): Xaa in position 25 is Leu, Ile, Val, Met, Ala or Thr
XXXFXXGXXXCXGXXXXXXXXXXXX

SEQ ID NO: 108466 - DNA, 813 bp, Zea mays
  CDS (103)..(549)
gaattcccgggtcgacttcgctgtcgacgatttcgtgttataaaggcacagctcttctgtctccacgagattgttgaattcatctctgccctagcaccagccatggcgaagccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattgggcactggacaagtgatcaaaggatgggatcagggtctcctgggaatgtgcgttggtgaaaagcggaagttgaagatcccatcaaagcttggctatgggcctcaaggctcgccacctactattcctggtggagcaaccctcatatttgacacggagcttgtcgctgtcaatggagaaccaaccaaccaatctgacgagctttagattcatcaaacaaatgaatccattcacctttttactcggaactcagcagatgtaatactttccaagaaatgagccttcattccctgccactttcatagtttctttcgctgttccacactgacatctatgatttttggagcaaactctgatctgttttgactagtttacacgtttgtgtgtggaaaaaaaaagaaaaaaaaaaaaaaaaaaaaaaaaaaaaaaaaaaaaaaaaaaaaagaaaaaaaaaaaaaaaaaagcggccgc

SEQ ID NO: 108467 - protein, 148 aa, Zea mays
MAKPQLLLCFLLAASAPLIVATAKKSGDVSELQIGVKYKPESCSIQAHKGDKVKVHYRGKLTDGTVFDSSYERGDPIEFELGTGQVIKGWDQGLLGMCVGEKRKLKIPSKLGYGPQGSPPTIPGGATLIFDTELVAVNGEPTNQSDEL

SEQ ID NO: 108468 - DNA, 339 bp, Glycine max
  CDS (1)..(339)
atgggagtggagaagcagttgttgaggtctggcaccggtccgaagccaattcccggtcagaacgtaaccgttcactgcactggtttcgggaagaacggtgacctttctcagaaattctggagcacaaaggatcctggccagaacccattcactttcaaaatcggccaaggttctgttatcaaaggatgggatgaaggtgtgcttggcatgcaaattggtgaagttgctcgtctccggtgctctccggattatgcttatggtgctggtggctttcctgcttggggaatacggcccaactctgtcttggaatttgaaatcgaagtcttaagtgcgcaatga

SEQ ID NO: 108469 - protein, 112 aa, Glycine max
MGVEKQLLRSGTGPKPIPGQNVTVHCTGFGKNGDLSQKFWSTKDPGQNPFTFKIGQGSVIKGWDEGVLGMQIGEVARLRCSPDYAYGAGGFPAWGIRPNSVLEFEIEVLSAQ

SEQ ID NO: 108470 - DNA, 339 bp, Glycine max
  CDS (1)..(339)
atgggagtggagaagcagttgttgaggtctggcaccggtccgaagccaattcccggtcagaacgtaaccgttcactgcactggtttcgggaagaacggtgacctttctcagaaattctggagcacaaaggatcctggccagaacccattcactttcaaaatcggccaaggttctgttatcaaaggatgggatgaaggtgtgcttggcatgcaaattggtgaagttgctcgtctccggtgctctccggattatgcttatggtgctggtggctttccttcttggggaatacagcccaactctgtcttggaatttgaaatcgaagtcttaagtgcgcaatga

SEQ ID NO: 108471 - protein, 112 aa, Glycine max
MGVEKQLLRSGTGPKPIPGQNVTVHCTGFGKNGDLSQKFWSTKDPGQNPFTFKIGQGSVIKGWDEGVLGMQIGEVARLRCSPDYAYGAGGFPSWGIQPNSVLEFEIEVLSAQ

SEQ ID NO: 108472 - DNA, 22 bp, Artificial sequence
  primer
atggcgaagccgcagcttcttc

SEQ ID NO: 108473 - DNA, 22 bp, Artificial sequence
  primer
ctaaagctcgtcagattggttg

SEQ ID NO: 108474 - protein, 160 aa, Artificial sequence
  consensus sequence
  Variant (2)..(6): Xaa in position 2 to 6 is any amino acid
  Variant (9)..(9): Xaa in position 9 is any amino acid
  Variant (11)..(21): Xaa in position 11 to 21 is any amino acid
  Variant (23)..(24): Xaa in position 23 to 24 is any amino acid
  Variant (29)..(30): Xaa in position 29 to 30 is any amino acid
  Variant (32)..(46): Xaa in position 32 to 46 is any amino acid
  Variant (48)..(49): Xaa in position 48 to 49 is any amino acid
  Variant (51)..(52): Xaa in position 51 to 52 is any amino acid
  Variant (54)..(56): Xaa in position 54 to 56 is any amino acid
  Variant (59)..(59): Xaa in position 59 is any amino acid
  Variant (62)..(63): Xaa in position 62 to 63 is any amino acid
  Variant (65)..(78): Xaa in position 65 to 78 is any amino acid
  Variant (80)..(81): Xaa in position 80 to 81 is any amino acid
  Variant (83)..(86): Xaa in position 83 to 86 is any amino acid
  Variant (88)..(94): Xaa in position 88 to 94 is any amino acid
  Variant (97)..(98): Xaa in position 97 to 98 is any amino acid
  Variant (100)..(147): Xaa in position 100 to 147 is any amino acid
  Variant (149)..(153): Xaa in position 149 to 153 is any amino acid
  Variant (155)..(155): Xaa in position 155 is any amino acid
  Variant (157)..(158): Xaa in position 157 to 158 is any amino acid
GXXXXXHYXGXXXXXXXXXXXGXXFDSSXXRXXXXXXXXXXXXXXXPXXFXXGXXXVIXGWXXGXXXXXXXXXXXXXXMXXGXXXXLXXXXXXXYGXXGXXXXXXXXXXXXXXXXXXXXXXXXXXXXXXXXXXXXXXXXXXXXXXXXIXXXXXLXFXXEL

SEQ ID NO: 108475 - protein, 89 aa, Artificial sequence; identical to SEQ ID NO: 1952
  protein pattern
  Variant (1)..(1): Xaa in position 1 is Tyr, Cys or Phe
  Variant (2)..(2): Xaa in position 2 is any amino acid
  Variant (3)..(3): Xaa in position 3 is Gly, Ala or Leu
  Variant (4)..(7): Xaa in position 4 to 7 is any amino acid
  Variant (8)..(14): Xaa in position 8 to 14 is any or no amino acid
  Variant (15)..(15): Xaa in position 15 is Gly, Thr, Asp or Gln
  Variant (16)..(17): Xaa in position 16 to 17 is any amino acid
  Variant (18)..(18): Xaa in position 18 is Phe, Trp, Met, Ile or Val
  Variant (19)..(19): Xaa in position 19 is Asp, Ser or Trp
  Variant (20)..(20): Xaa in position 20 is Ser, Asn, Thr or Ala
  Variant (21)..(21): Xaa in position 21 is Ser, Thr, Ile or Lys
  Variant (22)..(31): Xaa in position 22 to 31 is any amino acid
  Variant (32)..(44): Xaa in position 32 to 44 is any or no amino acid
  Variant (45)..(45): Xaa in position 45 is Leu, Met, Ile, Val or Ala
  Variant (46)..(46): Xaa in position 46 is any amino acid
  Variant (47)..(49): Xaa in position 47 to 49 is any or no amino acid
  Variant (50)..(50): Xaa in position 50 is Val, Ile, Leu or Thr
  Variant (51)..(51): Xaa in position 51 is Ile, Val or Phe
  Variant (52)..(52): Xaa in position 52 is any amino acid
  Variant (53)..(53): Xaa in position 53 is Gly, Ala or Cys
  Variant (54)..(54): Xaa in position 54 is Trp, Phe, Leu or Cys
  Variant (55)..(60): Xaa in position 55 to 60 is any amino acid
  Variant (61)..(71): Xaa in position 61 to 71 is any or no amino acid
  Variant (72)..(72): Xaa in position 72 is Met, Ile, Leu, Ala or His
  Variant (73)..(74): Xaa in position 73 to 74 is any amino acid
  Variant (76)..(86): Xaa in position 76 to 86 is any amino acid
  Variant (87)..(87): Xaa in position 87 is Ala or Gly
  Variant (88)..(88): Xaa in position 88 is Tyr or Phe
  Variant (89)..(89): Xaa in position 89 is Gly or Pro

SEQ ID NO: 108476 - DNA, 1286 bp, Zea mays
  CDS (174)..(1088)
ccgggggatcacgtcgttatcagcgaccagattcagacgcgagccgagcgggggaggcggaccacactagaactagaaccctctctacggctctactacgctacgccccatcccgcccggaccggaccggacccaccttcctccacctctctgcccgccgccggccgacccgaatgggggcgggaaccaataatggcctgagcaacggcgccgccgcagggcagcgcgcggacgacgggaccacggtgttccggggcacggcgtactcgccgctacggaccacggtggcgctcgcgctgtggctcggggccatccacttcaacgccttcctcgtcctcgcctcgctcttcctcttcccgcgccgcgtcgccgcactggtgctggcgacgcagctcttcttcatgttcctgccgctcagtgataagagcagactgggccgcaagatcgccaggttcataagcaagtacgtcattgggtattttcccgtcactttgcacgtggaagactatggcgcctttgatcccaacagggcttatgtgttcggttatgagcctcattctgttttgcccatagctgttgggatcctcggggaccttgttggattcatgccgctaccaaagatgaagattcttgcaagcagtgcggtgttctacaccccgttcctaaggcaaatatggacatggttggggttggctcctgcgtcgagaaagagtttctactcctaccttggagctggttatagctgtattatagtgccaggaggtgtgcaggaaatacttcatatggatcatgattcagagagctatgtttacaaatggtggaggccaggtggcaagttaattgtcaagattgctagagcaatcaaattttctccaataatcttctggggaaaactggggactcccatcccttttgcaacaccaatgcatgtgattgttggaaggccaattgaggttgtaaagaatcctcaacctaccattgatgagataaaccaagtccacggacagttcgttgttgcgatgcaagatctgttcgagaaatacaagagcagaactggataccctgatcttcagttaagagttctttgatggcgtgctgttccaatgaaaagctcttatcagctaggtttaagggataaaatggctgttcagacccatcgactcaattgatcgtagcatttgggctataatgttttttgagcacaggtccattattgaaattctgtaccccattccaaattagaagacgtttttttaatatgtagcttttccaaaaaaaaaaaaaaa

SEQ ID NO: 108477 - protein, 304 aa, Zea mays
MGAGTNNGLSNGAAAGQRADDGTTVFRGTAYSPLRTTVALALWLGAIHFNAFLVLASLFLFPRRVAALVLATQLFFMFLPLSDKSRLGRKIARFISKYVIGYFPVTLHVEDYGAFDPNRAYVFGYEPHSVLPIAVGILGDLVGFMPLPKMKILASSAVFYTPFLRQIWTWLGLAPASRKSFYSYLGAGYSCIIVPGGVQEILHMDHDSESYVYKWWRPGGKLIVKIARAIKFSPIIFWGKLGTPIPFATPMHVIVGRPIEVVKNPQPTIDEINQVHGQFVVAMQDLFEKYKSRTGYPDLQLRVL

SEQ ID NO: 108478 - DNA, 22 bp, Artificial sequence
  primer
atgggggcgggaaccaataatg

SEQ ID NO: 108479 - DNA, 24 bp, Artificial sequence
  primer
tcaaagaactcttaactgaagatc

SEQ ID NO: 108480 - protein, 379 aa, Artificial sequence; identical to SEQ ID NO: 44316
  consensus sequence
  Variant (3)..(35): Xaa in position 3 to 35 is any amino acid
  Variant (37)..(41): Xaa in position 37 to 41 is any amino acid
  Variant (43)..(48): Xaa in position 43 to 48 is any amino acid
  Variant (50)..(65): Xaa in position 50 to 65 is any amino acid
  Variant (67)..(70): Xaa in position 67 to 70 is any amino acid
  Variant (72)..(76): Xaa in position 72 to 76 is any amino acid
  Variant (80)..(81): Xaa in position 80 to 81 is any amino acid
  Variant (83)..(83): Xaa in position 83 is any amino acid
  Variant (86)..(87): Xaa in position 86 to 87 is any amino acid
  Variant (89)..(92): Xaa in position 89 to 92 is any amino acid
  Variant (94)..(140): Xaa in position 94 to 140 is any amino acid
  Variant (142)..(143): Xaa in position 142 to 143 is any amino acid
  Variant (145)..(145): Xaa in position 145 is any amino acid
  Variant (150)..(153): Xaa in position 150 to 153 is any amino acid
  Variant (155)..(160): Xaa in position 155 to 160 is any amino acid
  Variant (162)..(169): Xaa in position 162 to 169 is any amino acid
  Variant (173)..(176): Xaa in position 173 to 176 is any amino acid
  Variant (178)..(179): Xaa in position 178 to 179 is any amino acid
  Variant (181)..(183): Xaa in position 181 to 183 is any amino acid
  Variant (185)..(186): Xaa in position 185 to 186 is any amino acid
  Variant (188)..(189): Xaa in position 188 to 189 is any amino acid
  Variant (191)..(196): Xaa in position 191 to 196 is any amino acid
  Variant (198)..(209): Xaa in position 198 to 209 is any amino acid
  Variant (211)..(231): Xaa in position 211 to 231 is any amino acid
  Variant (233)..(234): Xaa in position 233 to 234 is any amino acid
  Variant (238)..(238): Xaa in position 238 is any amino acid
  Variant (240)..(240): Xaa in position 240 is any amino acid
  Variant (242)..(244): Xaa in position 242 to 244 is any amino acid
  Variant (247)..(249): Xaa in position 247 to 249 is any amino acid
  Variant (251)..(251): Xaa in position 251 is any amino acid
  Variant (253)..(254): Xaa in position 253 to 254 is any amino acid
  Variant (259)..(261): Xaa in position 259 to 261 is any amino acid
  Variant (263)..(265): Xaa in position 263 to 265 is any amino acid
  Variant (267)..(269): Xaa in position 267 to 269 is any amino acid
  Variant (273)..(275): Xaa in position 273 to 275 is any amino acid
  Variant (280)..(283): Xaa in position 280 to 283 is any amino acid
  Variant (285)..(290): Xaa in position 285 to 290 is any amino acid
  Variant (292)..(300): Xaa in position 292 to 300 is any amino acid
  Variant (302)..(308): Xaa in position 302 to 308 is any amino acid
  Variant (310)..(317): Xaa in position 310 to 317 is any amino acid
  Variant (320)..(320): Xaa in position 320 is any amino acid
  Variant (322)..(326): Xaa in position 322 to 326 is any amino acid
  Variant (328)..(329): Xaa in position 328 to 329 is any amino acid
  Variant (331)..(333): Xaa in position 331 to 333 is any amino acid
  Variant (336)..(337): Xaa in position 336 to 337 is any amino acid
  Variant (341)..(341): Xaa in position 341 is any amino acid
  Variant (344)..(344): Xaa in position 344 is any amino acid
  Variant (346)..(354): Xaa in position 346 to 354 is any amino acid
  Variant (356)..(363): Xaa in position 356 to 363 is any amino acid
  Variant (365)..(366): Xaa in position 365 to 366 is any amino acid
  Variant (368)..(370): Xaa in position 368 to 370 is any amino acid
  Variant (372)..(378): Xaa in position 372 to 378 is any amino acid

SEQ ID NO: 108481 - protein, 47 aa, Artificial sequence; identical to SEQ ID NO: 22528
  protein pattern
  Variant (2)..(3): Xaa in position 2 to 3 is any amino acid
  Variant (4)..(4): Xaa in position 4 is Trp, Tyr or Phe
  Variant (5)..(21): Xaa in position 5 to 21 is any amino acid
  Variant (22)..(24): Xaa in position 22 to 24 is any or no amino acid
  Variant (25)..(25): Xaa in position 25 is Arg or Gln
  Variant (26)..(29): Xaa in position 26 to 29 is any amino acid
  Variant (30)..(30): Xaa in position 30 is Trp, His, Phe or Asn
  Variant (31)..(32): Xaa in position 31 to 32 is any amino acid
  Variant (33)..(33): Xaa in position 33 is Phe, Tyr, Met or Leu
  Variant (34)..(35): Xaa in position 34 to 35 is any amino acid
  Variant (37)..(37): Xaa in position 37 is Phe or Tyr
  Variant (39)..(39): Xaa in position 39 is Ile, Val, Ala or Leu
  Variant (40)..(40): Xaa in position 40 is any amino acid
  Variant (41)..(41): Xaa in position 41 is Leu or Val
  Variant (42)..(42): Xaa in position 42 is Val, His or Ile
  Variant (44)..(44): Xaa in position 44 is Thr, Glu or Ser
  Variant (45)..(45): Xaa in position 45 is any amino acid
  Variant (46)..(46): Xaa in position 46 is Asp, Glu or Asn
  Variant (47)..(47): Xaa in position 47 is Leu or Met

SEQ ID NO: 108482 - protein, 70 aa, Artificial sequence; identical to SEQ ID NO: 22529
  protein pattern
  Variant (2)..(2): Xaa in position 2 is Ile, Leu or Val
  Variant (3)..(3): Xaa in position 3 is any amino acid
  Variant (4)..(4): Xaa in position 4 is Gly, Ala or Ser
  Variant (5)..(5): Xaa in position 5 is any amino acid
  Variant (6)..(6): Xaa in position 6 is His or Phe
  Variant (10)..(10): Xaa in position 10 is Ile, Val or Met
  Variant (11)..(13): Xaa in position 11 to 13 is any amino acid
  Variant (14)..(14): Xaa in position 14 is Gly or Ala
  Variant (15)..(18): Xaa in position 15 to 18 is any amino acid
  Variant (19)..(19): Xaa in position 19 is Phe, Met, Leu or Ile
  Variant (20)..(20): Xaa in position 20 is Ala, Ser, Cys or Gly
  Variant (21)..(21): Xaa in position 21 is any amino acid
  Variant (22)..(22): Xaa in position 22 is Glu, Asn, Asp or Lys
  Variant (23)..(29): Xaa in position 23 to 29 is any amino acid
  Variant (30)..(30): Xaa in position 30 is Phe, Tyr or Leu
  Variant (31)..(31): Xaa in position 31 is Pro or Ala
  Variant (32)..(32): Xaa in position 32 is any amino acid
  Variant (33)..(33): Xaa in position 33 is Ile, Phe, Val or Leu
  Variant (34)..(36): Xaa in position 34 to 36 is any amino acid
  Variant (37)..(37): Xaa in position 37 is Leu, Ile or Val
  Variant (38)..(38): Xaa in position 38 is any amino acid
  Variant (39)..(39): Xaa in position 39 is Thr, Val or Met
  Variant (40)..(40): Xaa in position 40 is Leu or Ala
  Variant (41)..(43): Xaa in position 41 to 43 is any amino acid
  Variant (45)..(46): Xaa in position 45 to 46 is any amino acid
  Variant (48)..(49): Xaa in position 48 to 49 is any amino acid
  Variant (51)..(51): Xaa in position 51 is Glu or Asp
  Variant (52)..(53): Xaa in position 52 to 53 is any amino acid
  Variant (54)..(54): Xaa in position 54 is Met, Leu, Arg or Ile
  Variant (55)..(56): Xaa in position 55 to 56 is any amino acid
  Variant (58)..(62): Xaa in position 58 to 62 is any amino acid
  Variant (63)..(63): Xaa in position 63 is Arg or Lys
  Variant (64)..(64): Xaa in position 64 is any amino acid
  Variant (65)..(65): Xaa in position 65 is Ser, Thr, Ala or Asn
  Variant (66)..(69): Xaa in position 66 to 69 is any amino acid

SEQ ID NO: 108483 - protein, 60 aa, Artificial sequence; identical to SEQ ID NO: 22530
  protein pattern
  Variant (1)..(1): Xaa in position 1 is Ile or Leu
  Variant (2)..(2): Xaa in position 2 is Val, Ile, Leu, Met or Ala
  Variant (3)..(3): Xaa in position 3 is Val, Ile or Leu
  Variant (7)..(7): Xaa in position 7 is any amino acid
  Variant (9)..(9): Xaa in position 9 is Ala or Ser
  Variant (10)..(10): Xaa in position 10 is Leu or Met
  Variant (11)..(11): Xaa in position 11 is any amino acid
  Variant (12)..(12): Xaa in position 12 is Ala, Ser or Cys
  Variant (13)..(13): Xaa in position 13 is any amino acid
  Variant (14)..(14): Xaa in position 14 is Pro, Thr or Val
  Variant (15)..(15): Xaa in position 15 is Gly or Asn
  Variant (16)..(18): Xaa in position 16 to 18 is any amino acid
  Variant (19)..(19): Xaa in position 19 is Leu or Val
  Variant (20)..(20): Xaa in position 20 is any amino acid
  Variant (21)..(21): Xaa in position 21 is Leu or Ile
  Variant (22)..(23): Xaa in position 22 to 23 is any amino acid
  Variant (25)..(25): Xaa in position 25 is Lys or Arg
  Variant (28)..(28): Xaa in position 28 is Val, Ile or Cys
  Variant (29)..(29): Xaa in position 29 is Lys or Arg
  Variant (30)..(30): Xaa in position 30 is any amino acid
  Variant (32)..(32): Xaa in position 32 is Leu, Ile, Val or Met
  Variant (33)..(34): Xaa in position 33 to 34 is any amino acid
  Variant (36)..(36): Xaa in position 36 is Asn or no amino acid
  Variant (37)..(38): Xaa in position 37 to 38 is any amino acid
  Variant (39)..(39): Xaa in position 39 is Leu or Ile
  Variant (42)..(43): Xaa in position 42 to 43 is any amino acid
  Variant (44)..(44): Xaa in position 44 is Ser, Ala, Thr or Asn
  Variant (48)..(48): Xaa in position 48 is Asn, Val or Thr
  Variant (49)..(49): Xaa in position 49 is Asp, Glu or Asn
  Variant (50)..(50): Xaa in position 50 is any amino acid
  Variant (51)..(51): Xaa in position 51 is Tyr, Phe or Leu
  Variant (52)..(52): Xaa in position 52 is any amino acid
  Variant (53)..(53): Xaa in position 53 is Gln, Val, Ile or Leu
  Variant (54)..(59): Xaa in position 54 to 59 is any amino acid
  Variant (60)..(60): Xaa in position 60 is Ser or Thr

SEQ ID NO: 108484 - protein, 79 aa, Artificial sequence; identical to SEQ ID NO: 22531
  protein pattern
  Variant (2)..(4): Xaa in position 2 to 4 is any amino acid
  Variant (5)..(5): Xaa in position 5 is Lys, Gln or Tyr
  Variant (6)..(8): Xaa in position 6 to 8 is any amino acid
  Variant (10)..(10): Xaa in position 10 is Phe, Ile, Val or Leu
  Variant (11)..(12): Xaa in position 11 to 12 is any amino acid
  Variant (13)..(13): Xaa in position 13 is Pro, Cys, Leu or Ala
  Variant (14)..(16): Xaa in position 14 to 16 is any amino acid
  Variant (17)..(17): Xaa in position 17 is Gly or Ala
  Variant (18)..(18): Xaa in position 18 is Arg or Cys
  Variant (19)..(19): Xaa in position 19 is Gly or Ser
  Variant (20)..(20): Xaa in position 20 is any amino acid
  Variant (21)..(21): Xaa in position 21 is Phe or Thr
  Variant (22)..(25): Xaa in position 22 to 25 is any amino acid
  Variant (26)..(26): Xaa in position 26 is any or no amino acid
  Variant (28)..(28): Xaa in position 28 is Leu, Phe, Ile or Tyr
  Variant (29)..(29): Xaa in position 29 is Leu, Val, Met or Ile
  Variant (31)..(31): Xaa in position 31 is any amino acid
  Variant (32)..(32): Xaa in position 32 is Arg, Ser, Ala or Asn
  Variant (33)..(33): Xaa in position 33 is any amino acid
  Variant (34)..(34): Xaa in position 34 is Pro, Arg, Leu or Ala
  Variant (35)..(35): Xaa in position 35 is Ile, Leu or Val
  Variant (36)..(36): Xaa in position 36 is any amino acid
  Variant (37)..(37): Xaa in position 37 is Thr, Val, Gln or Ile
  Variant (38)..(38): Xaa in position 38 is Val or Ile
  Variant (39)..(39): Xaa in position 39 is Val, Met or Leu
  Variant (41)..(41): Xaa in position 41 is any amino acid
  Variant (43)..(43): Xaa in position 43 is Ile, Leu or Val
  Variant (44)..(44): Xaa in position 44 is any amino acid
  Variant (45)..(45): Xaa in position 45 is Val or Ile
  Variant (46)..(50): Xaa in position 46 to 50 is any amino acid
  Variant (51)..(54): Xaa in position 51 to 54 is any or no amino acid
  Variant (55)..(55): Xaa in position 55 is Pro or Thr
  Variant (56)..(57): Xaa in position 56 to 57 is any amino acid
  Variant (58)..(59): Xaa in position 58 to 59 is any or no amino acid
  Variant (60)..(60): Xaa in position 60 is Ile, Val, Met or Leu
  Variant (61)..(63): Xaa in position 61 to 63 is any amino acid
  Variant (65)..(66): Xaa in position 65 to 66 is any amino acid
  Variant (67)..(67): Xaa in position 67 is Tyr, Val or Phe
  Variant (68)..(70): Xaa in position 68 to 70 is any amino acid
  Variant (71)..(71): Xaa in position 71 is Leu or Val
  Variant (72)..(73): Xaa in position 72 to 73 is any amino acid
  Variant (74)..(74): Xaa in position 74 is Leu, Ile, Val or Met
  Variant (75)..(75): Xaa in position 75 is Phe, Tyr or Trp
  Variant (76)..(77): Xaa in position 76 to 77 is any amino acid
  Variant (78)..(78): Xaa in position 78 is His, Tyr or Asn
  Variant (79)..(79): Xaa in position 79 is Lys or Arg
